United States Patent 11,098,302 (IDENTIFICATION OF POLYNUCLEOTIDES ASSOCIATED WITH A SAMPLE) - sequence listing, part 86

SEQ ID NO: 298609 - DNA, 620 bp, Homo sapiens
  misc_feature: GZ8MTXP01EDR33.13.36.D03.1.454.CMB.2.raw
  modified_base (300)..(300): a, c, t, g, unknown or other
  misc_feature (300)..(300): n is a, c, g, or t
  modified_base (346)..(346): a, c, t, g, unknown or other
  misc_feature (346)..(346): n is a, c, g, or t
  modified_base (465)..(465): a, c, t, g, unknown or other
  misc_feature (465)..(465): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcacgccaccctcggtgtcagtcggccccaggacaggacggccaggattaccgtggtagggggaaaacacagttaggaaagtaaaagtgtgacacgtggtaaccagcaagaagccaggccacggcccctgngctggtctctatgttagatacgcgaccggccctgagggacttccgngacgcgtacttcgcggctaccaactcgtacgggaacaccggccactcgtacgacctagtcgagggttagggaccggaaacggccgggggatagggacggccgtaaacgttattacgtgngtaagggtggtagggggtaagttaggttaacgtcgtagaacgtgtagtaggttggtaggtacgggtacgggaacgggaacgaaacgttacgtaccgttaccgtacggtcgacgccgacgcgtccgcccgtccgtcgacctccgttccgttccccg

SEQ ID NO: 298610 - DNA, 713 bp, Homo sapiens
  misc_feature: GZ8MTXP01EJA3M.13.36.D03.1.454.CMB.2.raw
  modified_base (232)..(232): a, c, t, g, unknown or other
  misc_feature (232)..(232): n is a, c, g, or t
  modified_base (251)..(251): a, c, t, g, unknown or other
  misc_feature (251)..(251): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagcccaccctcggtgtcagtcggccccaggacagacgcaggatacctggtaggggaaacanagttaggaaagtaaaggtngtgacagtacgacgacgcgagacgaccgaccgacgaccgcccgtcgtcgtcgtggtcgtacgtagttgtcgtacgtacgtaccggacccggcccgtaccggacggtaccgtccgtacgtacggacccgtacgttacgtaccggtccgtacccgtaaaccgtaccgtaacggaaccgtaccgacccgacctaccgtaccgaccgtacgtacgtacgggtacgggtacggaacgggaccgggtacggtacggtacggtaccgtacgtaacgttacgtacggtacgtaggtaggggtaggtaggtaggtaggtacgtaggtagtagtagtggttaggttacggtacgggtacgggtaacgggtaaccgttaaacggtacggttaccgtaccgtaacggttacgccgacccggtaaccggtccgtcccgtccccgtcccggttaccgtaacccgttcccgttcccg

SEQ ID NO: 298611 - DNA, 665 bp, Homo sapiens
  misc_feature: GZ8MTXP01CH136.13.36.D03.1.454.CMB.2.raw
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtcggccccaggacagaccggccaggattacctggtagggggaaacaacattaggaaagtaaaagtgtgcactggtaccagcagaagccaggccacggcccctgtgctggtcgtctatgtgatgcgaccggccctgagggactcccgtgacgcgtacttccgtcgggctaccgaactcgtagggaaccacgggcccactcgtacgaccatccgaggtacgggtacggaaacgggccggggatgggaacgggtccccggtaatagtttaccgtgtacggtagggttgggtaggggggtaattaagggttaggtcggtgagcgtaagttgggttggtaaggtttcggggacgggtaaggggaaccctaaacgttcgggaaacccgttccggtaaacgggtccaaccgggttcccaaacgggggtccctcccggtccccccgtacggtccttacccgttcccgttccggtttcccccccg

SEQ ID NO: 298612 - DNA, 582 bp, Homo sapiens
  misc_feature: GZ8MTXP01EOQCU.13.36.D03.1.454.CMB.2.raw
tcagtcacgtactacacgaccggtgctcgatttagctgcgtcacgatctctcttggggtcacatgggaagtgctttctgagagtcatggacctcctgcacaagaacatgaaacacctgtggttctgcctcctcctggtggcagctcccagatgggtcctgtcccaggtgcagctacagcaagtggggcgcaggggctgttgaagccttcggagaccctgtccctcacgtgcgctgtctcgtggttgggttcttcagtggttactacgtggagctggatccgccagtccccgagggagggctggagtggagttagggggaaatcaatcagtagtggaagcaccaacctaccaaccgtccctcgagaacgccgaagtcaccatgtcagtacgacacgtcaaacgaacctagttcctcccgtaggagggttgacgctcgtgtcgacccgccggggcggacgacggcgtgtgtacttcgtgtcgcgagagtctaagtttttcggacttcgttctattccttcccgtttgttaccgttcgtcggggtcccgtacgggtacccttacgttcccgttaaccgttcccgg

SEQ ID NO: 298613 - DNA, 576 bp, Homo sapiens
  misc_feature: GZ8MTXP01D8Y12.13.36.D03.1.454.CMB.2.raw
  modified_base (207)..(207): a, c, t, g, unknown or other
  misc_feature (207)..(207): n is a, c, g, or t
  modified_base (210)..(210): a, c, t, g, unknown or other
  misc_feature (210)..(210): n is a, c, g, or t
  modified_base (221)..(221): a, c, t, g, unknown or other
  misc_feature (221)..(221): n is a, c, g, or t
  modified_base (227)..(227): a, c, t, g, unknown or other
  misc_feature (227)..(227): n is a, c, g, or t
  modified_base (232)..(232): a, c, t, g, unknown or other
  misc_feature (232)..(232): n is a, c, g, or t
  modified_base (237)..(237): a, c, t, g, unknown or other
  misc_feature (237)..(237): n is a, c, g, or t
  modified_base (241)..(241): a, c, t, g, unknown or other
  misc_feature (241)..(241): n is a, c, g, or t
  modified_base (252)..(252): a, c, t, g, unknown or other
  misc_feature (252)..(252): n is a, c, g, or t
  modified_base (254)..(254): a, c, t, g, unknown or other
  misc_feature (254)..(254): n is a, c, g, or t
  modified_base (265)..(265): a, c, t, g, unknown or other
  misc_feature (265)..(265): n is a, c, g, or t
  modified_base (300)..(300): a, c, t, g, unknown or other
  misc_feature (300)..(300): n is a, c, g, or t
  modified_base (302)..(302): a, c, t, g, unknown or other
  misc_feature (302)..(302): n is a, c, g, or t
  modified_base (310)..(310): a, c, t, g, unknown or other
  misc_feature (310)..(310): n is a, c, g, or t
  modified_base (326)..(326): a, c, t, g, unknown or other
  misc_feature (326)..(326): n is a, c, g, or t
  modified_base (332)..(332): a, c, t, g, unknown or other
  misc_feature (332)..(332): n is a, c, g, or t
  modified_base (335)..(335): a, c, t, g, unknown or other
  misc_feature (335)..(335): n is a, c, g, or t
tcagtcacgtactacacgaccggtgctcgatttagctgcgtcacgatctctcttggggagcttcagctgtggtagagaagacaggattcaggacaatctccagcatggccggcttccctctcctcctcaccctcctcactcactgtgcagggtcctgggcccagtctgtgctgactcagccaccctcagcgtctgggaccccccggnagngtgcacatctnttgtcnggagnagtcncaangtcggataatngntattcgtgtanacaacactccgaggaccgcccagctcacatactananacaatacngccgcctcgacggtcngacctntcncgtcgctaccgagtctcgcactcacgccctccgcgactagtcgaggtcggcctccggaccgacgagtagacgtcgtagtaatttacgttacgttgttacgaggtcgttaggatacgactacgtacctaagtaacgttacgggttttcggggtttacgggacgggtaacgggttaaccgttaacggttaccggaacccggtacccgtaaggtaccgaccgacccgtaacggttcccgtcccg

SEQ ID NO: 298614 - DNA, 633 bp, Homo sapiens
  misc_feature: GZ8MTXP01CXAVU.13.36.D03.1.454.CMB.2.raw
  modified_base (597)..(597): a, c, t, g, unknown or other
  misc_feature (597)..(597): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtcggccccaggacagacgcaggatacctgtaggggaaacaacattaggaaagtaaagtgtgacactggtaccagcagaagccaggccaggcccctgcgctggtctctatgttgatagcgaccgccctcgagggtactcccgtgagcgtacttcgcggctacccaactcgtacgggaaccacgggccaaactccgtacgaaccctagtaccgaaggttaacggggacgaaacgggcccgggggtaagttacgggaacgggacccggtaacttacgttaaccgtggttaccgaaggggtccgtaggggggaacagggacacggcaccgtcgcccttacccggttacggaaacgtcggaacctaaagggtccaaaccgttccgtagcgaccgacccaacgcccaaccccgntccgtccacttcttaccgttcccccaaccgttcccg

SEQ ID NO: 298615 - DNA, 913 bp, Homo sapiens
  misc_feature: GZ8MTXP01BXGUF.13.36.D03.1.454.CMB.2.raw
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcacgccaccctcggtgtcaggtcggccccaggacagacggccaggtacttaccgtggtacgggggaaacaacgtagttagggaaagttaaaagtgtagacacgtggtaccagcagaacgccgaggccacggccccgtggtcgtccgtggtccgtcgttagttgttcgaacgttaacggcccggtaccccggtccccgttacggaacgggggtaccttccccggtagaacggtccgtaaccgtttccggtacgggggacccttacccgaaacccgtttcccgggaacggggaaacccgcccggggtaacccctacccgtttaccgtaccggaaaccccgtacgttacccggaaaggggtttaacgggggtaaccgggaaacggggccccggggggtaaattacgggggaaacgggtaccccgggttaaaattaccggtttaaccgttagggtaacggtaagggggtttagggttacggggggggttaaatttaacgggggtttaaaggttccgggttaggaaccggtacgttaaaggttccggggtttaggggtaaaccggtttccggggggaaccggggtaaacccgggggtaaaacccgtaaaacgggttcccgggtaaaccccgggttaccgttaaacgggtacccgttaacccgggaccccgaacggggtcccgttaccccggtaacccccggttccgggtacccttacccgtttcccggttccccggtttcccccccgg

SEQ ID NO: 298616 - DNA, 765 bp, Homo sapiens
  misc_feature: GZ8MTXP01BHF5B.13.36.D03.1.454.CMB.2.raw
  modified_base (212)..(212): a, c, t, g, unknown or other
  misc_feature (212)..(212): n is a, c, g, or t
  modified_base (283)..(283): a, c, t, g, unknown or other
  misc_feature (283)..(283): n is a, c, g, or t
tcagtcacgtactacacgaccggtgctcgatttagctgcgtcacgatctctcttggggagcttcagctgtggtagagaagacaggattcaggacaatctccagcatggccggcttccctctcctcctcaccctcctcactcactgtgcagggtcctgggcccagtctgtgctgactcagccaccctcagccgtcgtcggggaccccccgggnagagtcgtaccacctattcttcttgttcgtgggaggcagtcgaccaacgaggtacgggtaagttaattagngtactagtttcgtaggttaactaaccaaacctaacccgtaccccggaaacgggaaacccccggacccccctaacgtaccccttaccctactacttaccttaataacgaacctaaacgtaacccgacggtccccggtaccccgtacccggtaccggggtcctacggtacccgtacttaccgtcgtcgtccctaccgtaacgtcgtacggacctacccgtccgtacccgtcccctcccgtcggaccctacgttaccggacgggtccgggtcccgttacccgggtaccgacgtagtacggtacggtcgttagttatttaacgttacgttgttacgcggttcggttagggactacgacgtacgtccgtaagttaacgtttacgggtttcggggttaccgggaacggggtacggttaaccgttacgggttacccggaacccggtccgtaacggtacccgacggacccgtaacgggttcccgtcccgg

SEQ ID NO: 298617 - DNA, 639 bp, Homo sapiens
  misc_feature: GZ8MTXP01DJVEH.13.36.D03.1.454.CMB.2.raw
  modified_base (427)..(427): a, c, t, g, unknown or other
  misc_feature (427)..(427): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctgtagggggaaacaacattaggaaagtaaaagtgtgcactggtaccagcagaagccaggccaggcccctgtgctggtcgtctatgttgatagcgaccggccctcaggggactccctgagcgacttcgtcgggctcccaaactcgtagggaaccacgggccaactctgaccatcaggtagggtcgaagccggggatggaggcatatacgngtcaggtgtgggggatagtagtcgtgagctagttggtggttaattccgggggacgggtaaacgggggaaaccctaaaaccgttgggtaaccccggttacccgtaaagggttacccgaaccgggaccccgaaaccggggtccctacccgggtaaccccccccgttccggggttaccttaacccgttcccggtttcccggtttaaccccccccc

SEQ ID NO: 298618 - DNA, 752 bp, Homo sapiens
  misc_feature: GZ8MTXP01D04FO.13.36.D03.1.454.CMB.2.raw
  modified_base (383)..(383): a, c, t, g, unknown or other
  misc_feature (383)..(383): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtcggccccaggacagacgccaggattaccgtgtaggggaaacaacattaggaaagtaaaagtgtgacactggtaccagacagaacgccaggccaaggcccctgtcgctggtacgtctatgtgataggcgaccggccctgaggctcccgtgagcgtacttccgtacgggctcccgaaaccgtcgtacgggaaccncgggaccctaccgtcgtcgaaccctagtaccgtaaggtacggggtacggaaacgggccgggggtaattacggggaacgggtacccgtaacgttaacgtttaccgttaggtaccgtaaggggttgggttagggggtaacgttagggttaacggttccggttagggaccgtcgaaggtttgggttagggttaacggtttccggggacggggaacgggtaaaccccgtaaaacggttccggtaaccccgggttaccggttaaacgggttcccgaaaaccggttccccggaaaacggggtccctaccccgggttcccccgttcccgggtaaccttaccccgggttttccccttcccgggttttccccccccgg

SEQ ID NO: 298619 - DNA, 581 bp, Homo sapiens
  misc_feature: GZ8MTXP01DE2MG.13.36.D03.1.454.CMB.2.raw
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctgtagggggaaacaacattaggaagtaaaagtgtgacactggtaccagcagaagccaggccaggcccctgtgctggtcgtctatgttgatagcgaccggccctgagggatccctgagcgtacttcgtcgggctccaactcgtagggaacacggccactctgaccatcgagtagggtcgaaggccggggatggaggccgattatactgtcaggtgtgggggataggtagtcgtgagctagtggttgggtaacgttcgggcggaacggggaacctaaacgttcggacccgttcgtaagggtcgaacggttcccgaagggccttacgcccccgttacgggtccaccgttccgttcggttccccccg

SEQ ID NO: 298620 - DNA, 672 bp, Homo sapiens
  misc_feature: GZ8MTXP01ECASR.13.36.D03.1.454.CMB.2.raw
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcacgcccaccctcggtgtcaggtcggccccaggacaggacggccaggtacttaccgtggtagggggaaacaacgtagttagggaaagtaaaagtgtagacacgtggtaccagcaagaacgccgaggccacggccccgtgtcgcgtggtcgtctagtgttgagtacgccggacccggccctacggacgggtactcccgtgacgcgtacttccgcggctaccgaactcgtaggaaccgcggccactctacgaccagtcgaggtacgggtacggaagggccggggatcgggaacggaccctaattacgttacgtgtacggtaagggttggtagggggtaattagggttacgtcggtagacgtgtaggttgggtaggttaacgggttcgggacggggaacggaaacctaaacggttcggtaacccgttcgtaacgggaccacggcccgaacggtccgtcccgtcccccgttcggacccttaccgttcccgttccgttaaccccccg

SEQ ID NO: 298621 - DNA, 596 bp, Homo sapiens
  misc_feature: GZ8MTXP01EELYB.13.36.D03.1.454.CMB.2.raw
  modified_base (225)..(225): a, c, t, g, unknown or other
  misc_feature (225)..(225): n is a, c, g, or t
  modified_base (238)..(238): a, c, t, g, unknown or other
  misc_feature (238)..(238): n is a, c, g, or t
  modified_base (293)..(293): a, c, t, g, unknown or other
  misc_feature (293)..(293): n is a, c, g, or t
  modified_base (498)..(498): a, c, t, g, unknown or other
  misc_feature (498)..(498): n is a, c, g, or t
tcagtcacgtactacacgaccggtgctcgatttagctgcgtcacgatctctcttggggagtctgggcctaaggaagcagcactggtggtgcctcagccatggcctggaccgttctcctccctcggcctccctctctcactgcacaggctctgtgacctcctatgtgctgactcacgcccacccctcggtgtcagtcggccccaggacagacgccaggattaccgngtaggggaaacanattaggaaagtaaagtgtgcacgtggtaccagcagaacgcaggccacggccctgngctggtctctatgtgatgcgaccgccctgagggactcccgtgacgcgacttccgcgggctacccgaactcggtacgggaaccacggccctaactctacgacccataccgaggtacgggtacggaacgggccggggatagggacggaccggtaacttagttaaccgtgtacgagggtggtagggggtaagtacggtagtcgtgagngtagtgtggtagtcgggacgggaacggaaccgtaacgcgtaccgttcgtacgcgacgccgacgcctccgcccgtcgtccttacctccgttcccgtccc

SEQ ID NO: 298622 - DNA, 665 bp, Homo sapiens
  misc_feature: GZ8MTXP01BK0PG.13.36.D03.1.454.CMB.2.raw
  modified_base (298)..(298): a, c, t, g, unknown or other
  misc_feature (298)..(298): n is a, c, g, or t
  modified_base (384)..(384): a, c, t, g, unknown or other
  misc_feature (384)..(384): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtcggccccaggacaggacggccaggattaccgtggtagggggaaacaacagttagggaaagtaaaagtgtagacactggtaccagcaagaagccaggccaggcccctgngcgtggtcgtctatgttgatagcgaccggccctcgagggactcccgtgacgcgacttcgtcgggactccaacgtcgtagggaaccncggcccactctacgaccatcgaggtacgggtacgaagggccggggtatgggaacggtccgtaatacgttaaccgtgtacgaggggttggtagggggtaagttaggttacggtacggtagagcgtaaggttcggttaggttacggttacggggacgggtaacggggaaaccctaaacgttcgggtacccgttacgttaacgggtccgaaccggttcccggaaggtcccgtcccggtcccccgttcgggtacccttaccttcccgttaacccggttccccccg

SEQ ID NO: 298623 - DNA, 662 bp, Homo sapiens
  misc_feature: GZ8MTXP01CKG95.13.36.D03.1.454.CMB.2.raw
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtcggccccaggacagacgcaggattaccgtgtaggggaaacacattaggaaagtaaaagtgtagcactggtaccagcagaacgccaggccaggcccctgtgctggtcgtctatgtgatagcgaccggccctgagggactcccgtagacgcgtacttccggtacgggtcctaccgaacgtcgtacgggaaccacgggcccaactccgtacgacccgtatacgaacgggtacggggtaccgaaacggggtccggggaagtacggaacgggtacccgaacttacgttacgagtccggaagggttcgggtaggggggtagttaacgggtaggtacggtaggaagtcgtagttcgggtagggttacggtcgggacgggaagggtaacccctaaaggttcgtaccgttacgtacgggtcacggcccgaacgggtcctccggtcccccgtcggtaccttaccttccgttcgttccccccg

SEQ ID NO: 298624 - DNA, 582 bp, Homo sapiens
  misc_feature: GZ8MTXP01EHEIU.13.36.D03.1.454.CMB.2.raw
  modified_base (486)..(486): a, c, t, g, unknown or other
  misc_feature (486)..(486): n is a, c, g, or t
  modified_base (546)..(546): a, c, t, g, unknown or other
  misc_feature (546)..(546): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagcccaccctcggtgtcaggtcggccccaggacaggacggccaggtacttaccgtggtagggggaaacaactagttagggaaagtaaaagtggtagcacgtggtaccagcaagaagccgaggccaggcccctgtgctggctctagtgttgatgccgaccggccctgacgggactccgtgacgctacttcgtcggctaccaacgttcgacggaacgaccggccacgtctacgaccagtacgaggttagggacgaagggcgggatggacgaccgtatactagacgtgaaggtgtagggggaattaggtagtgagagngtagtggtgtagtcgggcggtaggaacctaaagttccgacgttcgtagcacggccaggcncccgaaccccgtgccttaccgtccgttccgttcccc

SEQ ID NO: 298625 - DNA, 621 bp, Homo sapiens
  misc_feature: GZ8MTXP01BX4FQ.13.36.D03.1.454.CMB.2.raw
  modified_base (387)..(387): a, c, t, g, unknown or other
  misc_feature (387)..(387): n is a, c, g, or t
  modified_base (462)..(462): a, c, t, g, unknown or other
  misc_feature (462)..(462): n is a, c, g, or t
  modified_base (499)..(499): a, c, t, g, unknown or other
  misc_feature (499)..(499): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtcggccccaggacagacggccaggtattaccgtggtagggggaaacaacgagttaggaaagtaaaagtgtgcacgtaggtacagcagagccgaggccacggcccctgtgcgtggtcgtctatgttgatagccgaccggccctcgaggtactcccgtgacgcgtacgttcgtcgggcctaccaacgtcgtacgggaacncgggacccactcgtcgaccagtcgaaggtacggtacgaacgggccggggatggaacggccgtaacgtacttacgngtacgaggtgggtaggggagtagtagtcggtagacgngtagtggtggtagtcggggacggacggaaacctaacgttcggtacccgttcgtacggtcgaccggttcccgacggtccctccggtccccgtacggtccttaccttcccgttcgttaaccccc

SEQ ID NO: 298626 - DNA, 644 bp, Homo sapiens
  misc_feature: GZ8MTXP01CCAOO.13.36.D03.1.454.CMB.2.raw
  modified_base (301)..(301): a, c, t, g, unknown or other
  misc_feature (301)..(301): n is a, c, g, or t
  modified_base (345)..(345): a, c, t, g, unknown or other
  misc_feature (345)..(345): n is a, c, g, or t
  modified_base (360)..(360): a, c, t, g, unknown or other
  misc_feature (360)..(360): n is a, c, g, or t
  modified_base (534)..(534): a, c, t, g, unknown or other
  misc_feature (534)..(534): n is a, c, g, or t
  modified_base (607)..(607): a, c, t, g, unknown or other
  misc_feature (607)..(607): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagcccaccctcggtgtcagtcggccccaggacagacggccaggattaccgtggtagggggaaacaacagttaggaaagtaaaagtgtgacacgtggtaccagcaagaacgccgaggccacggcccctggngctggtctctatgttgatagccgaccggccctgagggactccgngacgcgtacttccgngggcctaccgaactcggagggaaccaccgggccctacttcacgaaccctagtaccgtaaggtacggggtacggaaacgggcccgggggaagtcgggaaaccgggtcccgtaaacgttagttaaccgtggtacgtaaggggtggttaggggggaattagggtagtcggtagacgngtagtggtagtggtacggcgggaacgggaaccaaaggttccgaccgttaccgtaggcgacgcccgaaggtccnccgtcccccgtggaccttcctccgttcccgttccccc

SEQ ID NO: 298627 - DNA, 587 bp, Homo sapiens
  misc_feature: GZ8MTXP01D6YNO.13.36.D03.1.454.CMB.2.raw
  modified_base (245)..(245): a, c, t, g, unknown or other
  misc_feature (245)..(245): n is a, c, g, or t
  modified_base (327)..(327): a, c, t, g, unknown or other
  misc_feature (327)..(327): n is a, c, g, or t
  modified_base (345)..(345): a, c, t, g, unknown or other
  misc_feature (345)..(345): n is a, c, g, or t
  modified_base (353)..(353): a, c, t, g, unknown or other
  misc_feature (353)..(353): n is a, c, g, or t
tcagtcacgtactacacgaccggtgctcgatttagctgcgtcacgatctctcttggggagcttcagctgtggtagagaagacaggattcaggacaatctccagcatggccggcttccctctcctcctcaccctcctcactcactgtgcagggtcctgggcccagtctgtgctgactcagcccaccctcagcgtctcgggaccccccggagagtgtcacatctcttgtctggagcagtgacccaanagtcgggagtaattatgctattctggtatcaaacaactcccgaggaaccggccccagacctcctcatacatagcaataaccngcgccctcacggggtccngaccatcnctgctcatctgcactcacgtcctcctgcatcaggtcggcctccggtccacgaagttgacggttgtagtatttactacgttgtacgtgtcgttagggtatcggtaactcgtcgttaacgtaacggtttcgggtttcggggtttaccgggacggggtaacggttaccgttacgggttacccggaacccgtccgtaacggtacccgaccggttaccccgtaacggttccccgtcccg

SEQ ID NO: 298628 - DNA, 630 bp, Homo sapiens
  misc_feature: GZ8MTXP01E4WRS.13.36.D03.1.454.CMB.2.raw
  modified_base (189)..(189): a, c, t, g, unknown or other
  misc_feature (189)..(189): n is a, c, g, or t
  modified_base (400)..(400): a, c, t, g, unknown or other
  misc_feature (400)..(400): n is a, c, g, or t
  modified_base (432)..(432): a, c, t, g, unknown or other
  misc_feature (432)..(432): n is a, c, g, or t
tcagtcacgtactacacgaccggtgctcgatttagctgcgtcacgatctctcttggggtcacatgggaagtgctttctgagagtcatggacctcctgcacaagaacatgaaacacctgtggttctgcctcctcctggtggcagctcccagatgggtcctgtcccaggtgcagctacagcaagtggggcncagggctgttgaacgccttcggagaccctgtccctcacgtgcgctgtctcgtgggtggttcttcagttggttactacgtggagctggactcccgccacggtccccgaggggaaggggctggagtggagttaggggaaatcgaatcagtagtggaagcaaccaacctaccaaccgtccctacgagaacgcccgaagtccacatgtacagtanacactaccaaagaacctagtcctcccgtaggngggtagacgctcgtgtcgacccgccggggcggacgacggcgtggttcgtacgttcgtgtcgcggtaaggacggtacttaagtttttcgggaccttcggttcgtaactttcccgttcccgttttcggttaccgtttccggtacgggggaacccgtaacgggtaccccgttagggttccccttaacccgggtttccccgg

SEQ ID NO: 298629 - DNA, 696 bp, Homo sapiens
  misc_feature: GZ8MTXP01BBXMU.13.36.D03.1.454.CMB.2.raw
  modified_base (298)..(298): a, c, t, g, unknown or other
  misc_feature (298)..(298): n is a, c, g, or t
  modified_base (307)..(307): a, c, t, g, unknown or other
  misc_feature (307)..(307): n is a, c, g, or t
  modified_base (389)..(389): a, c, t, g, unknown or other
  misc_feature (389)..(389): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagcccaccctcggtgtcagtcggccccaggacagacggccaggattaccgtggtagggggaaacaacagttaggaaagtaaaagtgtgcacgtggtaccagcaagaacgccaggccacggcccctgngctggtctntatgttgatgcgaccggccctgacgggactcccgtagacgcgtacttccggcgggtcctaccctaacgtcgtaggggaaccnccgggtccacctctacgaaccctagttacgaagggttacggggtacggaaacggggcccgggggaatcggggaacggggtacccgtaacgttaacgttaccggtggttaccggtaaggggttgggtaggggggtaattaggggttacggtcggttagacggctaggtggttagggttacgttcgggacggggaacgggtaacctaaacggttcggtaccccgttcgtaacggtccgacggttccccgaagggtccctcccggtaacccccgtcgggtacccttccgttcccgttcccgtttcccccg

SEQ ID NO: 298630 - DNA, 675 bp, Homo sapiens
  misc_feature: GZ8MTXP01ASOYK.13.36.D03.1.454.CMB.2.raw
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtcgccccaggacagacgcaggattaccgtgtaggggaaacacattaggaagtaaagtgtgcactggtaccagcaagacgcaggccacggccctgtgctggtcgtctatgttgatacgcgaccgcctgaggtactccgtagacgcgtacttcgcggctaccctaacgtcgtacgggaaccaccgggtcccactcgtcgaaccatccgaagtacgggtaccggaaagggcccgggggtaagacgggaacggtaccgtaacgttaacgttacgtacggtacggtagggttacgggtagggggtaacgttaggtaacggttcggtagacgtacgttaggttacgggtacggtacgggtaccggggaacgggtaacgggaaacctaacggttaccggtaccgttccggtaacgggtaccaccggttacccgacggtccccgtccccggtccccgttcggtacccttacccgttccgttccccgtaaccccg

SEQ ID NO: 298631 - DNA, 695 bp, Homo sapiens
  misc_feature: GZ8MTXP01CYA03.13.36.D03.1.454.CMB.2.raw
  modified_base (421)..(421): a, c, t, g, unknown or other
  misc_feature (421)..(421): n is a, c, g, or t
tcagtcacgtactacacgaccggtgctcgatttagctgcgtcacgatctctcttggggtcacatgggaagtgctttctgagagtcatggacctcctgcacaagaacatgaaacacctgtggttctgcctcctcctggtggcagctccagatgggtcctgtcccaggtgcagctacagcaagtggggcgcgaggggtcttggttagaacggtcccgtttacgggacgtaccccttcggtccccctcgacggtcgccgtcttcggtccgttcggttggggttcgggttctttcgtaggttacggttactacgtggacgtcgtggactcccgaccgtaccggtaccccggaagggggaacggggcgtagggaggtacggtaggtttagggggaaactcgtaaagtcgaagttaggtacggaacnccaaccgaacctacccgaacccgtccgtacggacgaaccgaccgtgtaccaaccagtgtacgacgtacgactacgtacaaacgacctgttcctccgtagacgggtcgacgtctcgtcgtcgacccggcgggacggacggtccgtcgttcgtcgttaccttgtggtcgtccggtaaggtcgttacgttaagtttcgacttacgttcttacttccgttccgttgttaccgttcgggtacggccgtacgggtaccttcgtaacccgttcgttcccgg

SEQ ID NO: 298632 - DNA, 767 bp, Homo sapiens
  misc_feature: GZ8MTXP01AQGZ3.13.36.D03.1.454.CMB.2.raw
tcagtcacgtactacacgaccggtgctcgatttagctgcgtcacgatctctcttggggtcacatgggaagtgctttctgagagtcatggacctcctgcacaagaacatgaaacacctgtggttctgcctcctcctggtggcagctcccagatgggtcctgtcccaggtgcagctacagcaagtggggcgcgagggctgttgaagccgttcggacgaccctgtccctcacgtgcgtctgtctcgtgggttcggttcttcgtagttggttactacgtggagcgtggactcccggccgacggtccccggaggggaacggggcgtagggtaggtagggtaggttagggggaaatacgaagtacgtaagtaggtacggaaacgtaaccctaaaccgtaacccccgaaccccggtccgtacggacgaccgaacccgacgtccgaacctagtacgtacaaggtacgaaccgaccgtaacccaaacgtaacccgtacgttcccgtacccggtaggtacgggtacgacgtccgtcgtcgtaccggaccccggtacccgggccggggaaccgtcgggtcttaggttaccgttaccgttcgtaggtacgggtaccgtaggtacgttacgtttaaaggttttcggaactttccggtaacttccgtttcccgtttacccgttttcggttacccgttttccggggtaacccgggggtacccgtaaaccgggggtaacccctttacggttaccccgttaacccgggttcccggttccccggg

SEQ ID NO: 298633 - DNA, 745 bp, Homo sapiens
  misc_feature: GZ8MTXP01AFLV8.13.36.D03.1.454.CMB.2.raw
  modified_base (395)..(395): a, c, t, g, unknown or other
  misc_feature (395)..(395): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagcccaccctcggtgtcagtcggccccaggacagacggccaggattaccgtggtagggggaaacaacgagttagggaaagtaaaagtgtgcacgtggtacagcagaacgccgaggccgacggcccctggtgcgttggtcgtctagtgttagatacgccggacccggcctcgacgggctccgtgacgcgtacttccgcggtctaccgaacgtcgtacgggaaccnccgggacctactccgtacgacctagtcgaagggtacgggtacggaacgggcgggggtatagggacggaccgtacttaacgttacggtacgtacggagggttagggtaggggggtaagttaagggttacggtcggttaggagttccgagggtttaggggttacgggttacgggttaccggggaaccgggggtaaccgggtaaaccccgtaaacggttcccggggtaacccggttacccggtttaaacgggcccggaacccggaccccgggaacggttccccgccccggttccccccgttcggggttaaccccttacccgttcccggtttaaccccggtttaaccccccccg

SEQ ID NO: 298634 - DNA, 589 bp, Homo sapiens
  misc_feature: GZ8MTXP01BA113.13.36.D03.1.454.CMB.2.raw
  modified_base (187)..(187): a, c, t, g, unknown or other
  misc_feature (187)..(187): n is a, c, g, or t
  modified_base (207)..(207): a, c, t, g, unknown or other
  misc_feature (207)..(207): n is a, c, g, or t
  modified_base (210)..(210): a, c, t, g, unknown or other
  misc_feature (210)..(210): n is a, c, g, or t
  modified_base (213)..(213): a, c, t, g, unknown or other
  misc_feature (213)..(213): n is a, c, g, or t
  modified_base (218)..(218): a, c, t, g, unknown or other
  misc_feature (218)..(218): n is a, c, g, or t
  modified_base (227)..(227): a, c, t, g, unknown or other
  misc_feature (227)..(227): n is a, c, g, or t
  modified_base (240)..(240): a, c, t, g, unknown or other
  misc_feature (240)..(240): n is a, c, g, or t
  modified_base (249)..(250): a, c, t, g, unknown or other
  misc_feature (249)..(250): n is a, c, g, or t
  modified_base (261)..(261): a, c, t, g, unknown or other
  misc_feature (261)..(261): n is a, c, g, or t
  modified_base (296)..(296): a, c, t, g, unknown or other
  misc_feature (296)..(296): n is a, c, g, or t
  modified_base (303)..(303): a, c, t, g, unknown or other
  misc_feature (303)..(303): n is a, c, g, or t
  modified_base (314)..(314): a, c, t, g, unknown or other
  misc_feature (314)..(314): n is a, c, g, or t
  modified_base (341)..(341): a, c, t, g, unknown or other
  misc_feature (341)..(341): n is a, c, g, or t
  modified_base (376)..(376): a, c, t, g, unknown or other
  misc_feature (376)..(376): n is a, c, g, or t
  modified_base (388)..(388): a, c, t, g, unknown or other
  misc_feature (388)..(388): n is a, c, g, or t
  modified_base (460)..(460): a, c, t, g, unknown or other
  misc_feature (460)..(460): n is a, c, g, or t
tcagtcacgtactacacgaccggtgctcgatttagctgcgtcacgatctctcttggggagcttcagctgtggtagagaagacaggattcaggacaatctccagcatggccggcttccctctcctcctcaccctcctcactcactgtgcagggtcctgggcccagtctgtgctgactcagccaccctnagcgtctgggacccccgggnagngtncactntctctgtgnggagcagtcacangtggatatnnctattcagtanacaacacctccgacggacccgcccagtacctctanactctanacacaacaccngccgccgtacggacggtccagtacctnttccgcgtcgacctaccgtagtcgcgaccacctcnccgtccctccgngcctagtcgacggtccggtccgtccgggacgagtgtacgtacgtcgttacgttatttacgtacgttgtacgnggttcgtaggtctacgtacgtcgtcgtaagttacggtttgggtttcgggttcggacggtaacggttacgttacggttaccgaacccggtaccgtaacggccgtacggcccgtaacggttcccgtcccgg

SEQ ID NO: 298635 - DNA, 789 bp, Homo sapiens
  misc_feature: GZ8MTXP01DHVZO.13.36.D03.1.454.CMB.2.raw
tcagtcacgtactacacgaccggtgctcgatttagctgcgtcacgatctctcttggggtcacatgggaagtgctttctgagagtcatggacctcctgcacaagaacatgaaacacctgtggttctgcctcctcctggtggcagctcccagatgggtcctgtcccaggtgcagctacagcaagtgggggcgcgaggggtcttggttgaacgtcccgttcgggacgtacccctgtcccctcacgtgcgtctgtctcgtgggttcgggttcttcgaggttggttactcgtggagcgtggactcccgccgacggtaccccggaggggaacgggtctagggtaggtagggtagtttagggggaaatcgaaagttcgaagttaggtacggaaacgaccaaaccctaaacccgtaccccgaaacccggtccgtaacggaacggaaccggacccgtaagttacccacccgtaagttcgtacgaaggtaacggaacctaacccgttaccaaacgtaaacccgttacgttccgttacccgtaggggtacggggttacgacggtccttccgtagggttacccggaccccgggacccgggggtaccggggaaccggtaccgggtcgtttcggtaccgttaccgtttccggtgggtacggtaccggtaaggtacggttaccgttttaaaggtttttcggacgtttcccgttactttaaccgttttccctttccgtttcgttaccgtttcgggaccgggtaacccgtacgggtacccttcggtcccgttaacccggtttcccg

SEQ ID NO: 298636 - DNA, 773 bp, Homo sapiens
  misc_feature: GZ8MTXP01AI9XF.13.36.D03.1.454.CMB.2.raw
  modified_base (211)..(211): a, c, t, g, unknown or other
  misc_feature (211)..(211): n is a, c, g, or t
tcagtcacgtactacacgaccggtgctcgatttagctgcgtcacgatctctcttggggagcttcagctgtggtagagaagacaggattcaggacaatctccagcatggccggcttccctctcctcctcaccctcctcactcactgtgcgagggtcctcgggcccagtctgtgctgactcacgccaccctcagcgtcgtcggggaccccggnagagtgtcaccattctcttgtcgtgggaggcagtcgaccaaacgagtacggggaattaattatgctatttcgtggtaactaccaaacctaacctccccgaacgggaaccccgtcccccagacctcctacactactaatacgacaaactaaccgacggcccggtccctaccggaccggggttcctcggacccgtacttccgtcgtcgggtaccctaccgtaaagtccgttacggaccctacccctccgtacccgtcccctccccggtcgggaccctacgttacggtacggggttccggggtaccccgttacccgggtacccggaaccggtagtacgggtaacgggtcgtttacggttaaattttaccgttacggtttcgttaccgtaggttcggttagggtactcggtaaactacggtccgttaaggttaacgttttcggggtttacggggttttccggggaacggggttaacgggttaacgttaaccgggtttccgggaaccccggtcccgttaacggggacccgaccggttaccccggaagggttccccgtttcccccggg

SEQ ID NO: 298637 - DNA, 692 bp, Homo sapiens
  misc_feature: GZ8MTXP01CJ5UR.13.36.D03.1.454.CMB.2.raw
  modified_base (277)..(277): a, c, t, g, unknown or other
  misc_feature (277)..(277): n is a, c, g, or t
  modified_base (470)..(470): a, c, t, g, unknown or other
  misc_feature (470)..(470): n is a, c, g, or t
tcagtcacgtactacacgaccggtgctcgatttagctgcgtcacgatctctcttggggtcacatgggaagtgctttctgagagtcatggacctcctgcacaagaacatgaaacacctgtggttctgcctcctcctggtggcagctccagatgggtcctgtcccaggtgcagctacagcaagtggggcgcgaggggctgttgaacgtcccttcggacgaccctgtcccctcacgtgcgcttgtctcgtgggttgggttcttcgagttggttactacgnggagctggatcccggccacggtccccgaggggaagggctggagtggagttagggggaaatcgaatcgaagtaggtaggaaacgcaaccaaaccgtaccaaacccgtcctacgacgaacgcccgaagtccaaccctatcgtacaaggtacgacacgtaccaaacgaaccagttcctcccgtaggaacggggttnacggtccttcgtggtcggaccccggccggggcggaaccgtaccgggtcttggttcgttacctttcggtaggttcggtccgaaggtacggtacttaaggtttttcgggaacctttccggttacttaaccgtttccgtttccccgtttcggttaccgttttcgggtccgggggtaaccctaacgggggttaaccccttaggttccccgaacccggttttcccgg

SEQ ID NO: 298638 - DNA, 751 bp, Homo sapiens
  misc_feature: GZ8MTXP01DHVYQ.13.36.D03.1.454.CMB.2.raw
tcagtcacgtactacacgaccggtgctcgatttagctgcgtcacgatctctcttggggtcacatgggaagtgctttctgagagtcatggacctcctgcacaagaacatgaaacacctgtggttctgcctcctcctggtggcagctcccagatgggtcctgtcccaggtgcagctacagcaagtgggggcgcgaggggctggttagaacggtccctttcgggacgacccctggtcccctacgacgtgcgtcttgtctcgtgggttgggttcttcgaggttggttacacgtggagctggactccgccaggtccccgaggggaagggctggaggtggtaacgtttagggggaaaattcgaaagttcgaagtttaggacggaaaccgcaaacccccgtaaacccgtaacccgtaaacccccggttccgtacggaacggaacccggaacccggtaaggtacccaaaccctaaagttcggaaccaagggttaacgaacccgtaaaccgtaccgaaaacgtaacccgtaacggttcctacccgtagggtacggggtagacggtcttacgtggtaccgaccccggaccggggtacgggacgtaccggtcgttacggttcgttaccgttcgtggttacggcggtaacggtacggttacgttaaaggtttttcggaaccgttccgttcttaacgttccttaccgtttcgttaccgttcggtcgggaaccgtacggtacccttggtccgttaaccgttccgg

SEQ ID NO: 298639 - DNA, 659 bp, Homo sapiens
  misc_feature: GZ8MTXP01ERS5X.13.36.D03.1.454.CMB.2.raw
  modified_base (299)..(299): a, c, t, g, unknown or other
  misc_feature (299)..(299): n is a, c, g, or t
  modified_base (389)..(389): a, c, t, g, unknown or other
  misc_feature (389)..(389): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtcggccccaggacagacggccaggacttaccgtggtagggggaaacaactagttagggaaagttaaaagtttgacacgtggtaccagcaagacgccagccacggccctgngctggtcgtctagtgttgatagcgacccggcctcgagggactcccgtgacggcgtattcccgcgggctaccgaactcgtaacgggaaccncggccctaactctacgaaccacgtcgtaaggtacggggtacgaaacgggccgggggtatagggacggtacccggtaactttacttaccgtggtacgaagggtcggtaggggtaagttagggttaggtcgttggagccaggtttggtaggttagtcggggacgggaacggggaccaaacggtcgaccggtaccgttacgggcaacggcccggaaggttcccgtcccgtccccgtcgggtccctacttcctaacccgggtttcccccgcccg

SEQ ID NO: 298640 - DNA, 576 bp, Homo sapiens
  misc_feature: GZ8MTXP01ET81J.13.36.D03.1.454.CMB.2.raw
  modified_base (284)..(284): a, c, t, g, unknown or other
  misc_feature (284)..(284): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctgtagggggaaacaacattggaaagtaaaagtgtgcactggtaccagcagagcagccaggccctgngctggctctatgtgatagcgaccggccctgagggatcccgtgagcgattcgtcgggctccaactcgtagggaaccacgggccactctgaaccatccaggtagggtcgaaaggccggggatggacggccgtaactattacgtgtcgaagggttgtagggggattaggtagtacgtgagcgagttgtggtagttcgggcgggtaacgggaacctaaacgttcggacccgttacgtaggtcacggcccgaaggtccctaccgcccccgttggccacgttccgttccgttcccccg

SEQ ID NO: 298641 - DNA, 686 bp, Homo sapiens
  misc_feature: GZ8MTXP01DL7A4.13.36.D03.1.454.CMB.2.raw
  modified_base (640)..(640): a, c, t, g, unknown or other
  misc_feature (640)..(640): n is a, c, g, or t
tcagtcacgtactacacgaccggtgctcgatttagctgcgtcacgatctctcttggggtcacatgggaagtgctttctgagagtcatggacctcctgcacaagaacatgaaacacctgtggttctgcctcctcctggtggcagctcccagatgggtcctgtcccaggtgcagctacagcaagtggggcgcgagggctggttgaacgccttcgggacgtacccctgtcccctcgacgtgcgtctgtctcgtgggttggttcttcaggttggtactacgtggagctgggactcccgccacgtccccgaggggaacgggtcgtaggaggtgggtaagtttagggggaaatcgaatacgagtaggtaggaaacgcaacccctaaaccctacccaaaccccggtccctacggaacgaaccggacccgtaaggttaccaacccgaaagttcgtaaccgaaggttaacggacctaccggtaccaaacgtaaaccgtgttaccttcccgtagggtacgggtgacgtcgttcgtggtacgaccccggccgggggaccgggaacgtccggggtcttggtacgttcgttgtacggtggccgtagacggtcttaaattttcgggacttcggttactacttccttacccgttnttacgtttcgcgggccgtacgggacccttaggtcccttccgttccg

SEQ ID NO: 298642 - DNA, 635 bp, Homo sapiens
  misc_feature: GZ8MTXP01A2Q05.13.36.D03.1.454.CMB.2.raw
  modified_base (264)..(264): a, c, t, g, unknown or other
  misc_feature (264)..(264): n is a, c, g, or t
  modified_base (272)..(272): a, c, t, g, unknown or other
  misc_feature (272)..(272): n is a, c, g, or t
tcagtcacgtactacacgaccggtgctcgatttagctgcgtcacgatctctcttggggtcacatgggaagtgctttctgagagtcatggacctcctgcacaagaacatgaaacacctgtggttctgcctcctcctggtggcagctcccagatgggtcctgtcccaggtgcagctacagcaagtggggcgcgaggggcttggttgaaagtcccgtttcgggacgacccctgtcccctgacgtgcgctgtctcgtggtggttctcngtgtactnggagctgatccgcagtcccgagggaggctggagtggagttagggaaatcgaatctagtaggtggaaacgccaaccgaaacctaccaaacccgtcctacgacgaacgcccgaagtaccaaccgtagtgtacgaagtacgaacctaaccgtaccaaacggaaaccctacggttcctacccgtaggacgggttcgacgtccgtcgtcggtacgaccccggcccggggacggacctaccgggccttaggtcgtcttccgtggtcgacgagtaggtcttaagttttggacttcgttcttaacgttccttcccgtttgaccgtttggtcgggcctaacgggtacccttacgtccgttaaccgtttccgg

SEQ ID NO: 298643 - DNA, 760 bp, Homo sapiens
  misc_feature: GZ8MTXP01A16NY.13.36.D03.1.454.CMB.2.raw
  modified_base (349)..(349): a, c, t, g, unknown or other
  misc_feature (349)..(349): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcacgcccacccgtcggtgtcagtcgccccaggacagacggcagattaccgtggtaggggaaacacagttaggaaagtaaagtgtagcacgtggtaccagcaagacgccaggccacggccctgtcgctggtcgtctagtgttgagtacggccgacccggccctacggacgggactcccgnggacgcgtaccgttccggtcgggcctacccgaacgtccggtacgggaacccaccgggacccaaccgttccgtacgaccctagtacccgtaaggggttacggggtaccggaaacggggcccgggggtaattacgggaaccgggtacccgtaacgttacgttaaccgtgtacggtaagggttgggtagggggtaagttacgggtacggtcggtagacgcgtaaggttcgggtagggttacggtccggggacgggggtaaaccggtaaacccgtaaacggttccgggtaaaccccggttccgggtaaaccgggttccgaaacccgggccccgttaaaccgggtcccgttccccggtaaccccccggttcgggtacccttacccggtttccccgttaacccgggtttcccccccg

SEQ ID NO: 298644 - DNA, 685 bp, Homo sapiens
  misc_feature: GZ8MTXP01EQWPO.13.36.D03.1.454.CMB.2.raw
  modified_base (222)..(222): a, c, t, g, unknown or other
  misc_feature (222)..(222): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctctatgtgctgactcagcccaccctggtgtcagtcggccccaggacaggacggccaggacttaccgnggtaggggaaacacgagttagggaaagtaaagtgtagacacgtaggtaccagcagagcaggccaggcccctgcgctggtacgtctatgttagatacgccgaccggccctacgacgggactcccgtgacgtcgtacgttccgtcgggccttacccgaaacgtccggtaacgggaacccgaccgggtacccctaacgtcccgtacgaaccccgtagtaccgtacggtaacggggtacggaacgggaccggggagtagggacggtaccggtacgttaacgttacgtcgtacggtagggtcgggtagggggacgacggacgacgcgaaaaccgtccgtacccggtccttacgttcgtaccgttaccggaacggtaacgggaaccgttacggtaccgttaccgtaccgtaacgttccgacgacccgaacggacccaacccactcgttacctaaccgttccgttccccg

SEQ ID NO: 298645 - DNA, 763 bp, Homo sapiens
  misc_feature: GZ8MTXP01BLXXQ.13.36.D03.1.454.CMB.2.raw
  modified_base (246)..(246): a, c, t, g, unknown or other
  misc_feature (246)..(246): n is a, c, g, or t
  modified_base (260)..(260): a, c, t, g, unknown or other
  misc_feature (260)..(260): n is a, c, g, or t
  modified_base (351)..(351): a, c, t, g, unknown or other
  misc_feature (351)..(351): n is a, c, g, or t
tcagtcacgtactacacgaccggtgctcgatttagctgcgtcacgatctctcttggggagcttcagctgtggtagagaagacaggattcaggacaatctccagcatggccggcttccctctcctcctcaccctcctcactcactgtgcagggtcctgggcccagtctgtgctgactcacgccaccctcagccgtcgtcgggacccccggagagtgtcacatctcttgtctggagcagtcgaccaangtcgggataattangctattctaggtactaccaaacctaacctccccgaaggaacccggcccccagacccttcctacactctaagtacgactaaactaaacccgnggtcccgccccgtacggaccgggggttcccctggaacccgttctttaccctcgtcgggcctaaccccgtaaaggttcccttcgggacccctaaccgttccgacccgtcccttccccggtcggccctaacgtccgtacgggtcgggtcccgtcccgggtacccgaccgagtacggtacgggtcttacggttactttaacgttaccgtttacggttccgtaggttcggttacggggtattaccggaacgtaccggtccgttaacggttaaacgtttcgggttttacgggggttttccggggacggggttaaccggggaacccgttaagggtttcccggaaaccccgggttccccggtttaacggggtacccggacccggttaccccggtaaaccgggttccccgttcccccggg

SEQ ID NO: 298646 - DNA, 613 bp, Homo sapiens
  misc_feature: GZ8MTXP01DCV1K.13.36.D03.1.454.CMB.2.raw
  modified_base (212)..(212): a, c, t, g, unknown or other
  misc_feature (212)..(212): n is a, c, g, or t
  modified_base (215)..(215): a, c, t, g, unknown or other
  misc_feature (215)..(215): n is a, c, g, or t
  modified_base (406)..(406): a, c, t, g, unknown or other
  misc_feature (406)..(406): n is a, c, g, or t
  modified_base (416)..(416): a, c, t, g, unknown or other
  misc_feature (416)..(416): n is a, c, g, or t
  modified_base (428)..(428): a, c, t, g, unknown or other
  misc_feature (428)..(428): n is a, c, g, or t
  modified_base (453)..(453): a, c, t, g, unknown or other
  misc_feature (453)..(453): n is a, c, g, or t
  modified_base (485)..(485): a, c, t, g, unknown or other
  misc_feature (485)..(485): n is a, c, g, or t
  modified_base (487)..(487): a, c, t, g, unknown or other
  misc_feature (487)..(487): n is a, c, g, or t
tcagtcacgtactacacgaccggtgctcgatttagctgcgtcacgatctctcttggggagcttcagctgtggtagagaagacaggattcaggacaatctccagcatggccggcttccctctcctcctcaccctcctcactcactgtgcagggtcctgggcccagtctgtgctgactcagcccaccctcagcggtcgtcggggacccccgggnagngtgtcaccatctcttgtcgtgggagcagtcgaccaagagtacgggtaagttaattatgctattctaggtactacaaccaacctcccgaaacggaccccggccccagacctcctacatactaatacgactaaactaaccgcgccgtcccctcgaccggggtcctgaccctattcctcgtcggctaccagtcncggactaccncacgccctccgngccagtcagggtcgcctccggcagntagcgctgtagttatcgtgtctgtcgttaggntnacgtcgtcgtaaggttaacgtttacgggtttggggttccggaacggggtaccggttaacgttaacgggttccggaacccgtacccggtgtcccgaccggttacccggtaacgttccgttcccccgg

SEQ ID NO: 298647 - DNA, 642 bp, Homo sapiens
  misc_feature: GZ8MTXP01BI6VJ.13.36.D03.1.454.CMB.2.raw
  modified_base (279)..(279): a, c, t, g, unknown or other
  misc_feature (279)..(279): n is a, c, g, or t
  modified_base (283)..(283): a, c, t, g, unknown or other
  misc_feature (283)..(283): n is a, c, g, or t
  modified_base (388)..(388): a, c, t, g, unknown or other
  misc_feature (388)..(388): n is a, c, g, or t
tcagtcacgtactacacgaccggtgctcgatttagctgcgtcacgatctctcttggggtcacatgggaagtgctttctgagagtcatggacctcctgcacaagaacatgaaacacctgtggttctgcctcctcctggtgcagctcccagatgggtcctgtcccaggtgcagctacagcaagtggggcgcgagggctggttgaacgtccgttcggacgtacccctgtcccctcgacgtgcgtctgtctcgtgggttggttcttcgagttggttactacgnggancgtggactcccgaccgacggtccccgaaggggacgggctggagtggagttaggggaatcaatcagtagtgaagcaaccaacctaccaccgtctcgacgaacgccngtcaccgatcgtacaggtacaacaccgtacaaacggacctacgttcctacccgtagggtagggttcacggtctcgtacggtccgaacccggccggggacgggaaccgtccggtcgttggttcgtaccgtttgtacggtcgcgggtagtaccggttagtttaagttttcgggacttcggttacttacgtttcccgttccgtttagttcctttcgggcgggtaacctacgggacccttcgtccgttccgttcccgg

SEQ ID NO: 298648 - DNA, 772 bp, Homo sapiens
  misc_feature: GZ8MTXP01BD2JS.13.36.D03.1.454.CMB.2.raw
  modified_base (296)..(296): a, c, t, g, unknown or other
  misc_feature (296)..(296): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagcccaccctcggtgtcagtcggccccaggacagacggccaggattacctggtagggggaaacaacagttagggaaagtaaaagtgtagcacgtggtaccagcaagaagcaggccaggcccctgngctggtcgtctagtgttagataggcgaccggccctacgagggactccctggacgcgtacttccgacggggcctacccgaacgtcgtacggggaaccgaaccggcccgtaacctaccgtacgaaccctatacgtaacggggtacgggtacggaaacgggcccgggggtaatcggggaaacgggaccccgtaacgttaacgtttaaccgtggtaccgtaaggggttcgggtaggggggtaacgttaaaggggttaaccgggtcggttaggaaacggtcgttaggttacgggttagggttaaacggtttccgggggtaccggggtaaacgggggaaaccctaaaaaccggttccgggtaaaccccgttaccggttaaacggggttacccgaaacgggttcccccgaaaggggtcccgttacccggcccccccggtttacgggcccttaacccgttccgtttcccggtttccccccccgg

SEQ ID NO: 298649 - DNA, 531 bp, Homo sapiens
  misc_feature: GZ8MTXP01EXASG.13.36.D03.1.454.CMB.2.raw
  modified_base (188)..(188): a, c, t, g, unknown or other
  misc_feature (188)..(188): n is a, c, g, or t
  modified_base (227)..(227): a, c, t, g, unknown or other
  misc_feature (227)..(227): n is a, c, g, or t
  modified_base (263)..(263): a, c, t, g, unknown or other
  misc_feature (263)..(263): n is a, c, g, or t
  modified_base (328)..(328): a, c, t, g, unknown or other
  misc_feature (328)..(328): n is a, c, g, or t
  modified_base (351)..(351): a, c, t, g, unknown or other
  misc_feature (351)..(351): n is a, c, g, or t
  modified_base (358)..(358): a, c, t, g, unknown or other
  misc_feature (358)..(358): n is a, c, g, or t
  modified_base (362)..(362): a, c, t, g, unknown or other
  misc_feature (362)..(362): n is a, c, g, or t
  modified_base (380)..(380): a, c, t, g, unknown or other
  misc_feature (380)..(380): n is a, c, g, or t
  modified_base (410)..(410): a, c, t, g, unknown or other
  misc_feature (410)..(410): n is a, c, g, or t
  modified_base (412)..(412): a, c, t, g, unknown or other
  misc_feature (412)..(412): n is a, c, g, or t
  modified_base (414)..(414): a, c, t, g, unknown or other
  misc_feature (414)..(414): n is a, c, g, or t
  modified_base (434)..(434): a, c, t, g, unknown or other
  misc_feature (434)..(434): n is a, c, g, or t
tcagtcacgtactacacgaccggtgctcgatttagctgcgtcacgatctctcttggggtcacatgggaagtgctttctgagagtcatggacctcctgcacaagaacatgaaacacctgtggttctgcctcctctggtggcagctcccagatgggtcctgtcccaggtgcagctacagcaagtggggcncgaggggctggttgaacgccttcggagaccctgtccctnacgtgcgctgtctcgtggtggtctcagtggtactanggagctggactccgcagtccccgaggggaagggctggagtggattaggggaaatcaatcagtagngaagcacaacctacaaccgtccngagaacnccgngtcaaccatgtacagganacacgtcaacaacactctcctcgaggtgancncncgcgcgcggcgacgacgcgngtgtcgtcgtgtgtgagagtagtaagttacgttacgtcgttcgtcttcttccgttcgttcgtcgtcggtcggacggtaccgttacgtcgttcgtccg

SEQ ID NO: 298650 - DNA, 636 bp, Homo sapiens
  misc_feature: GZ8MTXP01CFHB2.13.36.D03.1.454.CMB.2.raw
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtcggccccaggacagacggccaggattaccgtggtagggggaaacaacagttaggaaagtaaaagtgtgcactggtaccagcagaacgcaggccacggcccctgtgctggtcgtctatgtgatagcgaccggccctgacgggactcccgtgacgcgtacttccgcgggcctaccaacgtccgtagggaaccacggccactctacgacccatccgaggtacgggtacgaacgggccggggtatacgggacggcccgtaattacgttacgtgtacgagggttggtagggggtagttaggtagtacggtgaacgcgtaagtggtggtaacggttcgggacgggtacgggaaacctaaacggttcggtaacccgttacgttacggtccgaacgcccgaacggtccgtacccgcccccgttggtcccttaccgttccttaaccgttcccccc

SEQ ID NO: 298651 - DNA, 610 bp, Homo sapiens
  misc_feature: GZ8MTXP01D7JWJ.13.36.D03.1.454.CMB.2.raw
  modified_base (442)..(442): a, c, t, g, unknown or other
  misc_feature (442)..(442): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtcggccccaggacaggacgccaggattaccgtggtaggggaaacaatagttaggaaagtaaaagtgtgcagtggtaccagcagagccgagccaggccctgtcgctggtcgtctagtgtgagtacgccgaccggccctcgagggactcccgtggacgcgtacttcgtacggctaccaacgtcgtacgggaacacggccacgtcacgaccagttcacggtaggcgaacggccgggatggacggcgtactatacgngtcgaaggtgtaggggtacttaggtagtcgtgacgtcgaagttggtacggttagttccggggacggaacggggaaaccctaacgttacggtacccgttaccggtacggtcaccggttaccgacggcctccgtcccccgtggcccttccgttcccgttcggttcccccg

SEQ ID NO: 298652 - DNA, 689 bp, Homo sapiens
  misc_feature: GZ8MTXP01CLN5S.13.36.D03.1.454.CMB.2.raw
  modified_base (187)..(187): a, c, t, g, unknown or other
  misc_feature (187)..(187): n is a, c, g, or t
  modified_base (407)..(407): a, c, t, g, unknown or other
  misc_feature (407)..(407): n is a, c, g, or t
  modified_base (464)..(464): a, c, t, g, unknown or other
  misc_feature (464)..(464): n is a, c, g, or t
tcagtcacgtactacacgaccggtgctcgatttagctgcgtcacgatctctcttggggtcacatgggaagtgctttctgagagtcatggacctcctgcacaagaacatgaaacacctgtggttctgcctcctcctggtggcagctccagatgggtcctgtccaggtgcagctacagcaagtggggcncgagggtctggttacgaacgtccgttacggacgtacccctcgtcccctcgacgtgccgtctgtcgttcgttgggttcggttcttcgtagttggttactacgtggatcgtggactccgcacggtcccggagggacgggctggagtggacgttaggggaatcgaagtcagttaggagaacgccaacctaaccgtacctaacccgtctacggagaacgaccgntcaacctgttgacagtacacacgtacaaacggtacctgtcctaccgaggtacgggtnacgtccgtacgtcggtacggaccccgggacggggaccgggaaccggtccggtcgttacggttaaccgttaccgttccggtaggtcggaccggaaggtacgtcgtttaaacggttttcgggaacttccggttctttaacgtttccctttcccggtttacgcccgttttcgggaccgggtaacccgtaacggggtaccccttacgttcccgaacccggtttccccgg

SEQ ID NO: 298653 - DNA, 604 bp, Homo sapiens
  misc_feature: GZ8MTXP01DZWA1.13.36.D03.1.454.CMB.2.raw
  modified_base (219)..(219): a, c, t, g, unknown or other
  misc_feature (219)..(219): n is a, c, g, or t
  modified_base (232)..(232): a, c, t, g, unknown or other
  misc_feature (232)..(232): n is a, c, g, or t
  modified_base (252)..(252): a, c, t, g, unknown or other
  misc_feature (252)..(252): n is a, c, g, or t
  modified_base (300)..(300): a, c, t, g, unknown or other
  misc_feature (300)..(300): n is a, c, g, or t
  modified_base (575)..(575): a, c, t, g, unknown or other
  misc_feature (575)..(575): n is a, c, g, or t
  modified_base (583)..(583): a, c, t, g, unknown or other
  misc_feature (583)..(583): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtcggccccaggacagacgccaggattaccngtaggggaacaanattaggaagtaaagtgtganactggtaccagacagaaagccaaggccaaggcccctgtcgctggtctntatgttgatagccgaccggccctgagggtactcccgtgacgcgacgttccgtcggggactcccgaactccgtagggaactaccgggcccaacgtctacgaaccagtcctaaggtgggtacgaaacggccgggggaatgggaacggtccgaacttagtacgtgtacgaaggtggtgggggaagttagtagggtccgtaggaagcgtaagtgtggtagttccgggagggtacgggaacctaaagttcgaccgttcgtagtcgaacgcccgaaggtcncgtccccnggtccacgttcttcgtccccg

SEQ ID NO: 298654 - DNA, 620 bp, Homo sapiens
  misc_feature: GZ8MTXP01C6RKE.13.36.D03.1.454.CMB.2.raw
  modified_base (219)..(219): a, c, t, g, unknown or other
  misc_feature (219)..(219): n is a, c, g, or t
  modified_base (391)..(391): a, c, t, g, unknown or other
  misc_feature (391)..(391): n is a, c, g, or t
  modified_base (486)..(486): a, c, t, g, unknown or other
  misc_feature (486)..(486): n is a, c, g, or t
  modified_base (518)..(518): a, c, t, g, unknown or other
  misc_feature (518)..(518): n is a, c, g, or t
tcagtcacgtactacacgaccggtgctcgatttagctgcgtcacgatccctcttggggagtctgggcctaaggaagcagcactggtggtgcctcagccatggcctggaccgttctcctcctcggcctcctctctcactgcacaggctctgtgacctcctatgtgctgactcagccaccgtcggtgtcagtcggcccaggacagacgccaggacttacgnggtaggggaaacaacagttaggaaagtaaagtgtagcacgtaggtaccagacaagaacgcgacggccacggccctgtgcgtggtctactatgtagatacgcgacccggctcggacggactcccgtgacgcgtacgttcccgcgggtactaccgtaactcggtaacgggaacnccggacctaacgtctacgacctagtcgaagggttacgggtacgaacgggtccggggatacgggacggaccgtaacgtacgttacggtcgttacgngggttaggtgggtaggttaggtacggtgtagngtacgagttcgtagggtcgtcgggacggacggaaactaacgtcggacctcgttacgcgacgccgagcctcgccccttggctaccttcgtccgttcccgtccc

SEQ ID NO: 298655 - DNA, 527 bp, Homo sapiens
  misc_feature: GZ8MTXP02I3H25.13.36.D03.1.454.CMB.2.raw
  modified_base (338)..(338): a, c, t, g, unknown or other
  misc_feature (338)..(338): n is a, c, g, or t
  modified_base (409)..(409): a, c, t, g, unknown or other
  misc_feature (409)..(409): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctgtgggggaaacaacattggaagtaaagtgtgcactggtaccagcagaagccaggccaggcccctgtgctggtcgtctatgttgatagcgaccggccctcagggatccctgagcgattcncgggctccaactctgggacacggccactctgaccatcagtaggtcgaagccgggatgaggccgactatacngtcaggtgtgggatagtagtcgtgagcagtggtaggtattcgggcggagggaccaaaagttggaccgtcctaaggtcacgcccgaaggctacgcccctcggtccactctcgttccccc

SEQ ID NO: 298656 - DNA, 522 bp, Homo sapiens
  misc_feature: GZ8MTXP02G9ZLL.13.36.D03.1.454.CMB.2.raw
  modified_base (218)..(218): a, c, t, g, unknown or other
  misc_feature (218)..(218): n is a, c, g, or t
  modified_base (280)..(282): a, c, t, g, unknown or other
  misc_feature (280)..(282): n is a, c, g, or t
  modified_base (285)..(285): a, c, t, g, unknown or other
  misc_feature (285)..(285): n is a, c, g, or t
  modified_base (291)..(291): a, c, t, g, unknown or other
  misc_feature (291)..(291): n is a, c, g, or t
  modified_base (293)..(293): a, c, t, g, unknown or other
  misc_feature (293)..(293): n is a, c, g, or t
  modified_base (308)..(308): a, c, t, g, unknown or other
  misc_feature (308)..(308): n is a, c, g, or t
  modified_base (312)..(312): a, c, t, g, unknown or other
  misc_feature (312)..(312): n is a, c, g, or t
  modified_base (314)..(314): a, c, t, g, unknown or other
  misc_feature (314)..(314): n is a, c, g, or t
  modified_base (316)..(316): a, c, t, g, unknown or other
  misc_feature (316)..(316): n is a, c, g, or t
  modified_base (327)..(327): a, c, t, g, unknown or other
  misc_feature (327)..(327): n is a, c, g, or t
  modified_base (345)..(345): a, c, t, g, unknown or other
  misc_feature (345)..(345): n is a, c, g, or t
  modified_base (350)..(350): a, c, t, g, unknown or other
  misc_feature (350)..(350): n is a, c, g, or t
  modified_base (422)..(422): a, c, t, g, unknown or other
  misc_feature (422)..(422): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggcaggattaccngtggggaaacaacattaggaagtaaaagtgtgcactggaccagcagaagcagccagccctgnnngcntatgtnangcgaccgcctgaggntccngngngactcgtcgcncactcagacacgcactcncacanacagtaggtacgaacgacgggagagagacgactaatactagtacgaggtggtaggtagtagtagtagtgagngagtgtggtagtacggacggacggaacgaaacgacgaccgtaccgtacgtacgacgaccgacgaacgccgccccgtccgtaccgtacctcctccgtcccg

SEQ ID NO: 298657 - DNA, 548 bp, Homo sapiens
  misc_feature: GZ8MTXP02GE7SU.13.36.D03.1.454.CMB.2.raw
  modified_base (486)..(486): a, c, t, g, unknown or other
  misc_feature (486)..(486): n is a, c, g, or t
tcagtcacgtactacacgaccggtgctcgatttagctgcgtcacgatctctcttggggagtctgggcctaaggaagcagcactggtggtgtctcagccatggcctggaccgttctcctcctcggcctcctctctcactgcacaggctctgtgacctcctatgtgctgactcagccaccctcggtgtcagtggccccaggacagacggccaggattacctgtgggggaaacaacattggaaagtaaagtgtgcactggtaccagcagaagccaggccaggcccctgtgctggtcgtctatgttgatagcgaccggccctcagggactccctgacgcgacttcgtccgggctccgaactccgtggggaccaccggccactctgaccatccgagtagggtacgaaggccggggatggacggccgtacttattaccgtgtacgagggttggtagggattaggtagtcggtgagcagtggtggtagtcggnggacggacaaacgtgaccgtcaggtcacgccgaggctcgcccctcggtcacctctcgtcccc

SEQ ID NO: 298658 - DNA, 603 bp, Homo sapiens
  misc_feature: GZ8MTXP02I5U8O.13.36.D03.1.454.CMB.2.raw
  modified_base (374)..(374): a, c, t, g, unknown or other
  misc_feature (374)..(374): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctggtagggggaaacaacattaggaaagtaaaagtgtgcactggtaccagcagaagccaggccaggcccctgtgctggtcgtctatgttgatagcgaccgccctgagggactccctgacgcgtattcgcggggctcccgaactccgtaggggaaccnccgggcccaacgtcctagacccatccgaagtaggggtacgaaagggccgggggaatggacggccgaacttattaaccgtgtcgaagggtgtgggtataggtagtggtgaaggctagtggtggttagttcggggacgggagggtaaccaaaacgtgaacccggtccgtaagggtcacggccccgaaaggcctaccggccccctcggtccaccgttccgtcgttacccccc

SEQ ID NO: 298659 - DNA, 523 bp, Homo sapiens
  misc_feature: GZ8MTXP02HDB9C.13.36.D03.1.454.CMB.2.raw
  modified_base (420)..(420): a, c, t, g, unknown or other
  misc_feature (420)..(420): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctgtggggaaacaacattaggaagtaaaagtgtgcactggtaccagcagaagccaggccaggcccctgtgctggtcgtctatgttgatagcgaccggccctcgagggactcccgtgacgcgacttcgtcgggctccaactctgggaccacggccactctcgaccatcagtagggtcgaagccggggatggagccgatattacngtcaggtgtgggatagagtcgtgagcatgtggtattcggcggagggaccaagtgaccgtctaggtcacgcccaaggcctcgcccctcggcactctcgtccccg

SEQ ID NO: 298660 - DNA, 568 bp, Homo sapiens
  misc_feature: GZ8MTXP02JFX5H.13.36.D03.1.454.CMB.2.raw
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctggtggggaaacaacattaggaagtaaaagtgtgcactggtaccagcagaagccaggccaggcccctgtgctggtcgtctatgttgatagcgaccggccctcgagggactccctgagcgacttcgtcggggctaccaactcgtcgggacacgggccactctcgaccatcgaagtagggtacgaaggccggggatggacggccgaactacgttactcgtacagggtgtagggataggtagtcggtgagcagtggtggtagttcgggcggacgggtaccaaaacgtcgaacccgtccgtaggtcacgcccgaagccgtcgcccccgtcggtccaccgtccgtcgttcccccg

SEQ ID NO: 298661 - DNA, 521 bp, Homo sapiens
  misc_feature: GZ8MTXP02FI491.13.36.D03.1.454.CMB.2.raw
  modified_base (330)..(330): a, c, t, g, unknown or other
  misc_feature (330)..(330): n is a, c, g, or t
  modified_base (412)..(412): a, c, t, g, unknown or other
  misc_feature (412)..(412): n is a, c, g, or t
  modified_base (421)..(421): a, c, t, g, unknown or other
  misc_feature (421)..(421): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctgtgggggaaacaacattggaagtaaaagtgtgcactggtaccagcagaagccaggccaggccccctgtgctggtcgtctatgttgatagcgaccggccctcagggatcccngagcgattctcgggctccaactctgggacacggcactctgaccatcagtagggtcgaagcggggatgaggccgactattacngtcaggtgngggatagtagtcgtgagcatgtggtattcggcggagggaccaaaatgaccgtcctaaggtcacgcccaaggctcgccccctcggtcactctcgttccccc

SEQ ID NO: 298662 - DNA, 539 bp, Homo sapiens
  misc_feature: GZ8MTXP02F5MLI.13.36.D03.1.454.CMB.2.raw
  modified_base (416)..(416): a, c, t, g, unknown or other
  misc_feature (416)..(416): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctgtagggggaaacaacattggaagtaaagtgtgcactggtaccagcagaagccaggccaggcccctgtgctggtctctatgttgatagcgaccggccctcgaggggactccctgacgcgacttcgcgggctccaactcgtagggacacggccactctgaccatcagtaggtcgaagccggggatgaggccgatatacngtcagggtgtggggatagtagtcggtgagcatggtggtattcgggcggagggaccaaacgtggacccgttacgtacggtcacgcccaaggcctcgccccctcggcctacgtcctcgttccccc

SEQ ID NO: 298663 - DNA, 536 bp, Homo sapiens
  misc_feature: GZ8MTXP02HVTCJ.13.36.D03.1.454.CMB.2.raw
  modified_base (363)..(363): a, c, t, g, unknown or other
  misc_feature (363)..(363): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctgtgggggaaacaacattggaagtaaaagtgtgcactggtaccagcagaagccaggccaggcccctgtgctggtcgtctatgttgatagcgaccggccctcgagggactccctgagcgattcgtcgggctccaactcgtgggacncggccactcctgaccatcagtaggtcgaagccggggatgagccgatatactgtcaggtgtgggatagtagtcgtgagcatgtggtattcgggcggagggaccaaaacgtggaaccgtcgtacggtcacgcccaaggccgtacgcccccgtcggcctacctcttacgttccccc

SEQ ID NO: 298664 - DNA, 534 bp, Homo sapiens
  misc_feature: GZ8MTXP02I9GJ2.13.36.D03.1.454.CMB.2.raw
  modified_base (208)..(208): a, c, t, g, unknown or other
  misc_feature (208)..(208): n is a, c, g, or t
tcagtcacgtactacacgaccggtgctcgatttagctgcgtcacgatctctcttggggagcttcagctgtggtagagaagacaggattcaggacaatctccagcatggccggcttccctctcctcctcaccctcctcactcactgtgcagggtcctgggcccagtctgtgctgactcagccaccctcagcgtctgggaccccccgggnagagtgtcaccatctcttgttctggaggcagtgccaacagtcgggagtaattatgcattctggtatcaacaactcccaggaaccggcccccagactcctcatctatacgcaaataaccagccggccctccgacggggtccctagaccgtattctctggctccaagtctgcacctcacgccctccctgccatcagtcgggctccggcgacgatggaggctgattagttactgttcgagtcgttgggatggacagcctagaatacgttgggtttcggcggtacggacctaggttcgaaccgccctaggtccagcccgtaaggcctccg

SEQ ID NO: 298665 - DNA, 524 bp, Homo sapiens
  misc_feature: GZ8MTXP02IC0C7.13.36.D03.1.454.CMB.2.raw
  modified_base (411)..(411): a, c, t, g, unknown or other
  misc_feature (411)..(411): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtggcccaggacagacggccaggattacctgtggggaaacaacattggaagtaaaagtgtgcactggtaccagcagaagccaggccaggcccctgtgctggtcgtctatgtgatagcgaccggccctcagggatccccgtgagcgattctcgggctccaactctcgggacacgggccactctgaccatcagtaggcgaagccggggatgaggccgactatacngtcaggtgtgggatagtagtcgtgagcagtgtggttatcgggcggagggaccaaacgtggaacctccgtaggtcacgcccaaggcgtcgcccctcggtcacctctcgttcccc

SEQ ID NO: 298666 - DNA, 754 bp, Homo sapiens
  misc_feature: GZ8MTXP02JR4GP.13.36.D03.1.454.CMB.2.raw
  modified_base (187)..(187): a, c, t, g, unknown or other
  misc_feature (187)..(187): n is a, c, g, or t
  modified_base (209)..(209): a, c, t, g, unknown or other
  misc_feature (209)..(209): n is a, c, g, or t
tcagtcacgtactacacgaccggtgctcgatttagctgcgtcacgatctctcttggggagcttcagctgtggtagagaagacaggattcaggacaatctccagcatggccggcttccctctcctcctcaccctcctcactcactgtgcagggtcctgggcccagtctgtgctgactcagccaccctnagccgtctgggaccccccgggnagagtgtccaccatctcttgttcgtggagcagtcgaccaacagtcggataattatgctattcgtgtactacaactaacctcccgacggaaccgcccccagacctccctacactactaatacgactaaactaaaccgacggcccggccctacccgtaccggggtcccctacggacccgtactttccgtcgtcgggtcctacccgtaaacgttccgtacggaccctaccctacccgaccgtcccccttacccccgtcgggaccctacgttaccgtacgggttccggggtaccccgttacccggggtaccccggacggtacgttacgggacggtccgttagttaacttttacgtttaccgttgtttaccgtaggttaccggtttggggtaacgttacggaaccgtacgtcccgttaaggttaaacgtttaccgggttttacgggggtttaccggggacggggtaacggggtaacccgttaacggttaccggaacccggtacccggttaacggtaccgaaccggaccccgtaacgggtcccgtacccgg

SEQ ID NO: 298667 - DNA, 728 bp, Homo sapiens
  misc_feature: GZ8MTXP02JATFQ.13.36.D03.1.454.CMB.2.raw
  modified_base (209)..(209): a, c, t, g, unknown or other
  misc_feature (209)..(209): n is a, c, g, or t
tcagtcacgtactacacgaccggtgctcgatttagctgcgtcacgatctctcttggggagcttcagctgtggtagagaagacaggattcaggacaatctccagcatggccggcttccctctcctcctcaccctcctcactcactgtgcagggtcctgggcccagtctgtgctgactcagccaccctcagcgtctggggaccccccgggnagagtgtccacctattcttcttgttcgtgggaggcagtcgacccaacgagtcggggtaagtaattatgctattcgtaggtactaccaaaccaacctacccgaacggaaccccggacccccagacccttccctacacttactaatacgaccaaactaacccgacggcccggaccccgtacccggtaccggggtcccctacggaacccgttactttccgttccgtcgggtcccttaccgtaacgttccgtcggaccctaccctccaccgtccccttcccgtcggaccctacgtccgacgggtccggggtcccgttcccgggtacccgacggtacgtacgggacggtcgtacgttacgtttactttaccgttgttacgtaggtcgttagggtactacgaacgcgtaccgttagtaacgtttaccggtttcggggtttaccgggacgggtacgggtaaccgtacggttaccggtaacccgtaccggtacggtaccgaccggacccggtacggtacccgtcccg

SEQ ID NO: 298668 - DNA, 543 bp, Homo sapiens
  misc_feature: GZ8MTXP02GTP1R.13.36.D03.1.454.CMB.2.raw
  modified_base (206)..(206): a, c, t, g, unknown or other
  misc_feature (206)..(206): n is a, c, g, or t
  modified_base (354)..(354): a, c, t, g, unknown or other
  misc_feature (354)..(354): n is a, c, g, or t
tcagtcacgtactacacgaccggtgctcgatttagctgcgtcacgatctctcttggggagcttcagctgtggtagagaagacaggattcaggacaatctccagcatggccggcttccctctcctcctcaccctcctcactcactgtgcagggtcctgggcccagtctgtgctgactcagccaccctcagcgtctgggacccccggnagagtgtcaccatctcttgttctggaggcagtgccaacatcgggagtaattatgcattctggtatcaacaactcccaggaacggcccccagactcctcatctatagcaaataaccagcggccctcgacggggtccctgaccgtattcnctggctcaagtctggcacctcacgcctcccgtgccatcagtcgggctccggtccgacgagtgaggctgtattattactgtcagtcttgggatgacagcctagaacttacgttcggggttttcggacgggtacgggaccgtaaggttcggaacccgtacccgtaggttccaggcccgaaggcgtccccgg

SEQ ID NO: 298669 - DNA, 565 bp, Homo sapiens
  misc_feature: GZ8MTXP02JCQGR.13.36.D03.1.454.CMB.2.raw
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccagggattacctggtgggggaaacaacattggaaagtaaaagtgtgcactggtaccagcagaagccaggccaggcccctgtgctggtcgtctatgttgatagcgaccggccctcgagggactcccgtgacgcgacttccgtcggggctccaacgtcgtgggaccacggccacgtctcgaccatcagtagggtacgaaggccgggatggaggccgatatacgtgtcaggtgtggatagtagtcgtgagcgagtgtggtagttcggggacggagggaacctaacgtcggaccgtacgtacgggtcacgcccgaaggctaccggtcccccgtcggtcctaccgttccgtacgtttccccc

SEQ ID NO: 298670 - DNA, 523 bp, Homo sapiens
  misc_feature: GZ8MTXP02GC30D.13.36.D03.1.454.CMB.2.raw
  modified_base (360)..(360): a, c, t, g, unknown or other
  misc_feature (360)..(360): n is a, c, g, or t
  modified_base (410)..(410): a, c, t, g, unknown or other
  misc_feature (410)..(410): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctgtgggggaaacaacattggaagtaaagtgtgcactggtaccagcagaagccaggccaggcccctgtgctggtcgtctatgttgatagcgaccggccctcagggactcccgtgagcgattctcgggctccaactctgggacncggcactctgaccatcagtaggtcgaagccggggatgaggccgatatacngtcaggtgtggatagagtcgtgagcagtgtggtattcgggcggagggaccaaacgtgaccgttccgaggtcacgcccgaaggcctcgccccctcggtccactctcgttccccc

SEQ ID NO: 298671 - DNA, 575 bp, Homo sapiens
  misc_feature: GZ8MTXP02F9FPK.13.36.D03.1.454.CMB.2.raw
  modified_base (219)..(219): a, c, t, g, unknown or other
  misc_feature (219)..(219): n is a, c, g, or t
  modified_base (457)..(457): a, c, t, g, unknown or other
  misc_feature (457)..(457): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattaccngtgggggaaacaacattaggaagtaaagtgtgcactggtaccagcagaagccaggccaggcccctgtgctggtctctatgttgataggcgaccggccctcgagggactccctgagcgattcgtcgggctaccaactcgtacgggaccaccgggccactctagacccatcagtagggtcgaaagccgggggatgacggccgatagttactgtcagggtgtgggatagtagtcgtgacgngagtgtggtagttacggtcgggagggaaccgaaacgtacggtaccgtaccgtacggttacgacgaccgaacggccgtccggaccccgtccggtccgtaccgtccgtccgtttcccccg

SEQ ID NO: 298672 - DNA, 577 bp, Homo sapiens
  misc_feature: GZ8MTXP02H5J47.13.36.D03.1.454.CMB.2.raw
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctgtagggggaaacacattggaagtaaagtgtgcactggtaccagcagaagccaggccaggcccctgtgctggtcgtctatgttgatagcgaccggccctcgagggactccccgtgagcgattcgtcgggctccaactcgtacggggacacgggccactctacgaccatcagtagggtcgaaggccgggggatggacggccgatagtactgtcagggtgtgggattagtaggtcgtgagcgagttggtggttagttcgggacgggacgggaccaaaagtcggacccgtccgtaaggtccacgacccgaagggtcctaccggaccccctcgggtaccaccgttccgttaccgttccccccg

SEQ ID NO: 298673 - DNA, 493 bp, Homo sapiens
  misc_feature: GZ8MTXP02HRPXP.13.36.D03.1.454.CMB.2.raw
  modified_base (208)..(208): a, c, t, g, unknown or other
  misc_feature (208)..(208): n is a, c, g, or t
  modified_base (222)..(222): a, c, t, g, unknown or other
  misc_feature (222)..(222): n is a, c, g, or t
  modified_base (228)..(228): a, c, t, g, unknown or other
  misc_feature (228)..(228): n is a, c, g, or t
  modified_base (236)..(236): a, c, t, g, unknown or other
  misc_feature (236)..(236): n is a, c, g, or t
  modified_base (241)..(241): a, c, t, g, unknown or other
  misc_feature (241)..(241): n is a, c, g, or t
  modified_base (253)..(253): a, c, t, g, unknown or other
  misc_feature (253)..(253): n is a, c, g, or t
  modified_base (260)..(260): a, c, t, g, unknown or other
  misc_feature (260)..(260): n is a, c, g, or t
  modified_base (264)..(264): a, c, t, g, unknown or other
  misc_feature (264)..(264): n is a, c, g, or t
  modified_base (272)..(272): a, c, t, g, unknown or other
  misc_feature (272)..(272): n is a, c, g, or t
  modified_base (287)..(287): a, c, t, g, unknown or other
  misc_feature (287)..(287): n is a, c, g, or t
  modified_base (290)..(290): a, c, t, g, unknown or other
  misc_feature (290)..(290): n is a, c, g, or t
  modified_base (292)..(292): a, c, t, g, unknown or other
  misc_feature (292)..(292): n is a, c, g, or t
  modified_base (298)..(298): a, c, t, g, unknown or other
  misc_feature (298)..(298): n is a, c, g, or t
  modified_base (312)..(312): a, c, t, g, unknown or other
  misc_feature (312)..(312): n is a, c, g, or t
  modified_base (329)..(329): a, c, t, g, unknown or other
  misc_feature (329)..(329): n is a, c, g, or t
  modified_base (334)..(334): a, c, t, g, unknown or other
  misc_feature (334)..(334): n is a, c, g, or t
  modified_base (338)..(338): a, c, t, g, unknown or other
  misc_feature (338)..(338): n is a, c, g, or t
  modified_base (350)..(350): a, c, t, g, unknown or other
  misc_feature (350)..(350): n is a, c, g, or t
  modified_base (355)..(355): a, c, t, g, unknown or other
  misc_feature (355)..(355): n is a, c, g, or t
  modified_base (357)..(357): a, c, t, g, unknown or other
  misc_feature (357)..(357): n is a, c, g, or t
  modified_base (359)..(359): a, c, t, g, unknown or other
  misc_feature (359)..(359): n is a, c, g, or t
  modified_base (361)..(361): a, c, t, g, unknown or other
  misc_feature (361)..(361): n is a, c, g, or t
  modified_base (363)..(363): a, c, t, g, unknown or other
  misc_feature (363)..(363): n is a, c, g, or t
  modified_base (365)..(365): a, c, t, g, unknown or other
  misc_feature (365)..(365): n is a, c, g, or t
  modified_base (367)..(369): a, c, t, g, unknown or other
  misc_feature (367)..(369): n is a, c, g, or t
  modified_base (371)..(371): a, c, t, g, unknown or other
  misc_feature (371)..(371): n is a, c, g, or t
  modified_base (385)..(385): a, c, t, g, unknown or other
  misc_feature (385)..(385): n is a, c, g, or t
  modified_base (387)..(387): a, c, t, g, unknown or other
  misc_feature (387)..(387): n is a, c, g, or t
  modified_base (389)..(390): a, c, t, g, unknown or other
  misc_feature (389)..(390): n is a, c, g, or t
  modified_base (405)..(405): a, c, t, g, unknown or other
  misc_feature (405)..(405): n is a, c, g, or t
tcagtcacgtactacacgaccggtgctcgatttagctgcgtcacgatctctcttggggagcttcagctgtggtagagaagacaggattcaggacaatctccagcatggccggcttccctctcctcctcaccctcctcactcactgtgcagggtcctgggcccagtctgtgctgactcagccaccctcagcgtctgggaccccccgggnagagtgcacatctnttgtcnggagcagnacaanagcggataatangctatcngtanacaacacnccaggaaccgcccanacncnatctanagacaaacaaaccngcgtcctcgacggtccngactnttcnctgctacagtcngcacncncncncncncnnngngcgtcgccgacgangngnngtatatactgtgtgngtgagagagacgcgtacgtagtagttcggttcggtacggacggacgtaacgtacgaaccgccgtacgtacgacgaccgacgacgtccg

SEQ ID NO: 298674 - DNA, 531 bp, Homo sapiens
  misc_feature: GZ8MTXP02G7H6R.13.36.D03.1.454.CMB.2.raw
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccctaggacagacggccaggattacctggtagggggaaacaacattaggaagtaaaagtgtgcactggtaccagcagaagccaggccaggcccctgtgctggtcgtctatgttgatagcgaccggccctcgagggactcccctgacgcgacttcgtcgggctccaactcgtgggacacggcactctgaccatcagtaggtcgaagccggggatgagccgatatactgtcaggtgtagggatagtagtcgtagagcagtgtggtattcgggaggacgggaaccaaacgtgaccgtcacggtcacgccaaggctcgccccctggccactcgtcgtcccccg

SEQ ID NO: 298675 - DNA, 625 bp, Homo sapiens
  misc_feature: GZ8MTXP02HIFS1.13.36.D03.1.454.CMB.2.raw
  modified_base (226)..(226): a, c, t, g, unknown or other
  misc_feature (226)..(226): n is a, c, g, or t
  modified_base (335)..(335): a, c, t, g, unknown or other
  misc_feature (335)..(335): n is a, c, g, or t
tcagtcacgtactacacgaccggtgctcgatttagctgcgtcacgatctctcttggggtcacatgggaagtgctttctgagagtcatggacctcctgcacaagaacatgaaacacctgtggttctgcctcctcctggtggcagctccagatgggtcctgtcccaggtgcagctacagcaagtggggcgcgaggggcttggttgaagccttggagaccctgtccctnacgtgcgctgtctcgtggtggttcttcagttggttactacgtggagctggatccgccagtccccgagggagggctggagtggagtggggaaatcaatcagtagtagaancaaccaacctaccaacccgtccctgagacgccgagtcacatgtacagtagacacgtaccaaagaaccagttctcccgtaggacggtgacgtcgtactgtaccggaccggcccggacggaccgacgggtcgtgtacgttaccttcgtggtcggacgtaaggtacggtacgtttaaagtttttcgggacctttccggtcttaacgtttccctttaccccgtttgtaccgtttccggtcggggtacccgtaaccggggtaaccctttacggtacccgttacccggtttcccgg

SEQ ID NO: 298676 - DNA, 631 bp, Homo sapiens
  misc_feature: GZ8MTXP02HIJMI.13.36.D03.1.454.CMB.2.raw
  modified_base (212)..(212): a, c, t, g, unknown or other
  misc_feature (212)..(212): n is a, c, g, or t
  modified_base (251)..(251): a, c, t, g, unknown or other
  misc_feature (251)..(251): n is a, c, g, or t
  modified_base (347)..(347): a, c, t, g, unknown or other
  misc_feature (347)..(347): n is a, c, g, or t
  modified_base (368)..(368): a, c, t, g, unknown or other
  misc_feature (368)..(368): n is a, c, g, or t
tcagtcacgtactacacgaccggtgctcgatttagctgcgtcacgatctctcttggggagcttcagctgtggtagagaagacaggattcaggacaatctccagcatggccggcttccctctcctcctcaccctcctcactcactgtgcagggtcctgggcccagtctgtgctgactcacgccaccctcagcgtcgtcggggaccccccgggnagagtgtcaccatctcttgttctggaggcagtgaccaanagtcgggaagtaattatgctatttcgtggtactacaaacaacctcccgaacggaaccggcccccagcctcctcactctaatacgacaaactaaccngccggcctccgacggggtccngaccgtatctcgtcgctacagtctgcacctcacgccctacccgtggaccagtcgacggtcggaccgtcccggtacgacgtagtcggacgtctagttactttacgttacgttcgtttacgacggttacggttggggtactcgaacgtacgtaccgttaggtaacgtttacgggtttcgggggtttacgggaccgggtaacgggtaccgtaacggttccgaacccggtccgtacggtaccgacgacccggtacggtccgtcccgg

SEQ ID NO: 298677 - DNA, 525 bp, Homo sapiens
  misc_feature: GZ8MTXP02IW34X.13.36.D03.1.454.CMB.2.raw
  modified_base (340)..(340): a, c, t, g, unknown or other
  misc_feature (340)..(340): n is a, c, g, or t
  modified_base (411)..(411): a, c, t, g, unknown or other
  misc_feature (411)..(411): n is a, c, g, or t
  modified_base (432)..(432): a, c, t, g, unknown or other
  misc_feature (432)..(432): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtcggccccaggacagacggccaggattacctgtaggggaaacaacattggaagtaaaagtgtgcactggtaccagcagaagccaggccaggcccctgtgctggtcgtctatgttgatagcgaccggccctcagggatccctgagcgattcncggctccaactcgtgggacacggccactctgaccatcagtaggtcgaagcggggatgaggcccgatatacngtcaggtgtggatagtagtgngagcgatgtggtagttagcggaggacgaaacgtacgacgtacgtacgtacgacgaccgaacgcgtcgcccgtccggtcgactctcgttccccg

SEQ ID NO: 298678 - DNA, 573 bp, Homo sapiens
  misc_feature: GZ8MTXP02IP2K9.13.36.D03.1.454.CMB.2.raw
  modified_base (208)..(208): a, c, t, g, unknown or other
  misc_feature (208)..(208): n is a, c, g, or t
tcagtcacgtactacacgaccggtgctcgatttagctgcgtcacgatctctcttggggagcttcagctgtggtagagaagacaggattcaggacaatctccagcatggccggcttccctctcctcctcaccctcctcactcactgtgcagggtcctgggcccagtctgtgctgactcagccaccctcagcgtctcgggacccccgggnagagtgtcaccatctcttgttctggaggcagtgccaacagtcgggagtaatatgcattctggtatcaacaactccaggaacgcccccagacctcctcatctaatagacaaataaccagccggcccctcgacggggtcccctgaccgattctctggcctccaagtcctaggcacctcacgccctccctgccatcgagtcggggctcccgggtccgacgagtcgaggtcctaggtattagttactgttccagtccgttgggatgacagtccctagtaactttacggttggggtttaccggacggtacggggaaccctaaggttcgaaccgtcccgtaacggtcacgacccgaacgtcccttcccccg

SEQ ID NO: 298679 - DNA, 550 bp, Homo sapiens
  misc_feature: GZ8MTXP02GPGPI.13.36.D03.1.454.CMB.2.raw
  modified_base (392)..(392): a, c, t, g, unknown or other
  misc_feature (392)..(392): n is a, c, g, or t
tcagtcacgtactacacgaccggtgctcgatttagctgcgtcacgatctctcttggggtcacatgggaagtgctttctgagagtcatggacctcctgcacaagaacatgaaacacctgtggttctgcctcctcctggtggcagctcccagatgggtcctgtcccaggtgcagctacagcaatggggcgcagggctgttgaagccttcggagaccctgtccctcacgtgcgctgtctctggtggttctcagtgtactactggagctggatccgcagtccccagggagggctggagtggagttggggaaatcgaatcatagtggaagcaccaacctacacccgtcctcgagacgccgagtcaccatgtcagtagacacgtcaaacgacagttcnccctgaggtgagctctgtcgaccgccgcggacgacggctgtcgtacttcgtgtcgcgagaggcttaagttttcggacttcgtctactttccttccgtttgtacgttcggtcgggggtaccctaacggggtaacccctaggtcccgtaccgtttcccgg

SEQ ID NO: 298680 - DNA, 565 bp, Homo sapiens
  misc_feature: GZ8MTXP02IYK92.13.36.D03.1.454.CMB.2.raw
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctgtgggggaaacaacattggaagtaaagtgtgcactggtaccagcagaagccaggccaggcccctgtgctggtcgtctatgttgatagcgaccggccctcgagggactcccgtgagcgattcgtcgggctccaactcgtagggaccacggccactctgaccatcagtagggtcgaagccgggggatggacggccgactattacgtgtcagggtgtgggattaggtagtcgtgagcagtggtggtagttcgggacggagggaaccaaaacgtcggacccgtcgtaaggtccgaacgtccccgaaggccgtacggcccccgtcgggtaccaccgttctcgtttcccccg

SEQ ID NO: 298681 - DNA, 530 bp, Homo sapiens
  misc_feature: GZ8MTXP02JADZM.13.36.D03.1.454.CMB.2.raw
  modified_base (188)..(188): a, c, t, g, unknown or other
  misc_feature (188)..(188): n is a, c, g, or t
tcagtcacgtactacacgaccggtgctcgatttagctgcgtcacgatctctcttggggtcacatgggaagtgctttctgagagtcatggacctcctgcacaagaacatgaaacacctgtggttctgcctcctcctggtggcagctcccagatgggtcctgtcccaggtgcagctacagcaatggggcncagggctgttgaagccttcggagaccctgtccctcacgtgcgctgtctctggtgggttcttcagtggttactactggagctggatccgccagtccccagggaagggctggagtggattggggaaatcaatcatagtggaagcaccaactacaacccgtcctcgagacgccgagtcaccatgtcagtagacacgtccaaagaaccagttctccctgacgggtgagctctgtgaccgcgcggacacggctgtgtacttctgtgcgagaggctaattttggacttcgtcacgttctccctttgacttcgtcggggtccacggggaaccctagtccgtacgttccg

SEQ ID NO: 298682 - DNA, 559 bp, Homo sapiens
  misc_feature: GZ8MTXP02J1R2Q.13.36.D03.1.454.CMB.2.raw
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctgtgggggaaacaacattggaagtaaaagtgtgcactggtaccagcagaagccaggccaggcccctgtgctggtcgtctatgttgatagcgacccggccctcgagggactcccctgagcgattcgtcggggcttccaactctggggaccacgggccacgtctgaccatcagtagggtcgaaggccggggatggagggcccgacgttattactgtcaggtgtgggatagtagtcgtgagcatgtggtagttcgggcggagggtaaccaaaacgtcggacccggtcctagggtccacgccccgaaggccgtcgcccccgtcggtccaccgtcgttcgtccccc

SEQ ID NO: 298683 - DNA, 570 bp, Homo sapiens
  misc_feature: GZ8MTXP02JLFYA.13.36.D03.1.454.CMB.2.raw
  modified_base (366)..(366): a, c, t, g, unknown or other
  misc_feature (366)..(366): n is a, c, g, or t
  modified_base (381)..(381): a, c, t, g, unknown or other
  misc_feature (381)..(381): n is a, c, g, or t
  modified_base (459)..(459): a, c, t, g, unknown or other
  misc_feature (459)..(459): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctggtagggggaaacaacattaggaaagtaaagtgtgcactggtaccagcagaagccaggccaggcccctgtgctggtcgtctatgttgatagcgaccggccctgagggactccctgagcgacttcgtcgggctccaactcgtgggacncggccactctgacancagtaggtacgaaggccgggatgacggcgacgtatacgtgtcgagggtgtagggataggtagtcggtgagcagttggnggttagttcgggcggacgggaaccaaacgtggaacccgtacgtacggtccgacgcccgaaacggccgtaccggcccccgttcgggtccaccgttccgtcggtttccccccg

SEQ ID NO: 298684 - DNA, 660 bp, Homo sapiens
  misc_feature: GZ8MTXP02GOQRI.13.36.D03.1.454.CMB.2.raw
  modified_base (386)..(386): a, c, t, g, unknown or other
  misc_feature (386)..(386): n is a, c, g, or t
  modified_base (528)..(528): a, c, t, g, unknown or other
  misc_feature (528)..(528): n is a, c, g, or t
  modified_base (534)..(534): a, c, t, g, unknown or other
  misc_feature (534)..(534): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtcggccccaggacaggacggccaggattaccgtggtagggggaaacaacagttaggaaagtaaaagtgtgcacgtggtaccagcagaagccaggccaggcccctgtgctggtctctatgttgatagccgacccggccctcgagggactcccgtgagcgtacttccgtccgggctacccgaactccgtaggggaaccnccgggacctacgtccgtacgaacccagttcgaaacggtaggggtaccggaaaacgggcccgggggtaatcgggaacgggcccgtaaacgttaacgttaccgtagtcgtaaggggttggtaggggtattagggtagttcgggngaacgnagtggtagtaagtccgggagggaacggacctaaaacgtcggaacccgtcgtaaacggtccgaacggccccgtaaaggcccgtcccggtacccccgtcggtccctacgtcccgttcgtttacccccc

SEQ ID NO: 298685 - DNA, 592 bp, Homo sapiens
  misc_feature: GZ8MTXP02JHGV9.13.36.D03.1.454.CMB.2.raw
  modified_base (390)..(390): a, c, t, g, unknown or other
  misc_feature (390)..(390): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctgtgggggaaacaacattggaagtaaagtgtgcactggtaccagcagaagccaggccaggcccctgtgctggtcgtctatgttgatagcgaccggccctcgagggactccccgtgacgcgacttccgtcggggcctaccgaactccgtagggaccaccgggcccaacgtccngaacccattccgaagtagggtacgaacggccggggatggacggccgactagttacgtgtcgtaggtgtgggatagtagtcgtagagcagtgtggtagttcgggacggacgggaaccaaacgtcggacccgtaccgtaggtaccacggtacccaaacggccgtaccgtacccccgtcgggtccaccgtcctcggtttaccccc

SEQ ID NO: 298686 - DNA, 565 bp, Homo sapiens
  misc_feature: GZ8MTXP02IAHJ2.13.36.D03.1.454.CMB.2.raw
tcagtcacgtactacacgaccggtgctcgatttagctgcgtcacgatctctcttggggtcacatgggaagtgctttctgagagtcatggacctcctgcacaagaacatgaaacacctgtggttctgcctcctcctggtggcagctcccagatgggtcctgtcccaggtgcagctacagcaatggggcgcagggctgttgaagccttcggagaccctgtccctcacgtgcgctgtctctggtggttcttcagcagtggtagtttctacgtggagctggatcccggcacggcccggccggggaaggacgtggagtggagtttgggctttatcaagtggccgaggtcgggggcaccgagcctaccaaccccctccctcaacgacgcccgcgtccacctatttcagtagacacgtaccaaagaacccagcctctccctgacgctagagttctcggtcgacccgccgcgagaccgacggtccgtgtattacgtgtcgcgcgacgaggtcggacgttcgcggggaccgaacgggaacccgtacggtccaccggtctcccgtacacgtcccc

SEQ ID NO: 298687 - DNA, 571 bp, Homo sapiens
  misc_feature: GZ8MTXP02JRKLY.13.36.D03.1.454.CMB.2.raw
  modified_base (365)..(365): a, c, t, g, unknown or other
  misc_feature (365)..(365): n is a, c, g, or t
  modified_base (382)..(382): a, c, t, g, unknown or other
  misc_feature (382)..(382): n is a, c, g, or t
  modified_base (434)..(434): a, c, t, g, unknown or other
  misc_feature (434)..(434): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctatcactgcacaggctctgtgacctcctatgtgctgactcagccaccctcggtgtcagtggccccaggacagacggccaggattacctggtagggggaaacaacattggaaagtaaaagtgtgcactggtaccagcagaagccaggccaggcccctgtgctggtcgtctatgtgatagcgaccggccctgagggctcccgtgagcgacttcgcggctccaactcgtagggaccncgggccactctcgaccntcgaggtagggtacggaacggccggggatgggacggccgaacttagttacgngtcgtagggtggtagggagtagtagtaggtgagcgagttggtcggtagttcgggcgggaagggaacccaaagtcggacccgtcgtacggtcacggaccaaggcgccgcccccgtcggctaccgtcctcgttcccccg

SEQ ID NO: 298688 - DNA, 548 bp, Homo sapiens
  misc_feature: GZ8MTXP02HIC9X.13.36.D03.1.454.CMB.2.raw
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctgtggggaaacaacattggaagtaaaagtgtgcactggtaccagcagaagccaggccaggcccctgtgctggtcgtctatgtgatagcgaccggccctcagggactccccgtgacgcgacttcgcgggctccaactctgggacacggcactctgaccatcagtaggtcgaagccggggatgaggccgactagtactgtcaggtgtgggatagtagtcgtgagtcagtggtggtagttcgggcggtaaggggaccaaaacgttggaacccgtcgtacgggtcacggacccaaggccgtcgcccccgtcggtccaccgtcgtcgttcccccg

SEQ ID NO: 298689 - DNA, 541 bp, Homo sapiens
  misc_feature: GZ8MTXP02JV5NQ.13.36.D03.1.454.CMB.2.raw
  modified_base (370)..(370): a, c, t, g, unknown or other
  misc_feature (370)..(370): n is a, c, g, or t
  modified_base (381)..(381): a, c, t, g, unknown or other
  misc_feature (381)..(381): n is a, c, g, or t
  modified_base (450)..(450): a, c, t, g, unknown or other
  misc_feature (450)..(450): n is a, c, g, or t
  modified_base (454)..(454): a, c, t, g, unknown or other
  misc_feature (454)..(454): n is a, c, g, or t
tcagtcacgtactacacgaccggtgctcgatttagctgcgtcacgatctctcttggggagtctgggtcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctgtagggggaaacaacattggaaagtaaaagtgtgcactggtaccagcagaagccaggccaggcccctgtgctggtctctatgttgatagcgaccggccctcgagggactccctgacgcgacttcgtcgggctaccgaactcgtagggacnccggccactcngaccatcagtagggtacgaaggccggggatgaggcccgatagtactgtcgaggtgtggatagtacgtgngagngtagtggtgtagtcggacggacggaaccaacgtcgaccgtcgtaggcacgaccgagccgccgccccgtcgtccacctcctccgtccc

SEQ ID NO: 298690 - DNA, 563 bp, Homo sapiens
  misc_feature: GZ8MTXP02GFT50.13.36.D03.1.454.CMB.2.raw
  modified_base (187)..(187): a, c, t, g, unknown or other
  misc_feature (187)..(187): n is a, c, g, or t
  modified_base (210)..(210): a, c, t, g, unknown or other
  misc_feature (210)..(210): n is a, c, g, or t
  modified_base (222)..(222): a, c, t, g, unknown or other
  misc_feature (222)..(222): n is a, c, g, or t
tcagtcacgtactacacgaccggtgctcgatttagctgcgtcacgatctctcttggggtcacatgggaagtgctttctgagagtcatggacctcctgcacaagaacatgaaacacctgtggttctgcctcctcctggtggcagctccagatgggtcctgtcccaggtgcagctacagcaatggggcncagggctgttgaagccttcgganaccctgtccctnacgtgcgatgtctcgtgggtggttcttcagtggttactactggagctggatccgccagtccccgaggggaacgggctgggagtggattggggaaatcgaatcatagtggagcacgaacctacaacccgtcctacgagacgccgagtcaccatgtcagtacgacacgtccaaacgaccagttcctcccgtgagggttcgagctcgtgtcgaccgcgcggacacggctgtcgtacttcgtagtcgcggagaggtctaagtttttcggacttcgtctacgtttcctaccgtttgacgttcgtcggggtacctacgggtaaccctacggtacctaccggttaccg

SEQ ID NO: 298691 - DNA, 574 bp, Homo sapiens
  misc_feature: GZ8MTXP02GDFPV.13.36.D03.1.454.CMB.2.raw
  modified_base (368)..(368): a, c, t, g, unknown or other
  misc_feature (368)..(368): n is a, c, g, or t
  modified_base (378)..(378): a, c, t, g, unknown or other
  misc_feature (378)..(378): n is a, c, g, or t
  modified_base (431)..(431): a, c, t, g, unknown or other
  misc_feature (431)..(431): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctgtagggggaaacaacattaggaaagtaaagtgtgcactggtaccagcagaagccaggccaggcccctgtgctggtcgtctatgttgatagcgaccggccctgagggactcccgtgacgcgacttcgtcgggctccaactctagggaccncggccactcngaccatcagtagggtacgaacggccggggatggaggcccgacttaagttacgngtcgtaggtgtgggattaggtagtcgtgacgctagtggtggtagttcgggacgggtaaggacctaaaacgtggacccgttcgtaggtccaacggcccgaaggccgtaccgcccccgtcggtaccaccgttcctccgtaccccc

SEQ ID NO: 298692 - DNA, 612 bp, Homo sapiens
  misc_feature: GZ8MTXP02JKZFG.13.36.D03.1.454.CMB.2.raw
  modified_base (295)..(295): a, c, t, g, unknown or other
  misc_feature (295)..(295): n is a, c, g, or t
  modified_base (450)..(450): a, c, t, g, unknown or other
  misc_feature (450)..(450): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtcggccccaggacaggacggccaggattaccgtggtagggggaaacaacattaggaaagtaaagtgtgcacgtggtaccagcagaacgccaggccacggcccctgngctggtctctatgtgatagcgaccggccctcgagggactcccgtgacgcgacttcgtcgggctaccaactcgtacgggaccacgggccactcgtacgacccatcaaggtacgggtacgaaacgggccggggatcggacggccgattacgttacgngtcgagggtggtagggtagtagtagtcggtagagcgtagtggtaggtagttcgggacgggacgggaaacctaaacggtcggaacccgttcgtacgggtccacggtcccgaaacgggtcctccggtcccccgtcggtcctaccgttccgttacgtttcccccc

SEQ ID NO: 298693 - DNA, 721 bp, Homo sapiens
  misc_feature: GZ8MTXP02I7ZSM.13.36.D03.1.454.CMB.2.raw
  modified_base (187)..(187): a, c, t, g, unknown or other
  misc_feature (187)..(187): n is a, c, g, or t
  modified_base (208)..(208): a, c, t, g, unknown or other
  misc_feature (208)..(208): n is a, c, g, or t
  modified_base (211)..(211): a, c, t, g, unknown or other
  misc_feature (211)..(211): n is a, c, g, or t
tcagtcacgtactacacgaccggtgctcgatttagctgcgtcacgatctctcttggggagcttcagctgtggtagagaagacaggattcaggacaatctccagcatggccggcttccctctcctcctcaccctcctcactcactgtgcagggtcctgggcccagtctgtgctgactcagccaccctnagcgtctgggaccccccgggnagngtcgtccaccatctcttgttcgtggagcagtcgaccaacgagtacggggtaagtaattatgctacttcgtaggtactaccaaacctaacctacccgaacggaacccggacccccagtaccctccctactactacctaatacgacctaaactaaaccgacggcccggtcccgtacccggtaccggggtcccctacggtaaccgtacttccgtcgtcggtaccctaccgtaacgtccgtacggaccctacccgtccgacccgtcccctcccgtacggaccctagtccgtacggtccgggtccgttcccgggtaccgacgtagtacggacggtcgttagtactttacgttacgttcgttacgtagttacggttagggtagtacggtaacgtacgtaccgtaggtaacgtttaccggtttcgggggtttaccgggacgggtacgggtaacccgtacggttaccggaacccggtacccgtacggtaccgaccggacccgtacggtcccgtcccgg

SEQ ID NO: 298694 - DNA, 583 bp, Homo sapiens
  misc_feature: GZ8MTXP02GOXXS.13.36.D03.1.454.CMB.2.raw
  modified_base (212)..(212): a, c, t, g, unknown or other
  misc_feature (212)..(212): n is a, c, g, or t
  modified_base (224)..(224): a, c, t, g, unknown or other
  misc_feature (224)..(224): n is a, c, g, or t
  modified_base (367)..(367): a, c, t, g, unknown or other
  misc_feature (367)..(367): n is a, c, g, or t
tcagtcacgtactacacgaccggtgctcgatttagctgcgtcacgatctctcttggggtcacatgggaagtgctttctgagagtcatggacctcctgcacaagaacatgaaacacctgtggttctgcctcctcctggtggcagctcccagatgggtcctgtcccaggtgcagctacagcaagtggggcgcagggctgttgaagccttcgganaccctgtccctnacgtgcgctgtctcgtggtggttcttcagttggttactacgtggagctggatccgccagtccccgagggaagggctggagtggagttggggaaatcaatcagtagtgaagcacaacctaccaacccgtcctcgacgacgccgngtccacatgtcagtacgacacgtacaaacgaccagttcctacccgtgacgggtgagctcgtgtcgaccgccgcggacacggctgtcgtacttcgtgtcgacgagtacggtacttaagtttttcggacgttcgtacctacgtttccttacccgtttgtaccgtttcggtcggggacccgtacggggtaacccgttacgtcccgtacccgtttcccgg

SEQ ID NO: 298695 - DNA, 615 bp, Homo sapiens
  misc_feature: GZ8MTXP02I2MGB.13.36.D03.1.454.CMB.2.raw
tcagtcacgtactacacgaccggtgctcgatttagctgcgtcacgatctctcttggggtcacatgggaagtgctttctgagagtcatggacctcctgcacaagaacatgaaacacctgtggttctgcctcctcctggtggcagctcccagatgggtcctgtcccaggtgcagctacagcaatggggcgcagggctgttgaagccttcggagaccctgtccctcacgtgcgctgtctcgtggtggttctcagtggttactactggagctggatccgcacgtccccgagggaagggctggagtggagttaggggaaatcgaatcagtagtggaagcaaccaacctacaacccgtcctacgagacgccgagtcaccatgtcagtacgacacgtacaaacgaaccagttcctacccgtaggacgggtcgagccgtcgtacggtacgacccgtccggacggaccgaccggtctaggtacgttaccgttcgtggtacggcgtaagaacgggtcttaaaacggtttttgggaaccttcggttactaactttccgttaccccttttgaccgtttcgtcgggggtacctaacggggtaaccctacggtaccgtacccgttcccg

SEQ ID NO: 298696 - DNA, 584 bp, Homo sapiens
  misc_feature: GZ8MTXP02HPN2C.13.36.D03.1.454.CMB.2.raw
  modified_base (187)..(187): a, c, t, g, unknown or other
  misc_feature (187)..(187): n is a, c, g, or t
  modified_base (209)..(209): a, c, t, g, unknown or other
  misc_feature (209)..(209): n is a, c, g, or t
  modified_base (371)..(371): a, c, t, g, unknown or other
  misc_feature (371)..(371): n is a, c, g, or t
tcagtcacgtactacacgaccggtgctcgatttagctgcgtcacgatctctcttggggagcttcagctgtggtagagaagacaggattcaggacaatctccagcatggccggcttccctctcctcctcaccctcctcactcactgtgcagggtcctgggcccagtctgtgctgactcagccaccctnagcgtctcgggaccccccgggnagagtgtccaccatctcttgttctgggaggcagtgaccaacatcggggagtaattatgcatttctggtatacaacaaccgtccccaaggaaccggcccccagacctcctcatctatagcaaactaaccagccggccctcgacggggtccctgaccgattccnctcggctaccaagtcctggccacctcacgccctccctcggccatcgagtcgggcctcccggtccgacgtagtggaggctagtattattactgttcagtcgttgggatgacagcctagtaacgtttcgtttacggggtttcgggacgggtacgggaccgttaaggttccgaacccggtccgtagggtccgacgaccccgtaaggccgtacccgg

SEQ ID NO: 298697 - DNA, 512 bp, Homo sapiens
  misc_feature: GZ8MTXP02I2I2K.13.36.D03.1.454.CMB.2.raw
  modified_base (188)..(188): a, c, t, g, unknown or other
  misc_feature (188)..(188): n is a, c, g, or t
  modified_base (223)..(223): a, c, t, g, unknown or other
  misc_feature (223)..(223): n is a, c, g, or t
  modified_base (314)..(314): a, c, t, g, unknown or other
  misc_feature (314)..(314): n is a, c, g, or t
  modified_base (316)..(317): a, c, t, g, unknown or other
  misc_feature (316)..(317): n is a, c, g, or t
  modified_base (319)..(319): a, c, t, g, unknown or other
  misc_feature (319)..(319): n is a, c, g, or t
  modified_base (343)..(343): a, c, t, g, unknown or other
  misc_feature (343)..(343): n is a, c, g, or t
  modified_base (352)..(352): a, c, t, g, unknown or other
  misc_feature (352)..(352): n is a, c, g, or t
  modified_base (359)..(360): a, c, t, g, unknown or other
  misc_feature (359)..(360): n is a, c, g, or t
  modified_base (373)..(373): a, c, t, g, unknown or other
  misc_feature (373)..(373): n is a, c, g, or t
  modified_base (392)..(392): a, c, t, g, unknown or other
  misc_feature (392)..(392): n is a, c, g, or t
  modified_base (431)..(431): a, c, t, g, unknown or other
  misc_feature (431)..(431): n is a, c, g, or t
tcagtcacgtactacacgaccggtgctcgatttagctgcgtcacgatctctcttggggtcacatgggaagtgctttctgagagtcatggacctcctgcacaagaacatgaaacacctgtggttctgcctcctcctggtggcagctcccagatgggtcctgtcccaggtgcagctacagcaatggggcncagggctgttgaagccttcggagaccctgtccctnacgtgcgctgtctctggtgggttcttcagtggttactactggagctggatcgccagtccccaggaagggctggagtggattggggaaaatnannanagagagacacaaccacacctaccncgagagcgngcacatnnagagacacacaanaacatctctgaggagagcnctgtcgacgccgcggacgacgcgtgtcgtacttctgtgngagagagtaatttagtacgtcgtactacttcttccttcgtacgttcgtcgggaccgacggaaccgtacgtacgtaccgtcg

SEQ ID NO: 298698 - DNA, 737 bp, Homo sapiens
  misc_feature: GZ8MTXP02H0C3H.13.36.D03.1.454.CMB.2.raw
  modified_base (209)..(209): a, c, t, g, unknown or other
  misc_feature (209)..(209): n is a, c, g, or t
tcagtcacgtactacacgaccggtgctcgatttagctgcgtcacgatctctcttggggagcttcagctgtggtagagaagacaggattcaggacaatctccagcatggccggcttccctctcctcctcaccctcctcactcactgtgcagggtcctgggcccagtctgtgctgactcagccaccctcagcgtctcgggaccccccgggnagagtcgcacctattcttcttgttcgtggacggctagtcgaccaacgtagtacgggtaattaattatgactattcgtagtactaccaaaccaacccgtaccccgaacggaaccccggacccccaacgtaccctcctactacttacctaatacgaactaaacgtaaccgacggcccggtacccgtaccggtaccggggttcccctacgtaccgttacttccgttcgtcggtacctaccgtaacgttccgtacgtaccctacctccgaccgtccctcccgtcgaccctacgtccgtacggtccgggtcccgtcccggtaccgacgtacgtacggacgtacgttagttaactttacgttacgtgttacgaggttcggttaggaacttacggacgtacgtcgttaaggttaacgttttacgggtttcggggtttaccgggacggggtaaccggtaaccgttaacggttacccggaacccggttaccgttaacgggtaccgaaccggtaccccggtaacggtcccctacccgg

SEQ ID NO: 298699 - DNA, 758 bp, Homo sapiens
  misc_feature: GZ8MTXP02GLA1M.13.36.D03.1.454.CMB.2.raw
  modified_base (384)..(384): a, c, t, g, unknown or other
  misc_feature (384)..(384): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtcggccccaggacagacggccaggattaccgtggtagggggaaacaacagttaggaaagtaaagtgtgcacgtggtaccagcagaacgccaggccacggcccctgtcgctggtcgtctatgttgatacgcgacccggccctgagggactcccgtgacgcgtacttccgtcgggctaccgaactcgtacgggaccnccgggacctactccgtacgaacctagtacgtaaggtacggggtacggaacgggaccgggggtatcgggaacggccgtaacgttaacgtttaaccgtcggttacggtaaggggttgggtagggggtaagtttaacggggttaggttccggggttaggaaccggtacgttaaggttggggtttaggggttacggtttaccgggggaacgggggaacgggggttaaaaccccaaaacggtttcgggaaaccccggttaccggttaacggggttacccgaaaccggtaccccggaaaacgggtcccgttaaccccgggtacccccccggttccggggtaaccctacccgtttcccgtttcccggtttaaccccccccg

SEQ ID NO: 298700 - DNA, 544 bp, Homo sapiens
  misc_feature: GZ8MTXP02ITMIQ.13.36.D03.1.454.CMB.2.raw
  modified_base (363)..(363): a, c, t, g, unknown or other
  misc_feature (363)..(363): n is a, c, g, or t
  modified_base (413)..(413): a, c, t, g, unknown or other
  misc_feature (413)..(413): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctgtagggggaaacaacattggaagtaaagtgtgcactggtaccagcagaagccaggccaggccccctgtgctggtctctatgttgatagcgaccggccctcagggactccctgagcgacttcgtcgggctccaactcgtgggacncggccactctgaccatcagtggtcgaagccggggatgaggccgatatacngcaggtgtgggatagtagtcgtagagctatggtggtagttcgggcgggaggaaccaaaacgtcggacccggtactacgggtacacggcccaaagggctccggccccctcggtccaccgttctcgttccccc

SEQ ID NO: 298701 - DNA, 567 bp, Homo sapiens
  misc_feature: GZ8MTXP02G2AMQ.13.36.D03.1.454.CMB.2.raw
  modified_base (470)..(470): a, c, t, g, unknown or other
  misc_feature (470)..(470): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtcggccccaggacagacggccaggattacctgtaggggaaacaacattaggaagtaaagtgtgcactggtaccagcagaagccaggccaggcccctgtgctggtcgtctatgttgatagcgaccggccctgagggactccctgacgcgacttccgtcggggctccaactcgtagggaccaccgggccaactcctagacccatccagtagggtacgaaagcgggggatggacggccgactagttaacgtgtcgtaaggtggtagggattagtagtcgtgagngtagtggtaggtagtcgggacggaacggaacgaaacgtcgaccgtcgtacggtcgacgaccgaggccgtccgcccgtcgtactacttcgtctccccg

SEQ ID NO: 298702 - DNA, 530 bp, Homo sapiens
  misc_feature: GZ8MTXP02JYL6G.13.36.D03.1.454.CMB.2.raw
  modified_base (360)..(360): a, c, t, g, unknown or other
  misc_feature (360)..(360): n is a, c, g, or t
  modified_base (475)..(475): a, c, t, g, unknown or other
  misc_feature (475)..(475): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctgtgggggaaacaacattggaagtaaaagtgtgcactggtaccagcagaagccaggccaggcccctgtgctggtcgtctatgttgatagcgaccggccctgagggatcccgtgagcgattctcgggctccaactctgggacncgggccactctgaccatcagtagggtcgaaggccggggatgaggccgatattactgtcagggtgtgggatagtagtcgtgagcagtgtggtagttcgggcggaggaccaaaacgngaccgtcgtaggtcacgcccaaggctcgccccctcggtccactcctcgttccccg

SEQ ID NO: 298703 - DNA, 544 bp, Homo sapiens
  misc_feature: GZ8MTXP02H03WU.13.36.D03.1.454.CMB.2.raw
  modified_base (366)..(366): a, c, t, g, unknown or other
  misc_feature (366)..(366): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctggtaggggaaacaacattggaagtaaagtgtgcactggtaccagcagaagccaggccaggccccctgtgcctggtcgtctatgtgatgcgaccggcccctgagggactcccctgagcgacttcgtcggggctccaactcgtgggacncgggccacgtctcgacatcagtagggtcgaaggcggggatgaggccgactattacgtgtcaggtggtggagtagtagtcgtgagcagtggtggtagttcgggcgggagggaccgaaaacgtcggaccgtccgtaggtcgacgccgaaggctcgccccgtcggtcactcctcgtccccc

SEQ ID NO: 298704 - DNA, 566 bp, Homo sapiens
  misc_feature: GZ8MTXP02I9BF2.13.36.D03.1.454.CMB.2.raw
  modified_base (284)..(284): a, c, t, g, unknown or other
  misc_feature (284)..(284): n is a, c, g, or t
  modified_base (316)..(316): a, c, t, g, unknown or other
  misc_feature (316)..(316): n is a, c, g, or t
  modified_base (358)..(358): a, c, t, g, unknown or other
  misc_feature (358)..(358): n is a, c, g, or t
  modified_base (366)..(366): a, c, t, g, unknown or other
  misc_feature (366)..(366): n is a, c, g, or t
  modified_base (370)..(370): a, c, t, g, unknown or other
  misc_feature (370)..(370): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtcggccccaggacagacggccaggattaccgtggtagggggaaacaacattaggaaagtaaaagtgtgcactggtaccagcagagcagcagcccngtgctgtcgtctatgtgatgcgaccggccctnagggctccgtgacgcgattcgcgggctccaactcgtaggacncgcactcngacntcgagtaggtacgaagtcgggatgacggccgactagtacgtgtcgtaggtcggtaggtatagtacgtcgtagagcgtagttgggtaggttacggttcgggacggggaacggaaccgaaaacgtcggacccgtacgtacggtcaacggcccgaaggccgtacgcccccgtggtacccacgtcgttccggttcccccg

SEQ ID NO: 298705 - DNA, 618 bp, Homo sapiens
  misc_feature: GZ8MTXP02HH72V.13.36.D03.1.454.CMB.2.raw
  modified_base (290)..(290): a, c, t, g, unknown or other
  misc_feature (290)..(290): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctggtagggggaaacaacattaggaaagtaaaagtgtgcactggtaccagcagaagccaggccaggcccctgngctggtcgtctatgttgatagcgaccggccctcgagggactccccgtgacgcgtacttcgcggggcctaccgaactccgtaggggaccaccgggccaacgttctacgaccatcgaaggttaggggtaccgaaaggcccgggggatgggacggccgaacgttattacgtgtcgagggtggtgggataggtagtcggtagagcagttggtggttagttcggggacgggaacgggaaccaaaacggtcggtaacccgtacgtacgggtaccacggacccgaaacgggcctccggcccccgtcggtaccaccgttccgtccggtttcccccc

SEQ ID NO: 298706 - DNA, 541 bp, Homo sapiens
  misc_feature: GZ8MTXP02JPMTL.13.36.D03.1.454.CMB.2.raw
  modified_base (188)..(188): a, c, t, g, unknown or other
  misc_feature (188)..(188): n is a, c, g, or t
  modified_base (223)..(223): a, c, t, g, unknown or other
  misc_feature (223)..(223): n is a, c, g, or t
tcagtcacgtactacacgaccggtgctcgatttagctgcgtcacgatctctcttggggtcacatgggaagtgctttctgagagtcatggacctcctgcacaagaacatgaaacacctgtggttctgcctcctcctggtggcagctcccagatgggtcctgtcccaggtgcagctacagcaatggggcncagggctgttgaagccttcggagaccctgtccctnacgtgcgctgtctctggtggttcttcagtggttactactggagctggatccgccagtccccagggagggctggagtggagttggggaaatcaatcatagtgaagcacaacctacaacccgtcctacgagacgccgagtcaccatcgtcagtagacacgtaccaaagaaccagttcctacccgtagacgggtcgagctcgtgtcgaccgccgcggacgacggctgtgtacttcgtgtcgcgagcgctaagttttcggactcgtctacttcctcctttgacttcgtcgggacctacgggaccctacgtccgaccgttccg

SEQ ID NO: 298707 - DNA, 641 bp, Homo sapiens
  misc_feature: GZ8MTXP02H24T6.13.36.D03.1.454.CMB.2.raw
  modified_base (185)..(185): a, c, t, g, unknown or other
  misc_feature (185)..(185): n is a, c, g, or t
  modified_base (218)..(218): a, c, t, g, unknown or other
  misc_feature (218)..(218): n is a, c, g, or t
  modified_base (302)..(302): a, c, t, g, unknown or other
  misc_feature (302)..(302): n is a, c, g, or t
  modified_base (333)..(333): a, c, t, g, unknown or other
  misc_feature (333)..(333): n is a, c, g, or t
  modified_base (350)..(350): a, c, t, g, unknown or other
  misc_feature (350)..(350): n is a, c, g, or t
  modified_base (384)..(384): a, c, t, g, unknown or other
  misc_feature (384)..(384): n is a, c, g, or t
tcagtcacgtactacacgaccggtgctcgatttagctgcgtcacgatctctcttggggagtctgggcctaaggaagcagcactggtggtgcctcagccatggcctagaccgttctcctcctcggcctcctctctcactgcacaggctctgtgacctcctatgtgctgactcagccaccctcggtntcagtcggccccaggacagacgcaggattaccnggtaggggaaacaacgattaggaaagtaaaagtgtgcagtggtaccagcaagaagccaggccaggcccctgtgcgtggtccgtntatgttgatagcgaccggccctagagggacncccgtagagcgacttcncgggctaccaactcgacgggaccacggacactcngaccaatccgaagtacgggacgaaacgggcccggggtaaaggaggaacggtaccgtaacgttaacgttacgtggtacgtagggtggtagggtaagttaggtacggtaggtagagtacgtaggtggtaggttacggtacgggaacgggaacggtaaaccgtaaaacgtccgaacccgtaccggtacggtaccgaaccgacccgtaacggcccgtaccccgccccgtacggtacctaccgttccgttacccgtcccccg

SEQ ID NO: 298708 - DNA, 634 bp, Homo sapiens
  misc_feature: GZ8MTXP02HHWUL.13.36.D03.1.454.CMB.2.raw
tcagtcacgtactacacgaccggtgctcgatttagctgcgtcacgatctctcttggggtcacatgggaagtgctttctgagagtcatggacctcctgcacaagaacatgaaacacctgtggttctgcctcctcctggtggcagctcccagatgggtcctgtcccaggtgcagctacagcaatggggcgcagggctgttgaagccttcggagaccctgtccctcacgtgcgctgtctctggtggttcttcagtgttactactggagctggatccgccagtccccgagggagggctggagtggagtggggaaatcgaaatcgaagtaggtaggaagcaccaacctaccaaccccgtccctacgacgacgccgagtccaaccagtcgtacagtacgaccacgtacccaaacgaaccctacggttccctacccgtaggtacggggtagacgtcctcgtcggtacggacccggccggaccgggaccgaccgggcgttaggtcgttacgttccgttgtcggccggaaggtacggtacttaagtttttcggaccttcggtactacgtttccttcccgtttgaccgtttcggtacggggacccgtaacgggtaccccttacggtacccgtaccggtttcccg

SEQ ID NO: 298709 - DNA, 533 bp, Homo sapiens
  misc_feature: GZ8MTXP02FNZ5W.13.36.D03.1.454.CMB.2.raw
  modified_base (207)..(207): a, c, t, g, unknown or other
  misc_feature (207)..(207): n is a, c, g, or t
  modified_base (345)..(345): a, c, t, g, unknown or other
  misc_feature (345)..(345): n is a, c, g, or t
tcagtcacgtactacacgaccggtgctcgatttagctgcgtcacgatctctcttggggagcttcagctgtggtagagaagacaggattcaggacaatctccagcatggccggcttccctctcctcctcaccctcctcactcactgtgcagggtcctgggcccagtctgtgctgactcagccaccctcagcgtctgggacccccgggnagagtgtcaccatctcttgttctggaggcagtgccaacatcgggagtaattatgcattctggtatcaacaactcccaggaacggcccccagactcctcatctatagcaaataaccagccggccctcgacggggtcccngacccgattcctctggctccaaagtctggcacctcacgcctccctgccatcagtcgggctccggtcacgatgagctgattattactgttcagtcttgggatgacagcctagaattacgttgggtttacggcggtacggggaaccaaggttcgaaccgtcccgtaggtcgacgcccgaacggctcccgg

SEQ ID NO: 298710 - DNA, 648 bp, Homo sapiens
  misc_feature: GZ8MTXP02GXQH1.13.36.D03.1.454.CMB.2.raw
  modified_base (189)..(189): a, c, t, g, unknown or other
  misc_feature (189)..(189): n is a, c, g, or t
  modified_base (213)..(213): a, c, t, g, unknown or other
  misc_feature (213)..(213): n is a, c, g, or t
  modified_base (340)..(340): a, c, t, g, unknown or other
  misc_feature (340)..(340): n is a, c, g, or t
  modified_base (362)..(362): a, c, t, g, unknown or other
  misc_feature (362)..(362): n is a, c, g, or t
  modified_base (373)..(373): a, c, t, g, unknown or other
  misc_feature (373)..(373): n is a, c, g, or t
tcagtcacgtactacacgaccggtgctcgatttagctgcgtcacgatctctcttggggtcacatgggaagtgctttctgagagtcatggacctcctgcacaagaacatgaaacacctgtggttctgcctcctcctggtggcagctcccagatgggtcctgtcccaggtgcagctacagcaagtggggcncgagggctgttgaagccttcgganaccctgtccctcacgtgcgctgtctcgtggtggttcttcagttggttactacgtggagctggactccgccacgtccccgaggggacgggctggagtggagttggggaaatgaatcagtagtaggaancaaccaacctaccacccgtccngacgacgccgngtccacatgtcagtacgacacgtacaaacgaacctgtacctcccgtaggacgggtacgacgtcgtcgtcgtccgacccggccggaccgggaaccgacgggtccgttaggtcgttaccgtttcgtggtcggtacggaggtacggtactttaaacggtttttcgggaactttccggttacttaactttcccgttacccgttttacgtaaccgttttccggacgggggtacccctaaacgggggtaacccccttggttaccccgtaccggtttcccgg

SEQ ID NO: 298711 - DNA, 598 bp, Homo sapiens
  misc_feature: GZ8MTXP02IIQHS.13.36.D03.1.454.CMB.2.raw
  modified_base (369)..(369): a, c, t, g, unknown or other
  misc_feature (369)..(369): n is a, c, g, or t
  modified_base (467)..(467): a, c, t, g, unknown or other
  misc_feature (467)..(467): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattaccgtggtagggggaaacaacattaggaagtaaaagtgtgcactggtaccagcagaagccaggccacggcccctgtcgctggtcgtctatgtgatgcgaccgccctcgaggatcccgtgagcgacttcgtcgggctccgaactcgtagggaccncggccacgtctcgaccatacagtaggtaccgaaaggccgggggaatggacggccgacgtattacgtgtcgaggtggtagggagtagtagtcgtagagngtagtggttaggtagttcgggggacggacggggtaacctaaaacggtcggaacccgttccggaaacggtcgaccgacccgaaggcccgttaccgcccccgtttcggacctaccgttccgtccgttcccccg

SEQ ID NO: 298712 - DNA, 792 bp, Homo sapiens
  misc_feature: GZ8MTXP02G6WKX.13.36.D03.1.454.CMB.2.raw
  modified_base (212)..(212): a, c, t, g, unknown or other
  misc_feature (212)..(212): n is a, c, g, or t
tcagtcacgtactacacgaccggtgctcgatttagctgcgtcacgatctctcttggggagcttcagctgtggtagagaagacaggattcaggacaatctccagcatggccggcttccctctcctcctcaccctcctcactcactgtgcagggtcctgggcccagtctgtgctgactcagcccaccctcagcgtcgtcggggaccccccgggnagagtcgtccacctattcttcgttgttcgtggacggcagtcgaccaacgtagtacgggtaagttaattagtgactattcgtaggtactacaaacctaacctcccgaacggaaccccgcccccaagtaccctaccctactactactaacgtaacgaacctaaaacgtaaacccgacggccccggtaccccgtaccccggtaccggggtaccccctacggtacccgttacgttccgttaccgtccggtaccctaccgtaacggttccgtaccggaccctacccgtccgacccgtcccccttacccggtcgtaccctacgtccggtacgggtccgggtaccccgtaccccgggtaccgtacgtacgtacgggtacgtcgttagttaacgtttacgttacgttcgttacgtacggttacggttagggactacgaacgtacgttacgttaacggttaacggttttacggggtttacgggggtttaccggggaaccggggtaaccgggtaccggttaacggttacccggaacccggttacccgtaacgggtacccgtaccggacccggtacgggtcccgtaccccg

SEQ ID NO: 298713 - DNA, 553 bp, Homo sapiens
  misc_feature: GZ8MTXP02I5IPM.13.36.D03.1.454.CMB.2.raw
  modified_base (365)..(365): a, c, t, g, unknown or other
  misc_feature (365)..(365): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctggtagggggaaacaacattggaaagtaaaagtgtgcactggtaccagcagaagccaggccaggcccctgtgctggtctctatgtgatagcgaccggccctcgagggactccctgagcgacttcgtcggctccaactcgtgggaccncggccactctgaccatcagtagggtcaagggccggggatggaggcccgagttattacgtgtctagggtgtggggataggtagtcgtagagcagtgtggtattcgggcgggacggaacaacgtcgaccgtcgtacggtcaacgcccgaaggctcccgccccgtacggtccaccgtcgtccgttcccccg

SEQ ID NO: 298714 - DNA, 627 bp, Homo sapiens
  misc_feature: GZ8MTXP02F97VG.13.36.D03.1.454.CMB.2.raw
  modified_base (388)..(388): a, c, t, g, unknown or other
  misc_feature (388)..(388): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtcggccccaggacagacggccaggacttaccgtggtagggggaaacaacagttaggaaagtaaaagtgtgcacgtggtaccagcagaacgccgaggccacggcccctggtcgcgtggtcgtctatggttgagtagccggaccggccctacgagggactcccgtgagcgtacttccgcggctccgaactcgtagggaccncggccacgtctcgaccatcgaggtagggtacgaacgggccggggagtggacggcccgtagttacgttacgtcgtcgtagggtggtagggtagttaggtaggtcggtagacgtgtagttggtacggtagttcggggacgggaacggtaaccgtaaacgtcggtaccgttaccgtacggaccgacggacccgaaggccgtacccggcccccgtcggtacctccgttccgtccgttcccccg

SEQ ID NO: 298715 - DNA, 560 bp, Homo sapiens
  misc_feature: GZ8MTXP02FNM9J.13.36.D03.1.454.CMB.2.raw
  modified_base (432)..(432): a, c, t, g, unknown or other
  misc_feature (432)..(432): n is a, c, g, or t
  modified_base (477)..(477): a, c, t, g, unknown or other
  misc_feature (477)..(477): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctgtagggggaaacaacattggaagtaaagtgtgcactggtaccagcagaagccaggccaggcccctgtgctggtctctatgttgatagcgaccggccctcgagggactccctgacgcgacttcgaccgggctcccaacgtccgtaggggaccaccgggcccactctgaaccatccaaggtgggtacgaggccggggatggaggccgatattacngtcaggtgagggatagtagtcggtgagcagtgtggtagttcgggnggaacgggaccaaaagtcggaccgtcgtacggtacacgcccaaggccgtccgcccccgtcggtccaccgtcctcgttaccccc

SEQ ID NO: 298716 - DNA, 553 bp, Homo sapiens
  misc_feature: GZ8MTXP02HIBBH.13.36.D03.1.454.CMB.2.raw
  modified_base (370)..(370): a, c, t, g, unknown or other
  misc_feature (370)..(370): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctggtagggggaaacaacattaggaaagtaaaagtgtgcactggtaccagcagaagccaggccaggcccctgtgctggtcgtctatgttgatagcgaccggccctgagggactccccgtgacgcgacttcgcgggctccaactcgtgggaccncggccactctcgaccatcagtagggtcgaagccggggatgaggccgatattactgtcgaggtgtgggattaggtagtcggtgagcagtgtggtagttcgggacgggacggaaccaaacgtcgaccgtcgtacggtacacgcccgaaggccgtcgcccccgtcggtccaccgtctcgttccccc

SEQ ID NO: 298717 - DNA, 561 bp, Homo sapiens
  misc_feature: GZ8MTXP02IDM60.13.36.D03.1.454.CMB.2.raw
  modified_base (212)..(212): a, c, t, g, unknown or other
  misc_feature (212)..(212): n is a, c, g, or t
  modified_base (375)..(375): a, c, t, g, unknown or other
  misc_feature (375)..(375): n is a, c, g, or t
  modified_base (390)..(390): a, c, t, g, unknown or other
  misc_feature (390)..(390): n is a, c, g, or t
  modified_base (407)..(407): a, c, t, g, unknown or other
  misc_feature (407)..(407): n is a, c, g, or t
  modified_base (482)..(482): a, c, t, g, unknown or other
  misc_feature (482)..(482): n is a, c, g, or t
tcagtcacgtactacacgaccggtgctcgatttagctgcgtcacgatctctcttggggtcacatgggaagtgctttctgagagtcatggacctcctgcacaagaacatgaaacacctgtggttctgcctcctcctggtggcagctcccagatgggtcctgtcccaggtgcagctacagcaatggggcgcaggggctgttgaagccttcgganaccctgtccctcacgtgcgctgtctctgggtgggtttcttcagttggttactacgtggagctggatcccgccacgtccccgagggagggctggagtggagttggggaaatcaatcagtagtaggaagcaacctaacctaccaaccccgtcctcgagacgccgngtccacatgcagtanacacgtccaaagaaccngttacctccctaggacgggtgacgtctcgtgtcgacccgccggccggacgacggctgtcgtacttctgtgcgagngctaagttttgactcgtctattcctccgtttgtacgttcgtcggggtacctacgggtaaccctcgtacctaccgttccg

SEQ ID NO: 298718 - DNA, 828 bp, Homo sapiens
  misc_feature: GZ8MTXP02H692S.13.36.D03.1.454.CMB.2.raw
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagcccaccctcgtgtcagtcggccccaggacagacggccaggacttaccgtggtagggggaaacaacagttaggaaagtaaagtgtgcactggtaccagcaagaagccaggccacggcccctgtgcgtggtcgtctatgtgatcgcgaccggcctcgacgggctccctggacgcgtactcgtcggggcctaccgaactcgtacggggaccaccgggacctaccgtcgtacgaacccgattccaagggttacgggggtaccggaaacggggccgggggtaacgtacggggacggggtaccccggtaaacgtttaacgttaaccgttcggttaccggtaaagggggttggggttaggggggtaaagttttaagggggttaaacgggtttccggggttacgggtaaacgggtacgtaaacggttttgggggttagggggttttaaacgggtttacccggggggaccgggggttaaaaccgggggtaaaccccgtaaaaaccgggttaccggggtaaacccccggtttacccgggttaaacggggttaccccgtaaaccgggtacccccggaaaacggggtccccgttaccccggaccccccccggtttcggggtacccccttaacccgtttcccggtttacccccggtttccccccccgg

SEQ ID NO: 298719 - DNA, 625 bp, Homo sapiens
  misc_feature: GZ8MTXP02HVTJL.13.36.D03.1.454.CMB.2.raw
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtcggccccaggacagacggccaggattacctggtagggggaaacaacattaggaaagtaaaagtgtgcactggtaccagcagaagccaggccaggcccctgtgctggtctctatgttgatagccgaccggccctcgagggactcccgtgacgtcgacttccgtccgggcctccaactcgtagggaccacgggccactccgtagaccctatccgaggttacgggtaccggaaagggcccgggggaatcgggacggacccgtacttacgttacgtgtacgtagggttaggtagggtagttaggtaggtcggtaggagcgtagttggttaggtacgttcggggacgggaacggggaacctaaacgtcggacccgtcgtaacgggtcacggcccgaaggccgtccgacccccgttggcctaccgtcgttccgttcccccg

SEQ ID NO: 298720 - DNA, 650 bp, Homo sapiens
  misc_feature: GZ8MTXP02G7DSX.13.36.D03.1.454.CMB.2.raw
  modified_base (287)..(287): a, c, t, g, unknown or other
  misc_feature (287)..(287): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctgtaggggaaacaacattaggaagtaaaagtgtgcactggtaccagcagaagccaggccaggcccctgngctggtctctatgttgatagcggaccggccctcgagggactcccgtgagcgacttcgtcgggctaccaactcgtacgggaccacggccactcgtacgaccatccgaaggtacggggtacgaacggccgggggatcgggacggccgaacttagttaacgtgtacgagggttggtaggggaacttaggactagggttcgtggaagcgtaagtgggttggttaacgttcggggacgggtaacggggtaacccaaaaggtccgggaaccccggttaccggtaacggggtacccaaccgggaccccgaaacgggcccgttaccccggacccccgttcggggtaccctacccgtttcccgtttccccgg

SEQ ID NO: 298721 - DNA, 598 bp, Homo sapiens
  misc_feature: GZ8MTXP02FU28L.13.36.D03.1.454.CMB.2.raw
  modified_base (189)..(189): a, c, t, g, unknown or other
  misc_feature (189)..(189): n is a, c, g, or t
tcagtcacgtactacacgaccggtgctcgatttagctgcgtcacgatctctcttggggtcacatgggaagtgctttctgagagtcatggacctcctgcacaagaacatgaaacacctgtggttctgcctcctcctggtggcagctcccagatgggtcctgtcccaggtgcagctacagcaagtggggcncgagggctgttgaagccttcggagaccctgtccctcgacgtgcgcttgtctcgtggtggttcttcagtggttactactggagctggatccgccacgtccccgagggaagggctggagtggagtggggaaatcaatcagtagtggaagcaaccacctaccaaccccgtcctcgagacgccgagtcaccatcgtacaagtagacctacgtaccaaacgaacctacgttcctacccgtgacgggttgagtcctacgtgtcgaccgccgcggacgacggtctgtcgtacttcgtggtgacgagtaggtacttaagttttcgggacttcggtctactttccgttacccgtttgtacccgtttcggtcggggaccgtaacggggtaaacccttcggtacccgtaccgtttcccgg

SEQ ID NO: 298722 - DNA, 687 bp, Homo sapiens
  misc_feature: GZ8MTXP02HM9LD.13.36.D03.1.454.CMB.2.raw
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctggtagggggaaacaacagttaggaaagtaaaagtgtgcacgtggtaccagcaagaacgccgaggccgacggcccctgtcgcgtggtcgtctatgtgatagcggaccggccctacgacgggactcccgtggacgcgtacttccgtcgggcctaccgaacttcgtacgggaaccgaccgggccacctccgtacgaccctatacgtaacggtacggggtacggaacgggccgggggagtagggacgggacccgtaacgttaagttacgtggtacgtagggttgggtagggtagtttaaggtaggttacggtaggacgcgtaggtggttagggttacggttcggggacggggtaacgggaacctaaaacggtcggtaacccgttacggtaacggtaccgaaccggtacccgaaacggtccgtacccggcccccgttacgggtaccctaccgtccgtttccgtttcccccccg

SEQ ID NO: 298723 - DNA, 624 bp, Homo sapiens
  misc_feature: GZ8MTXP02GK5D6.13.36.D03.1.454.CMB.2.raw
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtcggccccaggacagacggccaggattaccgtggtagggggaaacaacagttaggaaagtaaaagtgtgcactggtaccagcagaagccaggccaggcccctgtcgcgtggtctctatgttgatagcgaccggccctcgagggactcccgtagacgcgacttcgtcgggctaccaactcgtaggggaccaccggcccactctcgaaccatcaaggtagggtcgaagggccggggatggacgggaccgtaacttacgttacgtgtacgtagggttggtaggggtaagttaggtaggtccggtaggaacgcgtaagttgggttaggttaacgttcggggacgggtaacggaaccaaaacgttcggacccgtacgttacgggacacggacccgaaggtccgtaccgcccccgtcgtacctccgttccctcgtaccccc

SEQ ID NO: 298724 - DNA, 596 bp, Homo sapiens
  misc_feature: GZ8MTXP02G4CG6.13.36.D03.1.454.CMB.2.raw
  modified_base (291)..(291): a, c, t, g, unknown or other
  misc_feature (291)..(291): n is a, c, g, or t
  modified_base (376)..(376): a, c, t, g, unknown or other
  misc_feature (376)..(376): n is a, c, g, or t
  modified_base (483)..(483): a, c, t, g, unknown or other
  misc_feature (483)..(483): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtcggccccaggacagacggccaggattaccgtggtagggggaaacaacattaggaaagtaaagtgtgcactggtaccagcagaagccaggccaggcccctgngcgtggtcgtctatgttgatagcgaccggccctcgagggactcccgtgacgcgtacttcgccggctccaacgtcgtacgggaccncggccactcgtcgaccagtcgagtacggtacgaacgggcgggagtggacggtaccgtacttagttaccgtgtacgtaggtggtaggtagtaaggtgtcggtagacgngtagtggtggtacggtcgggacggaacggaactaacggtcggtacccgtacgacggtccgacgaccgtaacggccgtccggccccgtacgtcctccgtccgtccgttcccccg

SEQ ID NO: 298725 - DNA, 654 bp, Homo sapiens
  misc_feature: GZ8MTXP02IQEP7.13.36.D03.1.454.CMB.2.raw
  modified_base (283)..(283): a, c, t, g, unknown or other
  misc_feature (283)..(283): n is a, c, g, or t
  modified_base (285)..(285): a, c, t, g, unknown or other
  misc_feature (285)..(285): n is a, c, g, or t
  modified_base (379)..(379): a, c, t, g, unknown or other
  misc_feature (379)..(379): n is a, c, g, or t
tcagtcacgtactacacgaccggtgctcgatttagctgcgtcacgatccctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattaccgtggtagggggaaacaacgagttaggaaagtaaagtgtgcactgtaccagcagagcagcagcccngngctggtcgtctatgttgatagcgaccggccctcgagggactccccgtgagcgtacttcccgtccggggcctacccgaacgtcgtacggggaacnccgggcccaaccttcgtaccgacccagtaccgtaagggtacggggtaccgaaacgggcccgggggaatacgggaacggcccgtaagttagtttaaccgtgtacgaagggttggtaggggtaatagggttagtcgtagacgcgtagttggtggtacgttacgggcggggtaaggaaccctaaaacgtcggtacccgtaccgttaagggccaacgcccgaaaggtccctccggtccccccgtcggtacctacgttcccgtcgtttaccccccacccg

SEQ ID NO: 298726 - DNA, 684 bp, Homo sapiens
  misc_feature: GZ8MTXP02HWAF2.13.36.D03.1.454.CMB.2.raw
  modified_base (226)..(226): a, c, t, g, unknown or other
  misc_feature (226)..(226): n is a, c, g, or t
tcagtcacgtactacacgaccggtgctcgatttagctgcgtcacgatctctcttggggtcacatgggaagtgctttctgagagtcatggacctcctgcacaagaacatgaaacacctgtggttctgcctcctctggtggcagctcccagatgggtcctgtcccaggtgcagctacagcaagtggggcgcaggggctggttgaagccttcggagaccctgtcccctnacgtgcgctgtctcgtggtggttctcagtggttactacgtggagctggactccgcagtccccgagggagggctggagtggagttaggggaaatcgaatcataggtaggaagacaacaaccctaaccgaacccgttccacgagacgccgagtcaacatcgtcaagtagaccaacgtaccaaacggaaaccctaacggttccctcccgtaggtaacggggtcgaacggccttcgtacggttacggaaccccggccgggaccgggaaaccgacgggtcccgttaggttcgggttaacctttccggtggttcggaccggtaagggacgggtacctttaaaggtttttcggggtaaccttccggttaacgtacttttcccgtaccccgtttttggaccgtttcggttacggggacccgtaaaccgggggtaacccttacggtacccgtaacccggtttcccgg

SEQ ID NO: 298727 - DNA, 572 bp, Homo sapiens
  misc_feature: GZ8MTXP02GPJZT.13.36.D03.1.454.CMB.2.raw
tcagtcacgtactacacgaccggtgctcgatttagctgcgtcacgatctctcttggggtcacatgggaagtgctttctgagagtcatggacctcctgcacaagaacatgaaacacctgtggttctgcctcctcctggtggcagctcccagatgggtcctgtcccaggtgcagctacagcaatggggcgcagggctgttgaagccttcggagaccctgtccctcacgtgcgctgtctctggtggttcttcagtggtactactggagctggatccgccagtccccagggaagggctggagtggattggggaaatcaatcatagtagaagcaaccaacctaccaaacccgtccctacgagacgccgacgtcaaccatcgtacagtacgacacgtaccaaagaccagttctacccgtgacgggtgacgctacgtgtacgacccgccggcggacacgggtctgtacgttacttcgtcgtgcgagaggtacttaagtttttcgggacttcgtactactttccctcctttgaccgttcgtacggggcctaacggggtaaccctaggtccgaccgttccg

SEQ ID NO: 298728 - DNA, 620 bp, Homo sapiens
  misc_feature: GZ8MTXP02GJ5LV.13.36.D03.1.454.CMB.2.raw
  modified_base (466)..(466): a, c, t, g, unknown or other
  misc_feature (466)..(466): n is a, c, g, or t
  modified_base (611)..(611): a, c, t, g, unknown or other
  misc_feature (611)..(611): n is a, c, g, or t
tcagtcacgtactacacgaccggtgctcgatttagctgcgtcacgatctctcttggggtcacatgggaagtgctttctgagagtcatggacctcctgcacaagaacatgaaacacctgtggttctgcctcctcctggtggcagctcccagatgggtcctgtcccaggtgcagctacagcaaatggggcgcgaggggctgttgaacgcctttcggagacccctgtccctcgacgtgcgctgtctcgtggttgggttcttcgagttggttactacgtggagctggactccgccgacgtccccggaaggggaacgggtcgtaggaggtggtaagttaggggaaaactcaaagtcgtaagtagtaggaaacgccgaaccaaccctaaccgaaccccgtccctacgagacgaccgacgtcacctatcgtacagtacgacacgtacaaacgacctagtctcccgtagaggtnacgtctcgtgtacgacccgccggacggtacgaccgggtctacgtcgttaccgttgtggtcggacgtaggacggtacttaagttttcggacttcgtactcttcgttccttgtacttcggtcggtaccgacggtaaccctggtaccncgtttaccg

SEQ ID NO: 298729 - DNA, 769 bp, Homo sapiens
  misc_feature: GZ8MTXP02JQS9Y.13.36.D03.1.454.CMB.2.raw
  modified_base (288)..(288): a, c, t, g, unknown or other
  misc_feature (288)..(288): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctggtagggggaaacaacattggaaagtaaaagtgtgcactggtaccagcagaagcaggccaggcccctgngctggtcgtctatgttgatacgcgaccggccctcgagggactcccgtgacgcgatttccgtcggggctacccgaacttccgaggggaaccaccggggccctaaccgttccgtacggaacccattacccgaaaggttacggggttaccggaaaacgggcccgggggtaatcgggaaacgggacccggaaacgttaacgtttaaccgtggtaccgtaaagggggttggttagggggaattaagggttaacggtcgggttacggaagtacgtaagttggggtacgggtttaaggtttccgggggacggggttaaacggggaaaaccccgtaaaaaccggttcgggtaaacccccggttacccggttaaacggggttacccgaaaccgggtaccccccgaaaagggggtttcccccgtcccccgggttaccccccggttaccggggtaccctaccccggtttcccgtttaccccgttaccccccg

SEQ ID NO: 298730 - DNA, 637 bp, Homo sapiens
  misc_feature: GZ8MTXP02HDZLY.13.36.D03.1.454.CMB.2.raw
  modified_base (309)..(309): a, c, t, g, unknown or other
  misc_feature (309)..(309): n is a, c, g, or t
  modified_base (373)..(373): a, c, t, g, unknown or other
  misc_feature (373)..(373): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtcggccccaggacagacggccaggattaccgtggtagggggaaacaacgattaggaaagtaaagtgtgcacgtggaccagcagaagccaggccacggcccctgtgctggtctctagtgtnatcgcgaccggccctcgaggactccgtgacgcgacttcgcgggctccgaactcgtacgggaccncggccacgtctacgaccatccgaggtacgggtcgaacggccgggggatggaggcgtagaacttagttaccgtggtacgacgggtcggtaggggaccaggccgagccgacgtccggcccgtatacgttcgtacggtccggtaaacgttcggggaacccgtaagggtaccctaacccggttacccgtaaacggtccaaaccgggaacccgaaaacccggggaccccctaaaccccggtacttaccggtacccgtaacctttccccg

SEQ ID NO: 298731 - DNA, 584 bp, Homo sapiens
  misc_feature: GZ8MTXP02J5E0Q.13.36.D03.1.454.CMB.2.raw
  modified_base (219)..(219): a, c, t, g, unknown or other
  misc_feature (219)..(219): n is a, c, g, or t
  modified_base (372)..(372): a, c, t, g, unknown or other
  misc_feature (372)..(372): n is a, c, g, or t
  modified_base (416)..(416): a, c, t, g, unknown or other
  misc_feature (416)..(416): n is a, c, g, or t
  modified_base (471)..(471): a, c, t, g, unknown or other
  misc_feature (471)..(471): n is a, c, g, or t
  modified_base (473)..(473): a, c, t, g, unknown or other
  misc_feature (473)..(473): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattaccngtaggggaaacaacattggaagtaaagtgtgcactggtaccagcagaagccaggccaggcccctgtgctggtcgtctatgttgatagcgaccggccctcagggtactccctgagcgtactctcgggctaccgaactcgtggggacacggcccnctctgaccatcgacgtaggttaccggaaggacccgggtaggganacggggacggtcctaacttatacgttggaggtaggtgggtagtagtacgtggtgngngagtagtggtggttacggtacgggacgggacggaacgacgtaccgtaccgtaccgtacgtacgaccgaccgaaccgccgtcccgtcccgtccgtccgttccttccttcccg

SEQ ID NO: 298732 - DNA, 644 bp, Homo sapiens
  misc_feature: GZ8MTXP02F1RNA.13.36.D03.1.454.CMB.2.raw
  modified_base (375)..(375): a, c, t, g, unknown or other
  misc_feature (375)..(375): n is a, c, g, or t
tcagtcacgtactacacgaccggtgctcgatttagctgcgtcacgatctctcttggggagtctgggcctaaggaagcagcactggtggtgcccagccatggcctggaccgttctcctcctcggcctcctctctcactgcacaggctctgtgacctcctatgtgctgactcagccaccctcggtgtcagtcggccccaggacagacggccaggattacctggtagggggaaacaacattaggaaagtaaaagtgtgcactggtaccagcagaagccaggccaggcccctgcgctggtcgtctatgtgatagcgaccggcctcgagggactcccgtgagcgtattcccgtcgggcctaccgaactcgtacgggaacnccggccactcgtacgaccatacgagggtacgggtacgaaacggcccggggatcggacggaccgtaattacgttacgtgtacgagggttggtaggaattaggtgtacgtaggagcgtagtggtaggtacgtcggggacggacggggaacctaacgtcggacccgttaccgtaacgggtccgaaccggacccgaacggtcccgtcccggtcccccccgttaccgggtacccgtaacccttcccgtttcccggttaccccctttaacccccg

SEQ ID NO: 298733 - DNA, 629 bp, Homo sapiens
  misc_feature: GZ8MTXP02ID8SW.13.36.D03.1.454.CMB.2.raw
  modified_base (269)..(269): a, c, t, g, unknown or other
  misc_feature (269)..(269): n is a, c, g, or t
  modified_base (294)..(294): a, c, t, g, unknown or other
  misc_feature (294)..(294): n is a, c, g, or t
  modified_base (515)..(515): a, c, t, g, unknown or other
  misc_feature (515)..(515): n is a, c, g, or t
  modified_base (608)..(608): a, c, t, g, unknown or other
  misc_feature (608)..(608): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagcccaccctcggtgtcagtcggccccaggacagacgccaggacttacctggtagggggaaacaacagttaggaaagtaaagtgtagcacgtggtacngcaagagccaggccacggcccctgngcgtggtcgtctatgtgatagcgaccgccctcgagggactccgtgacgcgtattccgtccgggctaccgaactcggacgggactaccgggccacctctcgaaccctataccgaggttacggggacgaaagggcccgggggaatcgggacggtaccgtaacttaacgttaccgtggttacgaggggttggttaggggtaattagggttagtcgggtagacgntaggttggtgggttagtcggggacgggaacggaactaaacgtcggtactaccggagtacgacgtcccgaaggccgtccgtccccgtaggtccnccgttccttccgttacccccc

SEQ ID NO: 298734 - DNA, 635 bp, Homo sapiens
  misc_feature: GZ8MTXP02J0P35.13.36.D03.1.454.CMB.2.raw
  modified_base (189)..(189): a, c, t, g, unknown or other
  misc_feature (189)..(189): n is a, c, g, or t
  modified_base (224)..(224): a, c, t, g, unknown or other
  misc_feature (224)..(224): n is a, c, g, or t
  modified_base (375)..(375): a, c, t, g, unknown or other
  misc_feature (375)..(375): n is a, c, g, or t
  modified_base (494)..(494): a, c, t, g, unknown or other
  misc_feature (494)..(494): n is a, c, g, or t
tcagtcacgtactacacgaccggtgctcgatttagctgcgtcacgatctctcttggggtcacatgggaagtgctttctgagagtcatggacctcctgcacaagaacatgaaacacctgtggttctgcctcctcctggtggcagctcccagatgggtcctgtcccaggtgcagctacagcaagtggggcncagggctgttgaagccttcggagaccctgtccctnacgtgcgctgtctctgggtggttcttcgagtggttactacgtggagctggactccgccagtccccgagggagggctggagtggagttaggggaaatcaatcagtagtaggaagcaccaacctaccgaacccgtcccgtacgacgacgccgngtccaaccagtgtacaagtacgaccaacgtcccaaaagacctacgttcctcccgtaggacgggtgagcttcgtgtcgacccgccggtacggacgacgggtctggttcgttaccgtttcncggtcgacggtaaggacgggtactttaaggtttttcgggaaccttcggttacctactttcccgttacccgtttaggtacccgtttcggtcgggggtacccgtacggggtaaccccgttacggtcccgtacccggtttccgg

SEQ ID NO: 298735 - DNA, 566 bp, Homo sapiens
  misc_feature: GZ8MTXP02GZ6HU.13.36.D03.1.454.CMB.2.raw
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctggtagggggaaacaacattggaaagtaaaagtgtgcactggtaccagcagaagccaggccaggcccctgtgctggtcgtctatgttgatagcgaccggccctcgagggactccctgacgcgacttcgcgggctccgaactcgtagggacaccggccactctacgaccatccagtagggtcgaaggccggggagtgaggccgactagtactgtcgaggtgtagggagtagtagtcgtgagcagtgtggttagtcgggacggacgggaaccaaacgtcgaccggtcgtacggtccgacgacccgaaggccgtcgcccccgtcggtcctaccgtccgtccgttacccccg

SEQ ID NO: 298736 - DNA, 629 bp, Homo sapiens
  misc_feature: GZ8MTXP02I6IK0.13.36.D03.1.454.CMB.2.raw
  modified_base (381)..(381): a, c, t, g, unknown or other
  misc_feature (381)..(381): n is a, c, g, or t
  modified_base (447)..(447): a, c, t, g, unknown or other
  misc_feature (447)..(447): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggacttaccgtggtagggggaaacaacgagttaggaaagtaaaaggtgtagcaacgtggtaccagcaagaagccaggccacggcccctgtcgctggtcgtctagtgtgatagccgaccggccctgagggactccgtgacgcgattccgcgggctaccactcgtagggaccncggccactccgtagaccatcgaagtagggtacgaaggccggggatggacggccgtaactattacgnggtacgtagggtgtagggtattaggtaggtcgtagagtcgtagtggttagggtagttcggggaacgggaacgggtaaccgaaaacgtccggaccggttaccgtaacggtccgaaaccggtcccgaaacggccgtcccgtacccccggttcggtacctaccgttcccgttcccgtttaccccc

SEQ ID NO: 298737 - DNA, 543 bp, Homo sapiens
  misc_feature: GZ8MTXP02FHQV8.13.36.D03.1.454.CMB.2.raw
  modified_base (421)..(421): a, c, t, g, unknown or other
  misc_feature (421)..(421): n is a, c, g, or t
  modified_base (432)..(432): a, c, t, g, unknown or other
  misc_feature (432)..(432): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctgtgggggaaacaacattggaagtaaaagtgtgcactggtaccagcagaagccaggcccaggcccctgtgctggtcgtctatgttgatagcgaccggccctcaggggatccctgagcgacttctccggggctccaactcgtggggaccacgggccactctgacatcagtagggtcgaagccggggatgaggccgatattacgngtacgaggtgnggggatagtagtcggtgagcagtgtggtattcgggcgtagggaccaaaacgtgaccgtcgtaggtcacgcccaaggcctcggccccctcggtccacgtctcgtttaccccc

SEQ ID NO: 298738 - DNA, 619 bp, Homo sapiens
  misc_feature: GZ8MTXP02GXIJ4.13.36.D03.1.454.CMB.2.raw
  modified_base (190)..(190): a, c, t, g, unknown or other
  misc_feature (190)..(190): n is a, c, g, or t
  modified_base (272)..(272): a, c, t, g, unknown or other
  misc_feature (272)..(272): n is a, c, g, or t
  modified_base (503)..(503): a, c, t, g, unknown or other
  misc_feature (503)..(503): n is a, c, g, or t
tcagtcacgtactacacgaccggtgctcgatttagctgcgtcacgatctctcttggggtcacatgggaagtgcttttctgagagtcatggacctcctgcacaagaacatgaaacacctgtggttctgcctcctcctggtggcagctcccagatgggtcctgtcccaggtgcagctacagcaagtggggcncgagggctgttgaagccttcggacgaccctgtcccctcacgtgccgctgtctcgtggtggttcttcagtggttactactggngctggatccgccacgtccccgaggggaagggctggagtggagttaggggaaatcaagtcaagtaggtaggaagccaaccgtaacctacccaacccgtcccgtcgaagacgccgagtccaaccagtcgtacaagtacgaccacgtaccaaacgaacctacgttcctcccgtaggacgggtgacgtctcgttgacggacccgccgacggacacgggtctagttcgtaccgttnggttacgcggtagagtacgttaaattttcggggaacttcgttactactttccttacccgtttgaccgtttcggtacgggtaccgtacgggtaccctacggtccgtaccgtttcccg

SEQ ID NO: 298739 - DNA, 512 bp, Homo sapiens
  misc_feature: GZ8MTXP02I5WQ0.13.36.D03.1.454.CMB.2.raw
  modified_base (319)..(319): a, c, t, g, unknown or other
  misc_feature (319)..(319): n is a, c, g, or t
  modified_base (341)..(341): a, c, t, g, unknown or other
  misc_feature (341)..(341): n is a, c, g, or t
  modified_base (361)..(361): a, c, t, g, unknown or other
  misc_feature (361)..(361): n is a, c, g, or t
  modified_base (375)..(375): a, c, t, g, unknown or other
  misc_feature (375)..(375): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctggtagggggaaacaacattggaaagtaaagtgtgcactggtaccagcagaagccaggccaggcccctgtgctggtctctatgttgatagcgacggccctnagggactccctgagcgattccncgggctccaactctgggacncgggcactctgacntcagtaggtcgagcgggatgaggccgatatactgtcaggtgtggatagtagtcgtgagcagtgtggtattcgggcgtagggaccaaagtgaccgtcaggtcacgccaaggctcgcccctaggcactctcgttccccc

SEQ ID NO: 298740 - DNA, 631 bp, Homo sapiens
  misc_feature: GZ8MTXP02GSIIB.13.36.D03.1.454.CMB.2.raw
  modified_base (189)..(189): a, c, t, g, unknown or other
  misc_feature (189)..(189): n is a, c, g, or t
  modified_base (273)..(273): a, c, t, g, unknown or other
  misc_feature (273)..(273): n is a, c, g, or t
tcagtcacgtactacacgaccggtgctcgatttagctgcgtcacgatctctcttggggtcacatgggaagtgctttctgagagtcatggacctcctgcacaagaacatgaaacacctgtggttctgcctcctcctggtggcagctcccagatgggtcctgtcccaggtgcagctacagcaagtggggcncgagggctgttgaagccttcggacgaccctgtccctcacgtgcgctgtctcgtgggtggttcttcgagtggttactacgtggancgtggactccgccacgtccccgagggaggctggagtggagtaggggaaatcaagtcaagtagtaggaagccaaccaaccttaccgaaacccctccgtacgacgacgccgagtccaccatcgtcaagtacacacgtaccaaagaaccctattacctcccgtagacgggtcaagtctcgtgtaccgacccggccggacggacacggtcgtgtacgttacgttcgtgtcgacggaaggtacgtacgttaaacgtttttcggaaacgttccgtacttacgtttacccttcccgttacgttaccgttaacggtcggggtaccgtaaacggggtacccctaacggtcccgtaacccgtttcccg

SEQ ID NO: 298741 - DNA, 696 bp, Homo sapiens
  misc_feature: GZ8MTXP02II11O.13.36.D03.1.454.CMB.2.raw
tcagtcacgtactacacgaccggtgctcgatttagctgcgtcacgatctctcttggggtcacatgggaagtgctttctgagagtcatggacctcctgcacaagaacatgaaacacctgtggttctgcctcctcctggtggcagctcccagatgggtcctgtcccaggtgcagctacagcaagtggggcgcaggggctgttgaagtccttcggacgaccctgtccctcacgtgcgtctgtctcgtggtggttcttcgagttggttactactggagctggatccgccagtccccgagggagggcgtggagtggagtggggaaatcgaatcgaagtagtaggaagacaccaacctaaccgaaccccgtccctcgaagacgccgagtccaacctatcgtacagtaacaccacgtaccaaacgtaaccacgttcctacccgtaggacgggtacgagtccgtacgtcgtacggaccccggtccggaccgggtaaccgtcccgggtacgttacgtacggtttaaccgtttcgttaggttacggacccggtaagggtaacgggttaccgtttaaaagtttttcgggtaaaccgtttccggttactaacggttttccctttaacccgttttcgtaccgtttcggttacgggggtacccgtaaccggggtaaaccccgtttcggttacccgtaaccggtttcccgg

SEQ ID NO: 298742 - DNA, 543 bp, Homo sapiens
  misc_feature: GZ8MTXP02H09IJ.13.36.D03.1.454.CMB.2.raw
  modified_base (290)..(290): a, c, t, g, unknown or other
  misc_feature (290)..(290): n is a, c, g, or t
  modified_base (333)..(333): a, c, t, g, unknown or other
  misc_feature (333)..(333): n is a, c, g, or t
  modified_base (368)..(368): a, c, t, g, unknown or other
  misc_feature (368)..(368): n is a, c, g, or t
  modified_base (379)..(379): a, c, t, g, unknown or other
  misc_feature (379)..(379): n is a, c, g, or t
  modified_base (450)..(450): a, c, t, g, unknown or other
  misc_feature (450)..(450): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtcggccccaggacagacggccaggattacctggtaggggaaacaacattaggaagtaaaagtgtagcactggtaccagcagaagccaggccaggcccctgngctggtcgtctatgttgatagcgaccggccctgaggactccgngacgcgtacttcgtccggctaccaactcgaggacnccggcaccttnacgaccatacagtaggcgaagccggggatgagccgatatactgtgaggttgtaggattagacgtgagagangtgtgtagtaggacggacggacgaacgacgaccgtacgtacgtacgacgaccgacgcgtccgtcccgtccgtccgtacctccgtcccgtcccg

SEQ ID NO: 298743 - DNA, 773 bp, Homo sapiens
  misc_feature: GZ8MTXP02GN5TJ.13.36.D03.1.454.CMB.2.raw
tcagtcacgtactacacgaccggtgctcgatttagctgcgtcacgatctctcttggggtcacatgggaagtgctttctgagagtcatggacctcctgcacaagaacatgaaacacctgtggttctgcctcctcctggtgcagctcccagatgggtcctgtcccaggtgcagctacagcaagtggggcgcgaggggctggttgaacgtccgttcgggacgtaccccttggtcccctcgacgtgcgcttgtcctcgtgggttcggttcttcgtaggttggttactacgtggacgtcgtggactccgcctacggtccccgaggggagggcgtaggaggtggtagtaggggaatactaatcgaagttaggtaggaaacgaccaacctaaaccccgtaaccgtaacccccgtccctacggaacgaaccggacccgacggtaccaacccgtaagttacggtactaaacgggtaacgaacccgaaacgtaacccgaaaaccgtaacccgtaacgtttccgtaaccccgtagggtacggggtacgaacggtcttccgtacggtaccggaccccggaccgggaccgggtaaccgacgggtacttcggtacgttaccgtttcggttcggtacggacggaagtacggttacgtttaaagtttttaccggggacgtttaccttacggttaacgttttccctttaacccgttttgtaaccgtttccggggtaacggggtaccgttaaaaccggggtcccttacggtacccgttaccggtttcccgg

SEQ ID NO: 298744 - DNA, 591 bp, Homo sapiens
  misc_feature: GZ8MTXP02I5T5U.13.36.D03.1.454.CMB.2.raw
  modified_base (372)..(372): a, c, t, g, unknown or other
  misc_feature (372)..(372): n is a, c, g, or t
  modified_base (472)..(472): a, c, t, g, unknown or other
  misc_feature (472)..(472): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctggtgggggaaacaacattaggaagtaaaagtgtgcactggtaccagcagaagccaggccaggcccctgtcgctggtcgtctatgtgatagcgaccggccctcagggactcccgtgacgcgacttcgtaccgggctaccaactcgtagggaccnccgggaccactcctagaccatcgaagtagggtccgaagggccggggatggaggccgacttagttactgtcaagggtgtaggggataggtagtcggtgagnaggttgttggtagttcggggacggacgggaaaccgtaacgtcgacccgttcgtaaacggtcgaacgacccgaaggtccgtacccgcccgtcggacctaccgttccgttccgttcccccg

SEQ ID NO: 298745 - DNA, 628 bp, Homo sapiens
  misc_feature: GZ8MTXP02JUDGQ.13.36.D03.1.454.CMB.2.raw
  modified_base (189)..(189): a, c, t, g, unknown or other
  misc_feature (189)..(189): n is a, c, g, or t
  modified_base (513)..(513): a, c, t, g, unknown or other
  misc_feature (513)..(513): n is a, c, g, or t
tcagtcacgtactacacgaccggtgctcgatttagctgcgtcacgatctctcttggggtcacatgggaagtgctttctgagagtcatggacctcctgcacaagaacatgaaacacctgtggttctgcctcctcctggtggcagctcccagatgggtcctgtcccaggtgcagctacagcaagtggggcncgagggctgttgaagtccgttcggacgaccctcgtccctcacgtgcgctgtctcgtggtggttctcgaggttcggttactacgtggagctggactccgccgagtccccgagggagggcgtggaggtggtagtagggtaatacatatagtagtaggagacaccaaccctaccaacccgtccgtacgacgacgaccgacgtacacgatcgcaagtacgacaccgtacgaaacgtaccgaacgttcctcccgtagagggtacgtcgtacgtcgtagtcggacccggtcgaccggacgacggtcgtggttagtacccttggtcgtggnggacgtagcctttaaggtttcgacgtcgtcttacgtttccttacccgtttagttaccgtttccggggtacgggtacccgtacggggttacccctacggtaccgtaccggtttccg

SEQ ID NO: 298746 - DNA, 630 bp, Homo sapiens
  misc_feature: GZ8MTXP02HFD7F.13.36.D03.1.454.CMB.2.raw
  modified_base (213)..(213): a, c, t, g, unknown or other
  misc_feature (213)..(213): n is a, c, g, or t
  modified_base (413)..(413): a, c, t, g, unknown or other
  misc_feature (413)..(413): n is a, c, g, or t
tcagtcacgtactacacgaccggtgctcgatttagctgcgtcacgatctctcttggggagcttcagctgtggtagagaagacaggattcaggacaatctccagcatggccggcttccctctcctcctcaccctcctcactcactgtgcagggtcctgggcccagtctgtgctgactcagcccaccctcagccgtcgtcggggaccccccgggnagagtgtccaccatctcttgttctggaggcagtgccaacatcgggaatattatgcattctagtatcaacaactcccaggaaccggcccccagacctcctcatctaatagacaaactaaaccaggccggtaccctccgaaccggggtccctacggaccgtatttccgcgtcgggccttaccaagtcctacggcaacccttnacgccctcccgtcggccagtcgaggtgggcccttccgggtcgacgactgggacgtctagtattacttacgtgttccagtcgtttagggattcggactagccgtaaggtaaacgtttcgggtttcggggtttacggacggggtaacgggtaacctaacggttaccgaaccccggtccgttaacggtccgaacccggacccgaacggttccgtcccccg

SEQ ID NO: 298747 - DNA, 602 bp, Homo sapiens
  misc_feature: GZ8MTXP02GFIJY.13.36.D03.1.454.CMB.2.raw
  modified_base (509)..(509): a, c, t, g, unknown or other
  misc_feature (509)..(509): n is a, c, g, or t
  modified_base (519)..(519): a, c, t, g, unknown or other
  misc_feature (519)..(519): n is a, c, g, or t
tcagtcacgtactacacgaccggtgctcgatttagctgcgtcacgatctctcttggggtcacatgggaagtgctttctgagagtcatggacctcctgcacaagaacatgaaacacctgtggttctgcctcctcctggtggcagctcccagatgggtcctgtcccaggtgcagctacagcaagtggggcgcgagggctgttgaagccttcggagaccctgtccctcgacgtgcgctgtctcgtggttgggttcttctaggttggttactacgtggagcgtggactcccgccgacggtccccgaggggaacgggcgtggagtggagttaggggaatcgaatcagtagtaggaagaccaaccaacctaccaaccccgtcctacgagacgccgagtccacctatcgtcaagtacgacctacgtaccaaagaaccctacgttccctcccgtaggacgggttgaacgtcgtcgtcgtcggacccgccggacggacgacggtctgtcgtacttcgnggtgcggagngtacttaagttttcgacttcgtctacttccttaccgttgtacttcggtcgggacctacgggtaccctacggtcctacgttccg

SEQ ID NO: 298748 - DNA, 664 bp, Homo sapiens
  misc_feature: GZ8MTXP02IA7VG.13.36.D03.1.454.CMB.2.raw
  modified_base (188)..(188): a, c, t, g, unknown or other
  misc_feature (188)..(188): n is a, c, g, or t
  modified_base (227)..(227): a, c, t, g, unknown or other
  misc_feature (227)..(227): n is a, c, g, or t
  modified_base (310)..(310): a, c, t, g, unknown or other
  misc_feature (310)..(310): n is a, c, g, or t
  modified_base (442)..(442): a, c, t, g, unknown or other
  misc_feature (442)..(442): n is a, c, g, or t
tcagtcacgtactacacgaccggtgctcgatttagctgcgtcacgatctctcttggggtcacatgggaagtgctttctgagagtcatggacctcctgcacaagaacatgaaacacctgtggttctgcctcctctggtggcagctcccagatgggtcctgtcccaggtgcagctacagcaagtggggcncgagggcttgttgaagccttcggacgaccctgtcccctnacgtgcgtctgtctcgtgggtcggttctcgaggttgttacacgtggagcgtggactccgccgacgtccccgaggggagggcgnggagtggagttagggaaaatcgaatcgagtaggtagaacgccaacaaaccctaacccgaaccccgtcctagacgacgccgagtaccaacatcgtacaggtaacaccaacgtaccaaacgaacctagttcccncccgttaggaccgggtagacgtaccgtcgtacgtaccggacccgaccggaccggtaaccgtaccggtccgttgttacgttaccgttcgttcggtacggaccgtaagggtacgtaaaccgtttagtttttacggaccgttacgttacgtacctttccgttacccgtttgtaccgttcggtccggaccgtaacggtaacccgttcgtaccgttaaccgtcccgg

SEQ ID NO: 298749 - DNA, 614 bp, Homo sapiens
  misc_feature: GZ8MTXP02JWOWG.13.36.D03.1.454.CMB.2.raw
  modified_base (267)..(267): a, c, t, g, unknown or other
  misc_feature (267)..(267): n is a, c, g, or t
tcagtcacgtactacacgaccggtgctcgatttagctgcgtcacgatctctcttggggtcacatgggaagtgctttctgagagtcatggacctcctgcacaagaacatgaaacacctgtggttctgcctcctcctggtggcagctcccagatgggtcctgtcccaggtgcagctacagcaatggggcgcagggctgttgaagccttcggagacccctgtcccctcacgtgcgctgtctctggtggttctcagtggttactactgganctggatccgccagtccccgaggggaaggctggagtggagttaggggaaatcgaaatcatagtgaagcaaccgaacctaccaacccgtccacgagacgccgagtccaacctagtcgtacaggtaacaccaacgtaccaaaaggaaccctagtttaccctccgtaggagggtacgacgtctcgtgacggacccgccggacggacgtacggcgtgttacgttacttcgtggtcggacgtagtacggtactttaaacggttttcggacttcgtacttacgtttcccgttccgtttacgtaccgttccggcgggtaacccgtaacgggtaaccctacgtacccgtaccgtcg

SEQ ID NO: 298750 - DNA, 680 bp, Homo sapiens
  misc_feature: GZ8MTXP02HRV1S.13.36.D03.1.454.CMB.2.raw
  modified_base (187)..(187): a, c, t, g, unknown or other
  misc_feature (187)..(187): n is a, c, g, or t
  modified_base (208)..(208): a, c, t, g, unknown or other
  misc_feature (208)..(208): n is a, c, g, or t
  modified_base (224)..(224): a, c, t, g, unknown or other
  misc_feature (224)..(224): n is a, c, g, or t
  modified_base (247)..(247): a, c, t, g, unknown or other
  misc_feature (247)..(247): n is a, c, g, or t
  modified_base (264)..(264): a, c, t, g, unknown or other
  misc_feature (264)..(264): n is a, c, g, or t
  modified_base (310)..(310): a, c, t, g, unknown or other
  misc_feature (310)..(310): n is a, c, g, or t
tcagtcacgtactacacgaccggtgctcgatttagctgcgtcacgatctctcttggggagcttcagctgtggtagagaagacaggattcaggacaatctccagcatggccggcttccctctcctcctcaccctcctcactcactgtgcagggtcctgggcccagtctgtgctgactcagccaccctnagcgtctcggggacccccggnagagtgtcaccatctnttgtctggaggcagtgaccaacntcgggagtaattatgcntttctggtatacaacaactccccgacggaccgccccagacctcctnactctatacgactaaactaaccgacggccggtcccctaccggaccggggttccccctggaaccgttatttcctacgtcggcctaccgtaacgttcgtacgggaccctacctccgaccgttcccctacccgtcggtacccagtccgtacgggtcggggtacccttcccggggaccgacgtacgtgggacgtcgtaggttactttagttaccgttggtacgacggttcggttagggattacgggactacgtccgttagtaaacggtttcgggttttacggggtttcgggacggggtaccgggtaccgttaaggttcccgaacccggttcccgaacggtcccgacggtaccccgacggtccctttcccccggg

SEQ ID NO: 298751 - DNA, 628 bp, Homo sapiens
  misc_feature: GZ8MTXP02FJXKD.13.36.D03.1.454.CMB.2.raw
  modified_base (307)..(307): a, c, t, g, unknown or other
  misc_feature (307)..(307): n is a, c, g, or t
  modified_base (431)..(431): a, c, t, g, unknown or other
  misc_feature (431)..(431): n is a, c, g, or t
tcagtcacgtactacacgaccggtgctcgatttagctgcgtcacgatctctcttggggagcttcagctgtggtagagaagacaggattcaggacaatctccagcatggccggcttccctctcctcctcaccctcctcactcactgtgcagggtcctgggcccagtctgtgctgactcagcccaccctcagcgtctcgggacccccgggcagagtgtcaccatctcttgttctggaggcagtgccaacagtcgggagtaattatgcattctggtatcaacactcccaggaccggcccccagacctccncatctatagcaaataaccagccggccctccgacggggtcccctgaccgtattcctctcggcctccaagtctcggcacctcacgccctcccgtcgcccatcgagcgggcctcccgggtccgacgntggagctagatttattacgtgttacagtcgttgggatgacgacgccgttagtaacgtttacggtttacgggggttttccgggacggggtaacgggtaacccgttaaacgggtttaccggaaccccgggttaccccgttaaacggggttaccccgaaccggtacccccggtaaaacggggtccccgtttacccccggg

SEQ ID NO: 298752 - DNA, 694 bp, Homo sapiens
  misc_feature: GZ8MTXP02GPV4C.13.36.D03.1.454.CMB.2.raw
  modified_base (290)..(290): a, c, t, g, unknown or other
  misc_feature (290)..(290): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagcccaccctcggtgtcagtcggccccaggacagacggccaggatacctggtaggggaaacaacattaggaaagtaaagtgtgacactggtacagcagaagcaggccaggcccctgtcnctggtctctatgttgatagcgaccggccctgagggactccctgacgcgtacttcgtccgggctaccaacgtccgtaggggaccacgggccaacgtcctacgacccagtacgtaacgggtacgggtacggaacgggacccgggggatacgggacgggaccccgtaacgttaacgtttaccgtagtaccgtaagggttggtaggggtaagttacggtaaggttcggtaggaacgtcgaaggttggtggggttaacgttccgggggacgggaacgggtaaacccgtaaaacgtcgggtaaccccggttaccgtaacggggtccgaaccggacccccgaacgggtcccgtaacccggtaccccccgttaccgggtcctaacccgttccgttaccccgtttccccccgg

SEQ ID NO: 298753 - DNA, 669 bp, Homo sapiens
  misc_feature: GZ8MTXP02HI2W3.13.36.D03.1.454.CMB.2.raw
  modified_base (225)..(225): a, c, t, g, unknown or other
  misc_feature (225)..(225): n is a, c, g, or t
  modified_base (339)..(339): a, c, t, g, unknown or other
  misc_feature (339)..(339): n is a, c, g, or t
tcagtcacgtactacacgaccggtgctcgatttagctgcgtcacgatctctcttggggtcacatgggaagtgctttctgagagtcatggacctcctgcacaagaacatgaaacacctgtggttctgcctcctcctggtggcagctcccagatgggtcctgtcccaggtgcagctacagcaagtgggcgcgagggctgttgaagccttcggagtaccctgtccctnacgtgcgctgtctcgtggtggttctcagtgtactacgtggacgcgtggactccgcacgtccccgagggacgggcgtggagtggagtaggggaatcgaagtcgagtaggtaggancgaaccaaccctaccacccgtccctagacgacgaccgagccaacatcgacagtacgacgacgtaccgaaacgacctacgttacctcccgtaggtacgggtgtacgtccgttcttaggccgggacccgtccgggccggtaccgacgggtccgtaggttacgttccgttagtggtcgaccggtaaggcggttactttaacgggttttacggaacgttccggttaccttaacgtttcccgtttcccgtttacggttaaccgttccgggttaccgggggtaccggtaaccggggttaaccccttacggttacccggttacccggtttccccggg

SEQ ID NO: 298754 - DNA, 570 bp, Homo sapiens
  misc_feature: GZ8MTXP02FH1ZU.13.36.D03.1.454.CMB.2.raw
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctggtagggggaaacaacattggaagtaaaagtgtgcactggtaccagcagaagccaggcccaggcccctgtgctggtcgtctatgttgatagccgaccggccctcgaggggactccccgtgacgcgacttcgcgggctccaactcgtgggaccacggccactctgaccatcagtagggtcgaaacggccgggggaatggaggcccgaacttacgttacctgttcgaggtggtgggtataggtagtcggtgagcagtgtggtagttcgggacggagggaccaaaacgtcgaaccgtccgtaggtccacgccccaaggcctcgccccccgtcggtccacgtcctcgttcccccg

SEQ ID NO: 298755 - DNA, 567 bp, Homo sapiens
  misc_feature: GZ8MTXP02I7NOU.13.36.D03.1.454.CMB.2.raw
  modified_base (280)..(280): a, c, t, g, unknown or other
  misc_feature (280)..(280): n is a, c, g, or t
  modified_base (351)..(351): a, c, t, g, unknown or other
  misc_feature (351)..(351): n is a, c, g, or t
  modified_base (464)..(464): a, c, t, g, unknown or other
  misc_feature (464)..(464): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtgccccaggaccagacgccaggattacctgtggggaaacaacattaggaataaaagtgtgcatgtaccagcagagccaggcaggcccctgngctggtctctatgttagatagcgaccggccctgaggactcccgtgagcgattcgccggctccgaacttccngggacctcggcccactcctgaccatccaggtaggtacgaaacggccggggaatcggaaggcccgtaactattacgtgtcgtaagggtgtagggtactaggtaccgtgtagagngagtgtgtgtcggacggacggaacgaacgtacgtaccgtaccgtacgtacgacgaccgacggccgtccgtccccgtccgtaccgtaccgtccgtccgtccccg

SEQ ID NO: 298756 - DNA, 759 bp, Homo sapiens
  misc_feature: GZ8MTXP02F05DY.13.36.D03.1.454.CMB.2.raw
  modified_base (211)..(211): a, c, t, g, unknown or other
  misc_feature (211)..(211): n is a, c, g, or t
  modified_base (267)..(267): a, c, t, g, unknown or other
  misc_feature (267)..(267): n is a, c, g, or t
tcagtcacgtactacacgaccggtgctcgatttagctgcgtcacgatctctcttggggagcttcagctgtggtagagaagacaggattcaggacaatctccagcatggccggcttccctctcctcctcaccctcctcactcactgtgcagggtcctgggcccagtctgtgctgactcagcccaccctcagcgtcgtcggggacccccgggnagagtgtcaccatctcttgttctggaggcagtgaccaagagtcgggaagtaattancgctaatttcgtaggtaactaccaaaccaacctccccgaaacgggaaaccccggcccccccaaggtacccttcccctctaacttacctaaatacgaacctaaaactaaaaccccgacggaccccgggtaccccctaccgggtaacccggggggttcccccctaggtaaccccgtactttccgtaccgtcgggccctaccgtaaacgtccgtcggacccacccgtcacgtccctcccgtcggacctacgtccgtagggtccgggtaccgttcccgggtaccgaccgtagttacggacgggtccttaggttaatttaacgtttacgttcgttaccgtaggtccgtttaggggaacttggaacgtacggtccttaaggtaaactttacgggttttcggggtttaccggtcggttaggaaccggggtaacccgttaaggttccggaaccccggttccgtaaacggggtccaaccggaccccgtaacgggtcccccg

SEQ ID NO: 298757 - DNA, 588 bp, Homo sapiens
  misc_feature: GZ8MTXP02IAEC4.13.36.D03.1.454.CMB.2.raw
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccacctcggtgtcagtcggccccaggacagacggccaggacttaccgtggtagggggaaacaacgattaggaaagttaaaagtgtagcacgtggtaccagcagaagccaggccacggcccctggtcgcgtggtccgtctatggttagatacgccggaccggccctgagggactcccgtgacgcgtactcgcggctacacgtcgtaggaccacggtcactctcgaccagttacgagttaggacgaaaggccgggatcggacggtccgtatacgttacgtcgtagtagggtggtagggtagttagtacggtcggtagacgtgagttcggtaggtagtcggggacggtaacggaacacgtacgacgtacgtacggcacgtccgaaggccgtcgcccttggacctcgtctccgtccccg

SEQ ID NO: 298758 - DNA, 706 bp, Homo sapiens
  misc_feature: GZ8MTXP02HL1AN.13.36.D03.1.454.CMB.2.raw
  modified_base (587)..(587): a, c, t, g, unknown or other
  misc_feature (587)..(587): n is a, c, g, or t
tcagtcacgtactacacgaccggtgctcgatttagctgcgtcacgatctctcttggggtcacatgggaagtgctttctgagagtcatggacctcctgcacaagaacatgaaacacctgtggttctgcctcctcctggtggcagctccagatgggtcctgtcccaggtgcagctacagcaagtggggcgcgagggctgttgaacgtccgttcggacgacccttcgtccctacgacgtgcgtctgttctcgtgggttcggtttcttcgaggttcggttactacgtggagtcgtggactccgccgacggtccccgaggggacgggcgtggaggtggtaggttaggggaaatactaagtacgagtaggtacggaagaccaaacctaaacccctaacccgtaaccccgtcccgtacggaacgaccgaccgtacgtccaacctagttcgtacgtaacgtacgaacccgaccgtaaccgaaacgtaaccctacggtttccctacccgtaggtacggggtacgtaacgtcctacgtcggtaccggaccccggtaccggaccggtacgaccggtcgttcggttaccgttacttcgnggtcggacggtagtcgtactttacgtttcggtacttcgtacgttactttccgttccgtttacgtcgttaacggtccgggtaccgtaaccggggtaacctcggtaccgttccgttcccgg

SEQ ID NO: 298759 - DNA, 608 bp, Homo sapiens
  misc_feature: GZ8MTXP02H0PCD.13.36.D03.1.454.CMB.2.raw
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtcggccccaggacagacggccaggattacctggtagggggaaacaacattggaaagtaaaagtgtgcactggtaccagcagaagccaggccaggcccctgtcgctggtcgtctatgtgatagcgaccggccctgagggactcccgtgacgcgacttcgcgggctaccaactcgtagggaccacggcctacctctacgaccatccgagtagggtacgaaggccgggatcggacggccgatagttacgtgtcgaggtggtggagttagagtcgtagagcgagttggtggtagttcgggacgggaacggggtaacccaaaacgttcggaacccgttacggtacggtaccgaccggtacccgaagggtcccgtaccggtccccccgttcgggtaccctacccgttccgttccgttccccccgg

SEQ ID NO: 298760 - DNA, 660 bp, Homo sapiens
  misc_feature: GZ8MTXP02IFP20.13.36.D03.1.454.CMB.2.raw
  modified_base (271)..(271): a, c, t, g, unknown or other
  misc_feature (271)..(271): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagcccaccctcggtgtcagtcggccccaggacagacggccaggattaccgtggtaggggaaacaacgtagttaggaaagtaaagtgtagcacgtggaccngacaagaacgccgaggccacggcccctggtcgcgtggtctctatgttagatacggccgaccggccctagacgggtactcccgtgacgtcgtacttcctcgtcggcctaccgaacgttcgtacgggaacctcgaccgtacctacctcgtacgaacccataccgacgggtacccgggacccgaggtaccgtagtggaagtacggacgggtactagtacctttattaccggtggttacgagggtacgggtacggacgaggacgacgccgtacgtcggacccgtatacgtcgttaccgtacggtaaacggtacggaaccgtacggttcccaaccggttaacccgtaacgtaccgacccggtaaccccgaaaccggaccccctaaaccctaccg

SEQ ID NO: 298761 - DNA, 672 bp, Homo sapiens
  misc_feature: GZ8MTXP02HB7H1.13.36.D03.1.454.CMB.2.raw
  modified_base (209)..(209): a, c, t, g, unknown or other
  misc_feature (209)..(209): n is a, c, g, or t
  modified_base (320)..(320): a, c, t, g, unknown or other
  misc_feature (320)..(320): n is a, c, g, or t
  modified_base (560)..(560): a, c, t, g, unknown or other
  misc_feature (560)..(560): n is a, c, g, or t
tcagtcacgtactacacgaccggtgctcgatttagctgcgtcacgatctctcttggggagcttcagctgtggtagagaagacaggattcaggacaatctccagcatggccggcttccctctcctcctcaccctcctcactcactgtgcagggtcctgggcccagtctgtgctgactcagcccaccctcagcgtcgtcgggacccccggnagagtgtccacatcttcttgttctggagcagtcgaccaacagtcggggaagtaattatgctattcgtagtactacaaacacctccgaacggaacccgcccccagacctccncatactatacgacaaactaaccgagccggccctccggtacggggttcccctacgtaccgtactttccgcgttcggtcctaccgtaacgttccgtcggaccacccgttcgacccgtccccttcccgtcggaccctacgtccgtacggtccggggtccccgttcccggggtacccgacgtacgtagggaccggtcgttacggtttatttacgttagttcgttacgacgttcggtagggtacncgtaacgacgtcgttaacgtacgttttacgggtttcggggttacgggacgggtacggaccgtgttcggaacggttacgttcggtacggacgaccgacccggtacgtccccgg

SEQ ID NO: 298762 - DNA, 677 bp, Homo sapiens
  misc_feature: GZ8MTXP02HPH9S.13.36.D03.1.454.CMB.2.raw
tcagtcacgtactacacgaccggtgctcgatttagctgcgtcacgatctctcttggggtcacatgggaagtgctttctgagagtcatggacctcctgcacaagaacatgaaacacctgtggttctgcctcctcctggtggcagctcccagatgggtcctgtcccaggtgcagctacagcaagtggggcgcgaggggctggttgaacgccgtttcgggacgtacccctgtcccctcacgtgcgctgtctcgtggtggttcttcagtgttactacgtggagcgtggactccgccacgtccccgagggacgggcgtggaggtggagttaggggaaatacgaattcgaagtaggtaggaacgtaccgaaccaacccctaacccgaaccccgtccccgtacggacgaccggccgacgtccaacctagtacgtacaacggtaacaaccgaccgttaacccaaacggtaaaccctaacggttcccttacccgttggtaacgggggtactcgtacgtcgtcggtaccggaccccggccggaccgggtaccgaccgggtcgttcgttacgttccgttcgtggtcggcgaggtacgtcgtttaagttttcggtactcgttcttactttccttccgtttcgtactttcggcggtccgtacggtaacccgtcgtaccgtaccgttccgg

SEQ ID NO: 298763 - DNA, 681 bp, Homo sapiens
  misc_feature: GZ8MTXP02GR32Z.13.36.D03.1.454.CMB.2.raw
  modified_base (192)..(192): a, c, t, g, unknown or other
  misc_feature (192)..(192): n is a, c, g, or t
  modified_base (216)..(216): a, c, t, g, unknown or other
  misc_feature (216)..(216): n is a, c, g, or t
  modified_base (557)..(557): a, c, t, g, unknown or other
  misc_feature (557)..(557): n is a, c, g, or t
tcagtcacgtactacacgaccggtgctcgatttagctgcgtcacgatctctcttgggggagcttcagctgtggtagagaagacaggattcaggacaatctccagcatggccggcttccctctcctcctcaccctcctcactcactgtgcgagggtccgtcgggcccagtctgtgctgactcacgcccacctnagccgtcggtccgggacccccggnagagtgtccacctattcttcttgttcgtgggaggctagtcgaccaaagtacgtacggggtaattaattagtcgtactatttccgtaggtaactaaccgtaaaccaacccgttacccggaaaccggaaccccggtacccccacgtacccttccactactactagtacacaaactaacgcggccgccgtccggaccggtcctacgactcttctcgtcgtacctacgtacgtcgtcgacctacctcgaccgtcccttcccgcgacctacgtcgacgggtccggtccgtcccggacggtacgacgtaggtaccgtcgttagttaacttcgttaacgttgtaccgngttacgtgggactcgtacagtcgtaaggtaggtttacggttcggggtacggtacggtaaccggtacgtaaccggtccgaacccgtcgtaacggtcgaaccgtaccgggtacgtccgtcccccgg

SEQ ID NO: 298764 - DNA, 732 bp, Homo sapiens
  misc_feature: GZ8MTXP02G4OZJ.13.36.D03.1.454.CMB.2.raw
tcagtcacgtactacacgaccggtgctcgatttagctgcgtcacgatctctcttgggggtcacatgggaagtgctttctgagagtcatggacctcctgcacaagaacatgaaacacctgtggttctgcctcctcctggtggcagctcccagatgggtcctgtcccaggtgcagctacagcaagtggggcgcgagggctggttgaagtccgttcggacgaccctgtccctcacgtgcgctgtctcgtggtggttctcgagtgttactacgtggagctggactccgacctacggtacccccgagggggaacggggcgtagggacggtgggtacggtaggggaaaatcgaaagtcgaagttaggtaggaaacgaccgtaaccaaaccccgtacccgaacccccgttaccccgtacggaacggtaaccgcccggtacgtacccgaaacctacgttaggtaccaaggttaacgaccgtaaacccgtacccgaaaacggtaacccttaggtttacccgtacccgttaggggtacgggttcggaacgtcccgttcgttacggtaccggacccgggtacccgggaccgggaaccgtaccgggtccttagggtccgttacgttcgtggtacggtcgagggacggtactttaaggttttcgaccttcgtactacctttccgtcctttcggtacttccggtacggggaccgtacgggtaccctacggtaccgtaccgttcccg

SEQ ID NO: 298765 - DNA, 671 bp, Homo sapiens
  misc_feature: GZ8MTXP02ICYBW.13.36.D03.1.454.CMB.2.raw
  modified_base (337)..(337): a, c, t, g, unknown or other
  misc_feature (337)..(337): n is a, c, g, or t
  modified_base (340)..(340): a, c, t, g, unknown or other
  misc_feature (340)..(340): n is a, c, g, or t
  modified_base (368)..(368): a, c, t, g, unknown or other
  misc_feature (368)..(368): n is a, c, g, or t
  modified_base (379)..(379): a, c, t, g, unknown or other
  misc_feature (379)..(379): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtcggccccaggacaggacggccaggacttaccgtggtaggggaaacaacagttaggaaagtaaaagtgtagcactggtaccagcagaaagccaggccaggcccctgtgctggtcgtctatgttgatgcgaccggccctgaggactccngancgacttcgcggctccaactcgaggaccncggccacgtcncgaccagcaggtagggcgaaggccgggggatggacggaccgtacgttaattaccgtggtacgtaggggttggtaggggtatttaagggtacggttcgggtacggacggtacgtaggttggttacggggttaacggtttaccgggggacgggggtaaacggggaaacccaaaacgggttccggtaaccccggttaaccggttacggggtacccgaaccggtacccaaacggggtcccgttaccccggcccccgttacgggtaccacccgtttccgttcccggtttaacccccc

SEQ ID NO: 298766 - DNA, 610 bp, Homo sapiens
  misc_feature: GZ8MTXP02FNS23.13.36.D03.1.454.CMB.2.raw
  modified_base (516)..(516): a, c, t, g, unknown or other
  misc_feature (516)..(516): n is a, c, g, or t
  modified_base (595)..(595): a, c, t, g, unknown or other
  misc_feature (595)..(595): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtcggccccaggacagacggccaggattacctggtaggggaaacaacagttaggaaagtaaaagtgtgcacgtggtaccagcaagaacgccgaggcccacggcccctgtcgcgtggtcgtctagtgttgatagccgacccggccctcgagggactcccgtggacgcgtacgttccgtccgggctaccaacgtccgtaggggaccaccggcctactctacgaaccctagtccgaaggtagggtacggaagggccggggagtaggacggccgtaacttacgttacgtgtacgtagggtggtaggggtaagtagggtagtacggtgaacgngtagttggtggtagtcggacgggacggaaccaacgtcgaccgtcgtacgtcactccgaagtccgtccgcccgtcgtacncctcgtccgtacccc

SEQ ID NO: 298767 - DNA, 681 bp, Homo sapiens
  misc_feature: GZ8MTXP02JRB44.13.36.D03.1.454.CMB.2.raw
tcagtcacgtactacacgaccggtgctcgatttagctgcgtcacgatctctcttgggggtcacatgggaagtgctttctgagagtcatggacctcctgcacaagaacatgaaacacctgtggttctgcctcctcctggtggcagctcccagatgggtcctgtcccaggtgcagctacagcaagtggggcgcgagggctgtgaagccgttcggacgaccctgtccctcacgtgcgctgtctcgtggtggttctcgagttggttactacgtggagcgtggactccggccacggtaccccgaggggacggggcgtagggaggtggtaggttaggggaaatcgaatcgtagtaggtaggaacgccaaccaaccctacccgaaccccgtccacgacgacgaccgcgtccacagtcgtacagtacgacaccgtaccaaacgtacccgtacgttccctcccgtagggtacggggtactacggtccgttacgtcgggtaccggtaacccggtccgggtacggaacccggaccgggtccgttggttacgttaccgtttcggtggtacggaccggtaggtacggtacctttaaggttttcggacctttcggtacttactttcctcccggtttagaccgtttcggaccgggggtaccgtaacggggtaaccctccggtcgtacccgttccgg

SEQ ID NO: 298768 - DNA, 692 bp, Homo sapiens
  misc_feature: GZ8MTXP02I82FG.13.36.D03.1.454.CMB.2.raw
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagcccaccctcggtgtcagtcggccccaggaccagacggccaggattaccgtggtagggggaaacaacattaggaaagtaaaagtgtgacactggtaccagcagaagccaggccaggcccctgtgctggtctctatgtagatgcgacccggccctgagggactcctgacgcgacttccgcgggctaccaacgtcgtacgggacctcgggccctactccgtacgaaccctagtccgaaagggtacggggtaccgaaacgggcccgggggtaatcggggaaccggacccggtaattaacgtttaaccgtcggtacggacggggtccggtacgggacacggaccgacggaccgtaccgtccggaccgtacgttacgttccggttaccggttaaccggggaacggtaccggggaaacccgtaaccgggttacccgtaaaccgttaaccgtaaccgtaccgaacccggaaccccgaaaccgaccccctaacccgacgttacccgtacctaccgtttcccgttcccg

SEQ ID NO: 298769 - DNA, 843 bp, Homo sapiens
  misc_feature: GZ8MTXP02IAZCD.13.36.D03.1.454.CMB.2.raw
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagcccaccctcggtgtcagtcggccccaggacagacggccaggacttactggtagggggaaacaacgattaggaaagtaaagtgtagacactggtaccagcaagaacgccagggccacggcccctgtcgcgtggtccgtctatgttgagtagccgacccggccctcgagggactccccgtggacgcgtacttccggtccggggtcctacccgtaacgtaccggttcggggaacccacccggggtacccaaccgtttcgtaaccgggaaccccctaagttacccgaacggggttaaacgggggttacccggaaagggggccccgggggttaaagtcggggaaacggggaccgttacgttaaacgtttaacccggttggtaccgtaaaggggtttgggtagggggtaaggtttaaccggtttaagggttccgggttaagggaacggttacgtaaggttacgggtttggggttaacgggtttccgggggaacgggggaaaccggggttaaacccggaaaaaaccgttcggggtaaccccggtttaaacccggtaaacgggggtttccccaaaccgggacccccggttaaaccggccccggtttaccccggacccccccggttcggggtaaccccctttaccccggtttcccggtttccccgtttaaccccccccc

SEQ ID NO: 298770 - DNA, 784 bp, Homo sapiens
  misc_feature: GZ8MTXP02JE8CO.13.36.D03.1.454.CMB.2.raw
  modified_base (75)..(75): a, c, t, g, unknown or other
  misc_feature (75)..(75): n is a, c, g, or t
  modified_base (187)..(187): a, c, t, g, unknown or other
  misc_feature (187)..(187): n is a, c, g, or t
  modified_base (233)..(233): a, c, t, g, unknown or other
  misc_feature (233)..(233): n is a, c, g, or t
  modified_base (247)..(247): a, c, t, g, unknown or other
  misc_feature (247)..(247): n is a, c, g, or t
tcagtcacgtactacacgaccggtgctcgatttagctgcgtcacgatctctcttggggagcttcagctgtggtanagaagacaggattcaggacaatctccagcatggccggcttccctctcctcctcacccctcctcactcactgtgcagggtcctgggcccagtctgtgctgactcagccacctnagcgtcgtcgggaccccccgggagagtgtcaccattctcttgttcnggagcagtgccaanagtcgggaataattatgctattctaggtatacaactaacctacccgaacggaacccgggcccccagaccttccctacacttactatacgacaaactaaaccgagccggcccctacgacggggtccctacgaccgtacttcgcttcggacctaccaacgttcgtacggaccacctaccaccggcccttacccgtcggaccctattccgaggttccggggccttccccggggttacccggaccggtagttaccggacgggttaccgttagggttaaacttttaacgttttaaccggtttcggttacccgttaaagggttccgggtttaggggtaaacgttacgggttaaacccgacgttaccccgggtttaaacgttaaaaccggtttttaccgggttttcgggggtttttaccggggaccgggggttaaacggggtaaacccggttaaacggttacccgggtaaacccgggttcccccgtttaaaaggggttccccgtaacggaacccccggttaaacgggcccgtttaacccccggg

SEQ ID NO: 298771 - DNA, 589 bp, Homo sapiens
  misc_feature: GZ8MTXP02ITC9X.13.36.D03.1.454.CMB.2.raw
  modified_base (190)..(190): a, c, t, g, unknown or other
  misc_feature (190)..(190): n is a, c, g, or t
  modified_base (448)..(448): a, c, t, g, unknown or other
  misc_feature (448)..(448): n is a, c, g, or t
  modified_base (452)..(452): a, c, t, g, unknown or other
  misc_feature (452)..(452): n is a, c, g, or t
  modified_base (461)..(461): a, c, t, g, unknown or other
  misc_feature (461)..(461): n is a, c, g, or t
  modified_base (479)..(479): a, c, t, g, unknown or other
  misc_feature (479)..(479): n is a, c, g, or t
  modified_base (503)..(503): a, c, t, g, unknown or other
  misc_feature (503)..(503): n is a, c, g, or t
tcagtcacgtactacacgaccggtgctcgatttagctgcgtcacgatctctcttggggtcacatgggaagtgctttctgagagtcatggacctcctgcacaagaacatgaaacacctgtggttctgcctcctcctggtggcagctcccagatgggtccctgtcccaggtgcagctacagcaagtggggcncgaggggctggttgaagtcccgttcggacgacccctgtccctgacgtgcgtctgtctcgttgggttcggttcttcaggttggttactacgtggagcgtggactcccgccacgtccccgaggggagggcgtggagtggagtaggggaaatcaaagtctagtaggtaggaacgaccgaaccaacccgtaccaacccccgtcccgtacgaacgacgcccgagtccacatgacagtagacacgtacaagacatcctcgtagnggtnacgctacgngtcgcccgtcggacgacncggtctgtacgtcgttcgtgtcgngagagtcttaagtttggacttcgtcttacttccgttccttcgtacttcggtcgggtccgaaccggtacgtcgtaccgacgtttccg

SEQ ID NO: 298772 - DNA, 726 bp, Homo sapiens
  misc_feature: GZ8MTXP02FIZLX.13.36.D03.1.454.CMB.2.raw
  modified_base (213)..(213): a, c, t, g, unknown or other
  misc_feature (213)..(213): n is a, c, g, or t
  modified_base (244)..(244): a, c, t, g, unknown or other
  misc_feature (244)..(244): n is a, c, g, or t
  modified_base (365)..(365): a, c, t, g, unknown or other
  misc_feature (365)..(365): n is a, c, g, or t
tcagtcacgtactacacgaccggtgctcgatttagctgcgtcacgatctctcttgggggagcttcagctgtggtagagaagacaggattcaggacaatctccagcatggccggcttccctctcctcctcaccctcctcactcactgtgcagggtcctgggcccagtctgtgctgactcagcccaccctcagcgtcgtcggggaccccccgggnagagtcgtaccacctattcttctttgttcgngggacgctaggtcgaccaacagtacgggtaagttaattagtgtctattcgtagtactaccaaaccaacctaccccgaacggaaccccggaccccgaacgtacctacctactacttactaanacaacctaaacctaaccgacggccccggtaccgtacccggtaccggggtaccctacggtaccgtactttccgtcgttcggacctaccgtaagtccgtcgacctaccctacgacccgtcccgtcccgtcgacctacgtcgtacggtccgggtcccgttacccgggtaccgtacggtacgtacggaacggtacgttacgttaactttacgtttacgttgttaccgtacggttcggttaggacgtacgactacgacgttacggtaacgtttcgggtttacgggggttacgggacgggtaacggtaccgtacggtaccgaacccggtaccgttacggaccgaccggtaccgacggtccgtacccg

SEQ ID NO: 298773 - DNA, 666 bp, Homo sapiens
  misc_feature: GZ8MTXP02INLWQ.13.36.D03.1.454.CMB.2.raw
  modified_base (286)..(286): a, c, t, g, unknown or other
  misc_feature (286)..(286): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctggtagggggaaacacattggaagtaaagtgtgcactggtaccagcagaagccaggccaggcccctgngctggtcgtctatgttgatagcgaccggccctcgacgggactccccgtgacggcgacttccgtcggggaccttaccaacgttccgtagggaccgacgggtccacctcgtacgacccattccagggttacggggaccggaaggcccgggggattacgggacggacccggtacttaacgttacgtcgtacgtaagggttggttaggggagtttaaggtaggttcggtagagtcgaagttggtagggttagttccgggggacggaacgggggtacccaaaacggttcgggaaaccccgttacgtacgggtaccaaccgggaccccaaacgggcgttcccggacccccgttacggtccctaccgttccgtaccggtttcccccg

SEQ ID NO: 298774 - DNA, 704 bp, Homo sapiens
  misc_feature: GZ8MTXP02IV96P.13.36.D03.1.454.CMB.2.raw
  modified_base (189)..(189): a, c, t, g, unknown or other
  misc_feature (189)..(189): n is a, c, g, or t
  modified_base (294)..(294): a, c, t, g, unknown or other
  misc_feature (294)..(294): n is a, c, g, or t
tcagtcacgtactacacgaccggtgctcgatttagctgcgtcacgatctctcttggggtcacatgggaagtgctttctgagagtcatggacctcctgcacaagaacatgaaacacctgtggttctgcctcctcctggtggcagctcccagatgggtcctgtcccaggtgcagctacagcaagtggggcncgagggctggttagaacgtccgttacggacgtaccccgtcgtccctcgacgttgcgtcttgtccgtcgtgggttcgggttcttcgaggtcggttaactcgtggancgttggactccgccgtacgtccccggaggggaaggcgtaggaggtggagttagggaaatcaaagtcgaagttaggaggaacgaccaaaccgaaaccctacccgaacccgtccgtacgacgacgaccgtacgtccaactacgtgtaccaaagacgactaaccgtaccgaaacgaacctacgttcctacccgtagggacggtacgacgtcctcgttacggaccggacccggccgggaccggtaacgccggtcgttacgtacgttcgttcggtgtacgggagtacgtacggtaacgtttacgtttcggaccttcgtactttacgttcccgtttaccgtttacggaccgtttaacgggtcccggggtaaccggtacccgggttaaacctccggtacccgttaccggtttcccgg

SEQ ID NO: 298775 - DNA, 596 bp, Homo sapiens
  misc_feature: GZ8MTXP02F2ZV1.13.36.D03.1.454.CMB.2.raw
  modified_base (189)..(189): a, c, t, g, unknown or other
  misc_feature (189)..(189): n is a, c, g, or t
  modified_base (227)..(227): a, c, t, g, unknown or other
  misc_feature (227)..(227): n is a, c, g, or t
  modified_base (269)..(269): a, c, t, g, unknown or other
  misc_feature (269)..(269): n is a, c, g, or t
  modified_base (331)..(331): a, c, t, g, unknown or other
  misc_feature (331)..(331): n is a, c, g, or t
tcagtcacgtactacacgaccggtgctcgatttagctgcgtcacgatctctcttggggtcacatgggaagtgctttctgagagtcatggacctcctgcacaagaacatgaaacacctgtggttctgcctcctcctggtggcagctcccagatgggtcctgtcccaggtgcagctacagcaagtggggcncgaggggctggttgaagccttcggagaccctgtccctnacgtgcgctgtctctggtggtcttcgagtggtactactgganctggatccgcagtccccgagggaaggctggagtggattggggaatcgaatcagtagtggaancacaacctacgaacccgtctacgagacgccgagtccaccagtcgtcaagtacgacacgtaccaaagaccagttctcccgtaggacgggtgacgtctacgtcgttacgaacccgcggacgggtaccacggcgttagtcgttacgttctggtgaccggtaagcgggtacttaaagtttttcggaccttcggtacttactttccgttccctttgttaccgttcggtcggggtaccctaacggggacccttagtccgtaccgtttcccg

SEQ ID NO: 298776 - DNA, 637 bp, Homo sapiens
  misc_feature: GZ8MTXP02JZBR4.13.36.D03.1.454.CMB.2.raw
  modified_base (186)..(186): a, c, t, g, unknown or other
  misc_feature (186)..(186): n is a, c, g, or t
  modified_base (621)..(621): a, c, t, g, unknown or other
  misc_feature (621)..(621): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagcccaccctcggtntcagtcggccccaggacagacggccagggacttaccgtggtagggggaaacaacagttaggaaagttaaaagtgtgcacgtggtaccagcagaacgccaggccaggcccctgtcgctggtctctatgtgatagccgaccggccctacgagggtactcccgtagacgtcgtacgttcgtccggcctacccgaacgttccggtacgggaccgaccgggccctaacgtccgtacgaccctagtcgaacgggttacggggtaccggaacggggcccggggtagtcgggacggcccgaacttacgttaacgtgtacgtaagggtggttagggatacggtagttcggagacgtcgtagtggtacggttagttcggggacggacggtaacctaacgtcggaccgtaccgacgtcacgaccgagccgtccgcccgtcggtacnccgtcgtccgtccccg

SEQ ID NO: 298777 - DNA, 788 bp, Homo sapiens
  misc_feature: GZ8MTXP02F0RBI.13.36.D03.1.454.CMB.2.raw
tcagtcacgtactacacgaccggtgctcgatttagctgcgtcacgatctctcttggggtcacatgggaagtgctttctgagagtcatggacctcctgcacaagaacatgaaacacctgtggttctgcctcctcctggtggcagctcccagatgggtcctgtcccaggtgcagctacgagacaagtggggcgcgagggtctggttagaacgtcccgttcggacgaccccttgtccctcgacgtgcgtcttgtctcgtgggttggttcttcgagttggttactacgtggagcgtcggactcccggccacggtaccccgaaggggtacggggctgggacggtgggtagtaggggaaatcgaatcgaagtaggtacggagaccaaccaaccctaccaaccccgtcctacgaggaccgcgcgtaccacctagtcgacgagtacgacaaccgttacaaacgtaactacgtcccttcccgtaggacggtagacgtcgtaccgtaggtaccggaccccgtacgggcccggaacgtcccgggtgttacgggttaccgttaccgtttcggttacgggttacggtaccggtaagggtaacgggttaccgttttaaaaggtttttaccgggaccttttcccggttaaccgtttaaccgttttacccgttttcccccggtttttaagtttaccccgggtttaaccggggttaaccccgggggtaacccgggtttaaaaccccggggggttaaaccctttacccggggtttaaccccgtttacccccgggttttcccccggg

SEQ ID NO: 298778 - DNA, 688 bp, Homo sapiens
  misc_feature: GZ8MTXP02HF2HR.13.36.D03.1.454.CMB.2.raw
  modified_base (189)..(189): a, c, t, g, unknown or other
  misc_feature (189)..(189): n is a, c, g, or t
tcagtcacgtactacacgaccggtgctcgatttagctgcgtcacgatctctcttggggtcacatgggaagtgctttctgagagtcatggacctcctgcacaagaacatgaaacacctgtggttctgcctcctcctggtggcagctcccagatgggtcctgtcccaggtgcagctacagcaagtggggcncgagggcttggttgaacgtccgttcgggacgaccccttgtcccctgacgtgcgtctgtctcgtgggttggttcttcgagttggttactacgtggagtcgtggactcccgccgacgtccccggaggggacgggcgtggaggtggaagttaggggaaaatcgaaatcgagtaggtaggaacgaccaaccgaaaccctaccgaaccccgtcccacgacgaccgaccgacgtaccaacgagtcgtacgtagaacgaacccaaccgtaccaaaacggtaaccctacgttaccgtcccgtaggtacgggtcgaacgtccgtcgtcgtacggacccggcggaccggtaccgacggtcgtcgttacgttccttcgtggtcgaccggtagtacggttactttaaacggttttcggactttcggttacttaactttcccgtttccgtttagtaccgttcggtaccgggtaccgtaacggtaacccgtcgtaccgtacccggtttcccgg

SEQ ID NO: 298779 - DNA, 810 bp, Homo sapiens
  misc_feature: GZ8MTXP02JR8SX.13.36.D03.1.454.CMB.2.raw
tcagtcacgtactacacgaccggtgctcgatttagctgcgtcacgatctctcttggggtcacatgggaagtgctttctgagagtcatggacctcctgcacaagaacatgaaacacctgtggttctgcctcctcctggtggcagctccagatgggtcctgtcccaggtgcagctacagcaagtggggcgcgagggtctggttagaacgtccgttacggacgtacccctcgtcccctcgacgtcgcgtctgtctcgttgggttcggttctcgtaggttcggttactacgtggagtcgtcggtactcccgccgtaccggtacccccggaaggggaacggggtcgtaggggaggtagggtaaggttaggggaaaattacgtaaagtacgtaagttagggtaacggaaacgaccgtaaaccctaaacccgtaacccccgtaacccccggttaccctaacggaacggtaaccggacccgtacggtaccctaaaccgtacgttaccgtacgaacggttaaacgaacccgtaaacccggtaaccgaaaaccggtaacccttacgtttccccgtacccggtaggggtacggggtacgtaccggtcgttacgtcgggtaacccggaccccgggaccggtacccgggaacgtccggtcgtttcggttaacgttcccgtttggtcgggtacggcggtaaacggtacggttaacgttttaggtttaccgggactttccggtactttctttccccgttaccgtttgtaccggttcggtacggggtacccgtaacgggtacccgttcgtacccgtcgttacccgg

SEQ ID NO: 298780 - DNA, 819 bp, Homo sapiens
  misc_feature: GZ8MTXP02IEMFK.13.36.D03.1.454.CMB.2.raw
tcagtcacgtactacacgaccggtgctcgatttagctgcgtcacgatctctcttggggtcacatgggaagtgctttctgagagtcatggacctcctgcacaagaacatgaaacacctgtggttctgcctcctcctggtggcagctcccagatgggtcctgtcccaggtgcagctacagcaagtggggcgcgaggggcttgttgaagtcccgttcgggacgaccccttgtcccctcacgtgcgtctgtctcgtgggttgggtttcttcgtaggttggttaactacgtggagtcgtggactcccggccgacggtacccccggagggggaacggggcgtagggaggtcgggaagttaggggaaaactcgaaagtctaagtagggtaggaacgaccaaccctaacctaacccgaaccccgttcccgtacggacgtaccggacccgagttcccaaccgtagttacgttaccgaagtacgaacctaacccgtaccgaaacgtaaaccctacggttccctcccgtagggtacgggggtagtaacgtccgtacgtacggtaccggacccccggtaccgggaccggaacccggtccgggtccgtttacgggttaccgtttaaccgtttcggttcggtaacggggtaccggtaagggtacggttaacgtttttaaaacggtttttccggggaacccgtttccgggttaacctttaaccgtttttccccgtttaacccggtttttcggtaacccgttttccggggtaccggggtaccccggttaaccgggggtaaaccccttcgggttaaacccgtcccggtttccccgg

SEQ ID NO: 298781 - DNA, 622 bp, Homo sapiens
  misc_feature: GZ8MTXP02JEXRX.13.36.D03.1.454.CMB.2.raw
  modified_base (184)..(184): a, c, t, g, unknown or other
  misc_feature (184)..(184): n is a, c, g, or t
  modified_base (395)..(395): a, c, t, g, unknown or other
  misc_feature (395)..(395): n is a, c, g, or t
  modified_base (435)..(435): a, c, t, g, unknown or other
  misc_feature (435)..(435): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccacctcggtntcagtcggccccaggacagacggccaggattaccgtgtagggggaaacaacgattaggaagtaaaagtgtgacacgtggtaccagcagaacgccaggtcccaggcccctagtcgctggtctctatgtgataggcgaccggccctagagggtactcccgtgacgtcgactttcgcggactaccgactagtcgggacgccggctacgtcgtanacccagtactagggtacggtagaaacgggccgggggaaancggacgtccgtaatagtactaggtagtagggttggtaggtagttagtacggtcgtagagtacgtaggtggtcggtacgtcggggacggtaacggtaacgtaaacggtacggtaaccgtacgtacggtaccgacggtacccgaaggtccgtacccgtcccgtcggtacttacgtccgttaccgtcccc

SEQ ID NO: 298782 - DNA, 847 bp, Homo sapiens
  misc_feature: GZ8MTXP02F8Q3O.13.36.D03.1.454.CMB.2.raw
tcagtcacgtactacacgaccggtgctcgatttagctgcgtcacgatctctcttgggggtcacatgggaagtgctttctgagagtcatggacctcctgcacaagaacatgaaacacctgtggttctgcctcctcctggtggcagctcccagatgggtcctgtcccaggtgcagctacagcaagtggggcgcagggctgttgaagccttcggagaccctgtccctcgacgtgcgctgtcctcgttggggttgggttcttcgtaggttcggtttaacttacgtgggtacgtcttggggactccccggacccgtacggtaccccccggaaggggggaaacggggtccgtaggggaggttggggaagttttaggggggaaaaacttccgtaaaattccgaagttaaagggtacggggaaaacggacccaaacccgtaaaccccgtttaaacccccgaaaaccccccccggttccccgttaaccggaacggaccggtaccccggacggtcccaaacccgtagtacggtacgtaacgggttaacgaaccaaccggttaacccaaaacgtaaacccctaacggtttccctaccccggtttaggacgggggttcgaacgtcctacgtcggtacggaccccgggcccggaccgggaccgaccgggtcgttacggttaccgttccgtttacggtcgttagggaccggtaaggacggggttactttaacggtttttacgggaacctttcggtttaccttacttttcccgtttacccgttttcggtacccgtttccggttaccgggggaccctaacgggggtaacccccttacgggtacccgttaacccggtttcccgg

SEQ ID NO: 298783 - DNA, 390 bp, Homo sapiens
  misc_feature: GZ8MTXP01BEPMP.3.11.A11.1.454.CMB.2.raw
  modified_base (343)..(343): a, c, t, g, unknown or other
  misc_feature (343)..(343): n is a, c, g, or t
  modified_base (379)..(379): a, c, t, g, unknown or other
  misc_feature (379)..(379): n is a, c, g, or t
  modified_base (383)..(390): a, c, t, g, unknown or other
  misc_feature (383)..(390): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcatactggagcctgaagattttgcagtgtattactgtcaggtctatggttactcacctcggttcagctttggccaggggaccaaggtggagatcaaacgaactgtggctgcaccatcctgtcttcatcttcccgccntctgagagtgcgtctctgagcgggctggcaaggcgnatgnnnnnnnn

SEQ ID NO: 298784 - DNA, 385 bp, Homo sapiens
  misc_feature: GZ8MTXP01ERXJV.3.11.A11.1.454.CMB.2.raw
  modified_base (379)..(385): a, c, t, g, unknown or other
  misc_feature (379)..(385): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagattttgcagtgtattactgtcaggtctatggtactcacctcggttcagctttggccaggggaccaaggtgagatcaaacgaactgtgctgcacatcctgtctcatcttcccgcaatctgagagtgcgtctctgagcgggctggcaaggcgcatagnnnnnnn

SEQ ID NO: 298785 - DNA, 404 bp, Homo sapiens
  misc_feature: GZ8MTXP01BQHX4.3.11.A11.1.454.CMB.2.raw
  modified_base (342)..(342): a, c, t, g, unknown or other
  misc_feature (342)..(342): n is a, c, g, or t
  modified_base (367)..(367): a, c, t, g, unknown or other
  misc_feature (367)..(367): n is a, c, g, or t
  modified_base (383)..(404): a, c, t, g, unknown or other
  misc_feature (383)..(404): n is a, c, g, or t
tcagagacgcactccacgaccggtgctcgatttagctacgactgcagggccgagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagatttgcagtgtattactgtcaggtcatggttactcacctcggttcagctttggccaggggaccaaggtggagatcaaacgaactgtggcttgcaccatcctgtcttcatcttcccgcntctgagagtgcgtctctgagcgggntggcaaggcgcatagnnnnnnnnnnnnnnnnnnnnnn

SEQ ID NO: 298786 - DNA, 404 bp, Homo sapiens
  misc_feature: GZ8MTXP01DRFV4.3.11.A11.1.454.CMB.2.raw
  modified_base (378)..(378): a, c, t, g, unknown or other
  misc_feature (378)..(378): n is a, c, g, or t
  modified_base (380)..(380): a, c, t, g, unknown or other
  misc_feature (380)..(380): n is a, c, g, or t
  modified_base (382)..(404): a, c, t, g, unknown or other
  misc_feature (382)..(404): n is a, c, g, or t
tcagagacgcactccacgaccggtgctcgatttagctacgactgcagggccgagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagatttgcagtgtattactgtcaggtcatggttactcacctcggtcagctttggccaggggtaccaaggtggagatcaaacgaactgtggctgcacatcctgtctcatcttacccgcaatctgagagtgcgtctctgagcgggctggcaaggcganangnnnnnnnnnnnnnnnnnnnnnnn

SEQ ID NO: 298787 - DNA, 394 bp, Homo sapiens
  misc_feature: GZ8MTXP01CCJ3L.3.11.A11.1.454.CMB.2.raw
  modified_base (356)..(356): a, c, t, g, unknown or other
  misc_feature (356)..(356): n is a, c, g, or t
  modified_base (385)..(385): a, c, t, g, unknown or other
  misc_feature (385)..(385): n is a, c, g, or t
  modified_base (387)..(392): a, c, t, g, unknown or other
  misc_feature (387)..(392): n is a, c, g, or t
  modified_base (394)..(394): a, c, t, g, unknown or other
  misc_feature (394)..(394): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagattttgcagtgtattactgtcaggtctatggttactcactcggttcagctttggccaggggaccaaggtgagatacaaacgaactgtaggctgcacatcctgtcttcacttcttcccgcctaatctgagagtncgtctctgacgcgggctgcgagcggcaanannnnnngn

SEQ ID NO: 298788 - DNA, 378 bp, Homo sapiens
  misc_feature: GZ8MTXP01E4HH6.3.11.A11.1.454.CMB.2.raw
  modified_base (340)..(340): a, c, t, g, unknown or other
  misc_feature (340)..(340): n is a, c, g, or t
  modified_base (374)..(378): a, c, t, g, unknown or other
  misc_feature (374)..(378): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacagtttcagtggcagtgggtctgggacagacttcactctcaccatcagcagactggagcctgaagattttgcagtttattactgtcagcagggtactctggcccactttcggcctgggaccaaagtggatatcaaaacgaactgtggctgcaccatctgtcttcatcttccgccatctgagngtgcgtctctgagcgggctggcaaggcgcatagnnnnn

SEQ ID NO: 298789 - DNA, 398 bp, Homo sapiens
  misc_feature: GZ8MTXP01ESQL2.3.11.A11.1.454.CMB.2.raw
  modified_base (383)..(383): a, c, t, g, unknown or other
  misc_feature (383)..(383): n is a, c, g, or t
  modified_base (388)..(398): a, c, t, g, unknown or other
  misc_feature (388)..(398): n is a, c, g, or t
tcagagacgcactccacgaccggtgctcgatttagctacgactgcagggccagtgagactgttagcagcagctacttagcctggtaccagcaccaaacctggccaggctcccagtctcctcatctttggtgcatccagcagggcccctggcatcccagacaggttcagtggcagtgggtctgggacagacttcactcgtcaccatcagcagactggagcctgaagattttgctagtgtattactgtcaggtctatggtactcaacctcggttcagtctttggccaggggaccaaggtgagatacaaagaactgtggctgcaccatcctgtctcatccttcccgcaatctgagagtcgcgtctctgagcgggctggcaaggcgntatgnnnnnnnnnnn

SEQ ID NO: 298790 - DNA, 391 bp, Homo sapiens
  misc_feature: GZ8MTXP01CLQDR.3.11.A11.1.454.CMB.2.raw
  modified_base (385)..(391): a, c, t, g, unknown or other
  misc_feature (385)..(391): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagatttgcagtgtattactgtcaggtctatggttactcactcggttcagtctttggccaggggaccaaggtggagatcaaacgactgtggctgcaccatcctgtcttcatcttcccgctaatctgagtagtgcgtctctgagcgggctggcaagggcgcatagnnnnnnn

SEQ ID NO: 298791 - DNA, 389 bp, Homo sapiens
  misc_feature: GZ8MTXP01CL0Y6.3.11.A11.1.454.CMB.2.raw
  modified_base (338)..(338): a, c, t, g, unknown or other
  misc_feature (338)..(338): n is a, c, g, or t
  modified_base (381)..(389): a, c, t, g, unknown or other
  misc_feature (381)..(389): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagattttgcagtgtattactgtcaggtcatggttactcactcggttcagctttggccaggggaccaaggtggagatcaaacgactgtggctgcacatcctgtcttcatcttcccgcntctgagagtgcgtctctgagcgggctgggcaaggcgacatagnnnnnnnnn

SEQ ID NO: 298792 - DNA, 392 bp, Homo sapiens
  misc_feature: GZ8MTXP01DI3CT.3.11.A11.1.454.CMB.2.raw
  modified_base (352)..(352): a, c, t, g, unknown or other
  misc_feature (352)..(352): n is a, c, g, or t
  modified_base (380)..(392): a, c, t, g, unknown or other
  misc_feature (380)..(392): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactgagcctgaagatttgcagtgtattactgtcaggtctatggttactcacctcggttcagctttggccaggggaccaaggtggagatcaaagactgtggctgcacatcctgtcttcatcttcccgcaatctgagagtgcgtntctgagcgggctggcaaggcgcgatagnnnnnnnnnnnnn

SEQ ID NO: 298793 - DNA, 389 bp, Homo sapiens
  misc_feature: GZ8MTXP01D6YTS.3.11.A11.1.454.CMB.2.raw
  modified_base (383)..(389): a, c, t, g, unknown or other
  misc_feature (383)..(389): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagattttgcagtgtattactgtcaggtcatggtactcactcggtcagctttggccaggggaccaaggtggagatcaaacgaactgtggctgcaccatcctgtcttcatcttcccgccaatctgagagtgcgtctctgagcgggctggccaagggcgcatagnnnnnnn

SEQ ID NO: 298794 - DNA, 391 bp, Homo sapiens
  misc_feature: GZ8MTXP01EPETQ.3.11.A11.1.454.CMB.2.raw
  modified_base (341)..(341): a, c, t, g, unknown or other
  misc_feature (341)..(341): n is a, c, g, or t
  modified_base (383)..(391): a, c, t, g, unknown or other
  misc_feature (383)..(391): n is a, c, g, or t
tcagagacgcactccacgaccggtgctcgatttagctacgactgcagggccgagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagattttgcagtgtattactgtcaggtcatggttactcacctcggttcagctttggccaggggaccaaggtggagatcaaacgactgtggctgcaccatcctgtctcatccttcccgcntcctgagagtgcgtctctgagcggctggcaaggcgacatagnnnnnnnnn

SEQ ID NO: 298795 - DNA, 458 bp, Homo sapiens
  misc_feature: GZ8MTXP01CT1LJ.3.11.A11.1.454.CMB.2.raw
  modified_base (326)..(326): a, c, t, g, unknown or other
  misc_feature (326)..(326): n is a, c, g, or t
  modified_base (358)..(358): a, c, t, g, unknown or other
  misc_feature (358)..(358): n is a, c, g, or t
  modified_base (373)..(373): a, c, t, g, unknown or other
  misc_feature (373)..(373): n is a, c, g, or t
  modified_base (394)..(394): a, c, t, g, unknown or other
  misc_feature (394)..(394): n is a, c, g, or t
  modified_base (417)..(418): a, c, t, g, unknown or other
  misc_feature (417)..(418): n is a, c, g, or t
  modified_base (423)..(423): a, c, t, g, unknown or other
  misc_feature (423)..(423): n is a, c, g, or t
  modified_base (425)..(427): a, c, t, g, unknown or other
  misc_feature (425)..(427): n is a, c, g, or t
  modified_base (429)..(434): a, c, t, g, unknown or other
  misc_feature (429)..(434): n is a, c, g, or t
  modified_base (436)..(455): a, c, t, g, unknown or other
  misc_feature (436)..(455): n is a, c, g, or t
  modified_base (457)..(458): a, c, t, g, unknown or other
  misc_feature (457)..(458): n is a, c, g, or t
tcagagacgcactccacgaccggtgctcgatttagctacgactgcaggggccagtgagactgttagcagcagctacttagcctggtaccagcaccaaacctggccaggcctcccgagtctcctcatctttggtgcatccagcagggcccctggcatcccagacaggttcagtgcagtgggtctgggacagacttcactcgtcacatcagcagactggagcctagaagtattttgactagtgtattactgtcaggtctatggttactcaacctcggttacacgtctttggaccaggggaccaaggtggataatacaaacgaactggngctgctacatcctgtctcatccttcccgactnttctgaagtacgtcncgtctcgtgaggcccggggtntggacgaacggcgtataagtagnnatatngnnnannnnnntnnnnnnnnnnnnnnnnnnnntnn

SEQ ID NO: 298796 - DNA, 386 bp, Homo sapiens
  misc_feature: GZ8MTXP01C5EWD.3.11.A11.1.454.CMB.2.raw
  modified_base (339)..(339): a, c, t, g, unknown or other
  misc_feature (339)..(339): n is a, c, g, or t
  modified_base (354)..(354): a, c, t, g, unknown or other
  misc_feature (354)..(354): n is a, c, g, or t
  modified_base (374)..(374): a, c, t, g, unknown or other
  misc_feature (374)..(374): n is a, c, g, or t
  modified_base (380)..(386): a, c, t, g, unknown or other
  misc_feature (380)..(386): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagactcactctcacatcagcagactggagcctgaagtattttgcagttgtattactgtcaggtctatggttactcactcgttcagctttggccaggggaccaaggtggagatacaaacgaactgtggctgcacatcctgtctcatcttcccgcntctgagagtgcgtcnctgagcgggctggcaaggcncatagnnnnnnn

SEQ ID NO: 298797 - DNA, 393 bp, Homo sapiens
  misc_feature: GZ8MTXP01BRCJ4.3.11.A11.1.454.CMB.2.raw
  modified_base (342)..(342): a, c, t, g, unknown or other
  misc_feature (342)..(342): n is a, c, g, or t
  modified_base (367)..(367): a, c, t, g, unknown or other
  misc_feature (367)..(367): n is a, c, g, or t
  modified_base (381)..(381): a, c, t, g, unknown or other
  misc_feature (381)..(381): n is a, c, g, or t
  modified_base (387)..(393): a, c, t, g, unknown or other
  misc_feature (387)..(393): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagtattttgcagtgtattactgtcaggtctatggttactcacctcggttcagtctttggccgaggggaccaaggtggagatcaaacgaactgtggctgcacatcctgtctcatctcccgcntctgagagtgcgtctctgagcgggntgggcaagggccgnagtagnnnnnnn

SEQ ID NO: 298798 - DNA, 386 bp, Homo sapiens
  misc_feature: GZ8MTXP01DHDQL.3.11.A11.1.454.CMB.2.raw
  modified_base (382)..(386): a, c, t, g, unknown or other
  misc_feature (382)..(386): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagattttgcagtgtattactgtcaggtctatggttactcacctcggtcagctttggccaggggaccaaggtgagatcaaaacgaactgtggctgcaccatcctgtctcatcttcccgcaatctgagagtgcgtctctgagcgggctggcaaggcgcatagnnnnn

SEQ ID NO: 298799 - DNA, 401 bp, Homo sapiens
  misc_feature: GZ8MTXP01CCZSH.3.11.A11.1.454.CMB.2.raw
  modified_base (389)..(401): a, c, t, g, unknown or other
  misc_feature (389)..(401): n is a, c, g, or t
tcagagacgcactccacgaccggtgctcgatttagctacgactgcagggccgagtgagactgttagcagcagctacttagcctggtaccagcacaaacctggccaggctcccagtctcctcatctttggtgcatccagcagggcccctggcatcccagacaggttcagtggcagtgggtctgggacagacttcgactctcaccatcagcaggactggagcctgaagatttgcagtgtattactgtcaggtctatggtactcacctcggttcagctttggccaggggaccaagggtggagatcaaacgaactgtggcttgcaccatcctgtcttcatcttcccgcaatcctgagagtgcgtctctgagcgggctggcaaggcgacatagnnnnnnnnnnnnn

SEQ ID NO: 298800 - DNA, 389 bp, Homo sapiens
  misc_feature: GZ8MTXP01DDM70.3.11.A11.1.454.CMB.2.raw
  modified_base (383)..(389): a, c, t, g, unknown or other
  misc_feature (383)..(389): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagtattttgcagtgtattactgtcaggtctatggttactcacctcggttcagctttggccaggggaccaaggtggagatcaaacgactgtggctgcacatcctgtctcatcctcccgctaatctgagagtgcgtctctgagcggcgtggcaaggcgcatagnnnnnnn

SEQ ID NO: 298801 - DNA, 390 bp, Homo sapiens
  misc_feature: GZ8MTXP01BWSYP.3.11.A11.1.454.CMB.2.raw
  modified_base (344)..(344): a, c, t, g, unknown or other
  misc_feature (344)..(344): n is a, c, g, or t
  modified_base (351)..(351): a, c, t, g, unknown or other
  misc_feature (351)..(351): n is a, c, g, or t
  modified_base (385)..(390): a, c, t, g, unknown or other
  misc_feature (385)..(390): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagtattttgcagtgtattactgtcaggtctatggttactcacctggttcagtctttggccagggggaccaaggtggagatcaaacgaactgtggctgcaccatcctgtcttcatcttcccgcntctgagngtgcgtctctgagcgggctggcaaggcgcatagnnnnnn

SEQ ID NO: 298802 - DNA, 391 bp, Homo sapiens
  misc_feature: GZ8MTXP01DM9PJ.3.11.A11.1.454.CMB.2.raw
  modified_base (386)..(391): a, c, t, g, unknown or other
  misc_feature (386)..(391): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagattttgcagtgtattactgtcaggtctatggttactcacctcggttcagctttggccaggggaccaaggtggagatacaaacgactgtggctgcaccatcctgtcttcatccttcccgccaatctgagagtgcgtctctgagcgggctggcaaggcgcatagnnnnnn

SEQ ID NO: 298803 - DNA, 426 bp, Homo sapiens
  misc_feature: GZ8MTXP01D1F44.3.11.A11.1.454.CMB.2.raw
  modified_base (319)..(319): a, c, t, g, unknown or other
  misc_feature (319)..(319): n is a, c, g, or t
  modified_base (401)..(426): a, c, t, g, unknown or other
  misc_feature (401)..(426): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagtattttgctagtgtattactgtcaggtctatggttactcaaccttcggttcacgtctttggccaggggaccaaggtggagatacaaacgaatgtgntgcacgatcctgtcttcacttctaccccgcaatctgacgagtgcgtctcgtgacgtcgggctggactaaaggcgactatagnnnnnnnnnnnnnnnnnnnnnnnnnn

SEQ ID NO: 298804 - DNA, 418 bp, Homo sapiens
  misc_feature: GZ8MTXP01CBX65.3.11.A11.1.454.CMB.2.raw
  modified_base (363)..(363): a, c, t, g, unknown or other
  misc_feature (363)..(363): n is a, c, g, or t
  modified_base (404)..(404): a, c, t, g, unknown or other
  misc_feature (404)..(404): n is a, c, g, or t
  modified_base (409)..(409): a, c, t, g, unknown or other
  misc_feature (409)..(409): n is a, c, g, or t
  modified_base (411)..(418): a, c, t, g, unknown or other
  misc_feature (411)..(418): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcaggtgggtctgggacagacttcactctcacatcagcagactggagcctgaagtattttgctagtgtattactgtcaggtctatggttactctacctcggttcagtcgtttggccgagggggaccaagggtggaagaatacgaaacgtaactggtggctgacaccattccctgtcttcactccttccccgctntctgaagtgtgcgtctcgtgagcggggctgggccaagggcncgaangnnnnnnnn

SEQ ID NO: 298805 - DNA, 402 bp, Homo sapiens
  misc_feature: GZ8MTXP01BEPA0.3.11.A11.1.454.CMB.2.raw
  modified_base (254)..(254): a, c, t, g, unknown or other
  misc_feature (254)..(254): n is a, c, g, or t
  modified_base (309)..(309): a, c, t, g, unknown or other
  misc_feature (309)..(309): n is a, c, g, or t
  modified_base (341)..(341): a, c, t, g, unknown or other
  misc_feature (341)..(341): n is a, c, g, or t
  modified_base (394)..(394): a, c, t, g, unknown or other
  misc_feature (394)..(394): n is a, c, g, or t
  modified_base (398)..(398): a, c, t, g, unknown or other
  misc_feature (398)..(398): n is a, c, g, or t
  modified_base (400)..(402): a, c, t, g, unknown or other
  misc_feature (400)..(402): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacccactgccactgaacctgtctgggatgccaggggccctgctggatgcaccaaagatgaggagactggagcctgaagtattttgcagtgtattacngtcaggtctatggttactcacctggttcagctttggccaggggaccaaggtgganatcaaacgactgtggctgcacatctgtcttcntcttcccgcatctgacgagtgcgtctctggagcggggctgggcaagggccganatgngnnn

SEQ ID NO: 298806 - DNA, 388 bp, Homo sapiens
  misc_feature: GZ8MTXP01DOZV0.3.11.A11.1.454.CMB.2.raw
  modified_base (310)..(310): a, c, t, g, unknown or other
  misc_feature (310)..(310): n is a, c, g, or t
  modified_base (340)..(340): a, c, t, g, unknown or other
  misc_feature (340)..(340): n is a, c, g, or t
  modified_base (383)..(388): a, c, t, g, unknown or other
  misc_feature (383)..(388): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagatttgcagtgtattactgtcaggtctatggttactcacctcggttcagctttggccaggggaccaaggtggagatcaaacgaactgnggctgcacatctgtctcatccttcccgctntctgagagtgcgtctctgagcgggctggcaaggcgacagtagnnnnnn

SEQ ID NO: 298807 - DNA, 413 bp, Homo sapiens
  misc_feature: GZ8MTXP01BHHFD.3.11.A11.1.454.CMB.2.raw
  modified_base (376)..(376): a, c, t, g, unknown or other
  misc_feature (376)..(376): n is a, c, g, or t
  modified_base (391)..(391): a, c, t, g, unknown or other
  misc_feature (391)..(391): n is a, c, g, or t
  modified_base (396)..(401): a, c, t, g, unknown or other
  misc_feature (396)..(401): n is a, c, g, or t
  modified_base (403)..(413): a, c, t, g, unknown or other
  misc_feature (403)..(413): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagattttgcagtgtattactgtcaggtctatggtactcacctgtcagcttggccaggggaccaaggtggagatcaaacgaactgtgctgcacgatcctgtcttcatccttcccgctaatccgtagagtagtgcggtctcgtgagccgggggtacncgggacgaaggcganagtgnnnnnngnnnnnnnnnnn

SEQ ID NO: 298808 - DNA, 390 bp, Homo sapiens
  misc_feature: GZ8MTXP01B6R08.3.11.A11.1.454.CMB.2.raw
  modified_base (216)..(216): a, c, t, g, unknown or other
  misc_feature (216)..(216): n is a, c, g, or t
  modified_base (379)..(379): a, c, t, g, unknown or other
  misc_feature (379)..(379): n is a, c, g, or t
  modified_base (385)..(390): a, c, t, g, unknown or other
  misc_feature (385)..(390): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggancctgaagtatttgcagtgtattactgtcaggtctatggttactcacctcggttcagtcttggccaggggaccaaggtggagatacaaacgaactgtagctgcacctatcctgtcttcatccttcccgcaatctgagagtgcgtctctgagcgggctggcaggncatagnnnnnn

SEQ ID NO: 298809 - DNA, 387 bp, Homo sapiens
  misc_feature: GZ8MTXP01B2ETC.3.11.A11.1.454.CMB.2.raw
  modified_base (340)..(340): a, c, t, g, unknown or other
  misc_feature (340)..(340): n is a, c, g, or t
  modified_base (381)..(387): a, c, t, g, unknown or other
  misc_feature (381)..(387): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagattttgcagtgtattactgtcaggtctatggttactcacctcggttcagctttggccaggggaccaaggtgagatcaaacgaactgtggctgcacatcctgtcttcatcttcccgcntctgagagtgcgtctctgagcgggctggcaaggcgcatagnnnnnnn

SEQ ID NO: 298810 - DNA, 391 bp, Homo sapiens
  misc_feature: GZ8MTXP01EM370.3.11.A11.1.454.CMB.2.raw
  modified_base (340)..(340): a, c, t, g, unknown or other
  misc_feature (340)..(340): n is a, c, g, or t
  modified_base (382)..(391): a, c, t, g, unknown or other
  misc_feature (382)..(391): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagattttgcagtgtattactgtcaggtcatggttactcactcggtcagctttggccaggggaccaaggtggagatcaaacgaactgtggctgcaccatcctgtcttcatccttcccgcntctgagagtgcgtctctgagcgggctggcaaggcgcagtagnnnnnnnnnn

SEQ ID NO: 298811 - DNA, 605 bp, Homo sapiens
  misc_feature: GZ8MTXP01DBVSD.3.11.A11.1.454.CMB.2.raw
  modified_base (136)..(136): a, c, t, g, unknown or other
  misc_feature (136)..(136): n is a, c, g, or t
  modified_base (555)..(555): a, c, t, g, unknown or other
  misc_feature (555)..(555): n is a, c, g, or t
  modified_base (557)..(557): a, c, t, g, unknown or other
  misc_feature (557)..(557): n is a, c, g, or t
  modified_base (565)..(565): a, c, t, g, unknown or other
  misc_feature (565)..(565): n is a, c, g, or t
  modified_base (567)..(570): a, c, t, g, unknown or other
  misc_feature (567)..(570): n is a, c, g, or t
  modified_base (572)..(573): a, c, t, g, unknown or other
  misc_feature (572)..(573): n is a, c, g, or t
  modified_base (575)..(575): a, c, t, g, unknown or other
  misc_feature (575)..(575): n is a, c, g, or t
  modified_base (577)..(577): a, c, t, g, unknown or other
  misc_feature (577)..(577): n is a, c, g, or t
  modified_base (579)..(579): a, c, t, g, unknown or other
  misc_feature (579)..(579): n is a, c, g, or t
  modified_base (581)..(582): a, c, t, g, unknown or other
  misc_feature (581)..(582): n is a, c, g, or t
  modified_base (584)..(584): a, c, t, g, unknown or other
  misc_feature (584)..(584): n is a, c, g, or t
  modified_base (586)..(586): a, c, t, g, unknown or other
  misc_feature (586)..(586): n is a, c, g, or t
  modified_base (590)..(591): a, c, t, g, unknown or other
  misc_feature (590)..(591): n is a, c, g, or t
  modified_base (593)..(600): a, c, t, g, unknown or other
  misc_feature (593)..(600): n is a, c, g, or t
  modified_base (602)..(603): a, c, t, g, unknown or other
  misc_feature (602)..(603): n is a, c, g, or t
  modified_base (605)..(605): a, c, t, g, unknown or other
  misc_feature (605)..(605): n is a, c, g, or t
tcagagacgcactccacgaccggtgctcgattttagctacgactgcaggggccagtgagactgttagcagcagctacttagcctggtaccagcaccaaacctggccaggcctcccgagtcctcctcatctttggtncatccagcagggcccctggcatcccagacaggttcagtggcaggtggtctgggacagtacttcacgtcgtacacatccagcagactggacgcctagaagtattttgatagttgttattacgtgtctaggtctagtggttaacctacgaaccgttcggttaccacggttacgtttcggaccgtaagggggtaacctaaggggttggaagttaacgtaacggtaaaaccggtagtttacgggcggtacttaggaaccctaactacggtttccccttacggtttcttaccgtaacttccccgtttccccggaactaagttcgtaaccgggtaaagtccggttcgaccggtttaccgtacgggtacgggtcgggtaccgggtacgtacggacggtacggtacgtacgtagtagtagtatatananagatatanannnntnntngngngnnanangagnngnnnnnnnntnntn

SEQ ID NO: 298812 - DNA, 400 bp, Homo sapiens
  misc_feature: GZ8MTXP01EDGBC.3.11.A11.1.454.CMB.2.raw
  modified_base (357)..(357): a, c, t, g, unknown or other
  misc_feature (357)..(357): n is a, c, g, or t
  modified_base (377)..(377): a, c, t, g, unknown or other
  misc_feature (377)..(377): n is a, c, g, or t
  modified_base (395)..(400): a, c, t, g, unknown or other
  misc_feature (395)..(400): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagtattttgcagttgtattactgtcaggtctatggttactcactcggttcagtctttggccagggggaccaaggtggagatacgaaacgaactgtggctgcacatcctgtctcattccttccccgctaatctgagngtcgcgtctcgtgagcgggntgggccaaggcgacatgnnnnnn

SEQ ID NO: 298813 - DNA, 393 bp, Homo sapiens
  misc_feature: GZ8MTXP01D9W25.3.11.A11.1.454.CMB.2.raw
  modified_base (381)..(381): a, c, t, g, unknown or other
  misc_feature (381)..(381): n is a, c, g, or t
  modified_base (387)..(393): a, c, t, g, unknown or other
  misc_feature (387)..(393): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagtattttgctagtgtattactgtcaggtctatggttactcacctcggttcagtctttggccaggggaccaaggtgagatcaaacgaactgtggctgcacatcctgtcttcatcttcccgctaatctgagagtgcgtctctgagcgggctggccaaggcncatagnnnnnnn

SEQ ID NO: 298814 - DNA, 400 bp, Homo sapiens
  misc_feature: GZ8MTXP01CRA2V.3.11.A11.1.454.CMB.2.raw
  modified_base (388)..(388): a, c, t, g, unknown or other
  misc_feature (388)..(388): n is a, c, g, or t
  modified_base (391)..(400): a, c, t, g, unknown or other
  misc_feature (391)..(400): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagtattttgcagtgtattactgtcaggtctatggtactcactcggttcagctttggcaggggaccaaggtggagatacgaaacgaactggtagctgcaccatcctgtcttcactcttcccgccaatctgagagtgctctctggagcgggctgggccaagggcacaanagnnnnnnnnnn

SEQ ID NO: 298815 - DNA, 489 bp, Homo sapiens
  misc_feature: GZ8MTXP01CJUVU.3.11.A11.1.454.CMB.2.raw
  modified_base (473)..(478): a, c, t, g, unknown or other
  misc_feature (473)..(478): n is a, c, g, or t
  modified_base (480)..(489): a, c, t, g, unknown or other
  misc_feature (480)..(489): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagattttgcagtgtattctagtcgtagtacgtatggttacgtctacctaccggttcgtacgtcgtttcggtccggacggggaccggaacggtagggtaggaagtacgtaaaaccggtaaacgtacgtgggtcgttcgaccaccacttaccttcggttctttcctactacctttaccccgtccctctctcgtaagacggtgccggtctcctaggggagccgggggcctgggcgaaacggcggtccaaagtggnnnnnngnnnnnnnnnn

SEQ ID NO: 298816 - DNA, 392 bp, Homo sapiens
  misc_feature: GZ8MTXP01CNHO8.3.11.A11.1.454.CMB.2.raw
  modified_base (330)..(330): a, c, t, g, unknown or other
  misc_feature (330)..(330): n is a, c, g, or t
  modified_base (344)..(344): a, c, t, g, unknown or other
  misc_feature (344)..(344): n is a, c, g, or t
  modified_base (386)..(392): a, c, t, g, unknown or other
  misc_feature (386)..(392): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagtatttgcagtgtattactgtcaggtctatggttactcacctcggttcagtctttggccaggggaccaaggtggagatcgaaacgactgtgctgcacatcctgtcttnactcttcccgcctntctgagagtgcgtctctgagcgggctcggcaaggcgcatagnnnnnnn

SEQ ID NO: 298817 - DNA, 392 bp, Homo sapiens
  misc_feature: GZ8MTXP01CGSMB.3.11.A11.1.454.CMB.2.raw
  modified_base (388)..(392): a, c, t, g, unknown or other
  misc_feature (388)..(392): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcaggtgggtctgggacagacttcactctcacatcagcagactggagctagaagtatttgctagttgtattactgtcaggtctatggtactcacctcggttcagtctttggccaggggaccaaggtgagatacaaacgaactgtgctgcacatcctgtctcactcttacccgctaatctgagagtgcgtctcgtgagcgggctggcgaaggctcatagnnnnn

SEQ ID NO: 298818 - DNA, 399 bp, Homo sapiens
  misc_feature: GZ8MTXP01D86ZA.3.11.A11.1.454.CMB.2.raw
  modified_base (349)..(349): a, c, t, g, unknown or other
  misc_feature (349)..(349): n is a, c, g, or t
  modified_base (386)..(386): a, c, t, g, unknown or other
  misc_feature (386)..(386): n is a, c, g, or t
  modified_base (391)..(399): a, c, t, g, unknown or other
  misc_feature (391)..(399): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctggggacagacttcactctcaccatcagcagactggagcctgaagtattttgcagtgtattactgtcaggtctatggttactcacctcggttcagtctttggccagggggaccaaggtggagatacaaagaactgtgctgcaccatcctgtcttcactccttccccgctntctgagtagtgcgtctctgagcggctggacaggccgnatagnnnnnnnnn

SEQ ID NO: 298819 - DNA, 522 bp, Homo sapiens
  misc_feature: GZ8MTXP01DKWJT.3.11.A11.1.454.CMB.2.raw
  modified_base (312)..(312): a, c, t, g, unknown or other
  misc_feature (312)..(312): n is a, c, g, or t
  modified_base (446)..(446): a, c, t, g, unknown or other
  misc_feature (446)..(446): n is a, c, g, or t
  modified_base (455)..(455): a, c, t, g, unknown or other
  misc_feature (455)..(455): n is a, c, g, or t
  modified_base (467)..(467): a, c, t, g, unknown or other
  misc_feature (467)..(467): n is a, c, g, or t
  modified_base (469)..(469): a, c, t, g, unknown or other
  misc_feature (469)..(469): n is a, c, g, or t
  modified_base (471)..(471): a, c, t, g, unknown or other
  misc_feature (471)..(471): n is a, c, g, or t
  modified_base (477)..(477): a, c, t, g, unknown or other
  misc_feature (477)..(477): n is a, c, g, or t
  modified_base (498)..(498): a, c, t, g, unknown or other
  misc_feature (498)..(498): n is a, c, g, or t
  modified_base (502)..(503): a, c, t, g, unknown or other
  misc_feature (502)..(503): n is a, c, g, or t
  modified_base (505)..(508): a, c, t, g, unknown or other
  misc_feature (505)..(508): n is a, c, g, or t
  modified_base (510)..(510): a, c, t, g, unknown or other
  misc_feature (510)..(510): n is a, c, g, or t
  modified_base (512)..(512): a, c, t, g, unknown or other
  misc_feature (512)..(512): n is a, c, g, or t
  modified_base (515)..(515): a, c, t, g, unknown or other
  misc_feature (515)..(515): n is a, c, g, or t
  modified_base (517)..(517): a, c, t, g, unknown or other
  misc_feature (517)..(517): n is a, c, g, or t
  modified_base (520)..(520): a, c, t, g, unknown or other
  misc_feature (520)..(520): n is a, c, g, or t
  modified_base (522)..(522): a, c, t, g, unknown or other
  misc_feature (522)..(522): n is a, c, g, or t
tcagagacgcactccacgaccggtgctcgatttagctacgactgcaggggccagtgagactcgttagcagcagctacttagcctggtaccagcgaccaaacctggccaggcctcccgagtcctcctcatctttggtgcatccagcagggccctggcatcccagacaggttcagtggcagtggtctgggacagactttcactcgtcacatcagcagactggagcctgaagtattttgctagttgtatttacgtgtcaggtctatggtactcaacctggtacacgtactttggccaggggaccaaggtcggaanaattacgaaacgtaagtggtcggcttgcgtaccatcctgtattcgattccttacccgactaatcttgagtacgttcgaccgttctcctggacggccgggtcgtcgggacctaaaggggccgtataagttaaggngatatatanacgactatatanantntatcgngtgtacgacgagaagagaganaganngnnnncntnttntnttntn

SEQ ID NO: 298820 - DNA, 429 bp, Homo sapiens
  misc_feature: GZ8MTXP01C6EXF.3.11.A11.1.454.CMB.2.raw
  modified_base (352)..(352): a, c, t, g, unknown or other
  misc_feature (352)..(352): n is a, c, g, or t
  modified_base (399)..(429): a, c, t, g, unknown or other
  misc_feature (399)..(429): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcaggtgggtctgggacagacttcactctcacatcagcagactggagcctgaagtattttgctagtgtattactgtcaggtctatggttactcacctcggttcagtctttggccaggggaccaaggtggagaatacaaacgtactgtggctgcaccatcctgtcttcaatcctttccccgctntctgagtagtgcgtctcgtgagcgggctggcaaggcgacatagcagnnnnnnnnnnnnnnnnnnnnnnnnnnnnnnn

SEQ ID NO: 298821 - DNA, 399 bp, Homo sapiens
  misc_feature: GZ8MTXP01DT6AS.3.11.A11.1.454.CMB.2.raw
  modified_base (310)..(310): a, c, t, g, unknown or other
  misc_feature (310)..(310): n is a, c, g, or t
  modified_base (357)..(357): a, c, t, g, unknown or other
  misc_feature (357)..(357): n is a, c, g, or t
  modified_base (368)..(368): a, c, t, g, unknown or other
  misc_feature (368)..(368): n is a, c, g, or t
  modified_base (385)..(390): a, c, t, g, unknown or other
  misc_feature (385)..(390): n is a, c, g, or t
  modified_base (392)..(399): a, c, t, g, unknown or other
  misc_feature (392)..(399): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagtattttgcagtgtattactgtcaggtctatggtactcactcggtcagctttggacaggggaccaaggtcgagatacaaacgaactgnggctgcacatctgtcttcatccttcccgctaatctagagagtgcgtntctgagcgggntggacaggcgcaagtgnnnnnngnnnnnnnn

SEQ ID NO: 298822 - DNA, 383 bp, Homo sapiens
  misc_feature: GZ8MTXP01EA7VY.3.11.A11.1.454.CMB.2.raw
  modified_base (308)..(308): a, c, t, g, unknown or other
  misc_feature (308)..(308): n is a, c, g, or t
  modified_base (321)..(321): a, c, t, g, unknown or other
  misc_feature (321)..(321): n is a, c, g, or t
  modified_base (326)..(326): a, c, t, g, unknown or other
  misc_feature (326)..(326): n is a, c, g, or t
  modified_base (340)..(340): a, c, t, g, unknown or other
  misc_feature (340)..(340): n is a, c, g, or t
  modified_base (347)..(347): a, c, t, g, unknown or other
  misc_feature (347)..(347): n is a, c, g, or t
  modified_base (363)..(363): a, c, t, g, unknown or other
  misc_feature (363)..(363): n is a, c, g, or t
  modified_base (373)..(373): a, c, t, g, unknown or other
  misc_feature (373)..(373): n is a, c, g, or t
  modified_base (377)..(383): a, c, t, g, unknown or other
  misc_feature (377)..(383): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagtatttgctagtgtattactgtcaggtctagtgtactcactcggtcagtcttggacgaggggacaaggtgagatacgaaagactgngctgcacatcctntcttnacttcctcccgctntctgagntgctctcgtgagcggntggacaggcntagnnnnnnn

SEQ ID NO: 298823 - DNA, 394 bp, Homo sapiens
  misc_feature: GZ8MTXP01ALS85.3.11.A11.1.454.CMB.2.raw
  modified_base (344)..(344): a, c, t, g, unknown or other
  misc_feature (344)..(344): n is a, c, g, or t
  modified_base (362)..(362): a, c, t, g, unknown or other
  misc_feature (362)..(362): n is a, c, g, or t
  modified_base (387)..(394): a, c, t, g, unknown or other
  misc_feature (387)..(394): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagtattttgcagtgtattactgtcaggtctatggttactcactcggttcagtctttggccaggggaccaaggtggagatacaaacgaactgtaggctgcacatcctgtctcatcttcccgctntctgagagtgcgtctcgngagcgggctggcaaggcgcataggnnnnnnnn

SEQ ID NO: 298824 - DNA, 390 bp, Homo sapiens
  misc_feature: GZ8MTXP01C2WW3.3.11.A11.1.454.CMB.2.raw
  modified_base (342)..(342): a, c, t, g, unknown or other
  misc_feature (342)..(342): n is a, c, g, or t
  modified_base (384)..(390): a, c, t, g, unknown or other
  misc_feature (384)..(390): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacctcactctcaccatcagcagactggagcctgaagattttgcagtgtattactgtcaggtctatggttactcacctcgttcagtctttggccaggggaccaaggtggagatacaaacgaactgtgctgcacatcctgtcttcatccttcccgcntctgagagtgcgtctcgtgagcgggctggcaaggcacatagnnnnnnn

SEQ ID NO: 298825 - DNA, 417 bp, Homo sapiens
  misc_feature: GZ8MTXP01C9A5X.3.11.A11.1.454.CMB.2.raw
  modified_base (399)..(399): a, c, t, g, unknown or other
  misc_feature (399)..(399): n is a, c, g, or t
  modified_base (403)..(403): a, c, t, g, unknown or other
  misc_feature (403)..(403): n is a, c, g, or t
  modified_base (405)..(417): a, c, t, g, unknown or other
  misc_feature (405)..(417): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcaggtgggtctgggacagacttcactctcaccatcagcagactggagcctgaagtattttgctagtgttattactgtcaggtctatggttactctacctcggttcagtctttggccgtaggggaccaaggtcggaagatacaaacgaactgtggctgcacatcctgtcttcactccttcccgctaatctgacgtagtgcgttctcgtgacggcgggctggacaagggcnaagngnnnnnnnnnnnnn

SEQ ID NO: 298826 - DNA, 444 bp, Homo sapiens
  misc_feature: GZ8MTXP01CVNVO.3.11.A11.1.454.CMB.2.raw
  modified_base (341)..(341): a, c, t, g, unknown or other
  misc_feature (341)..(341): n is a, c, g, or t
  modified_base (424)..(424): a, c, t, g, unknown or other
  misc_feature (424)..(424): n is a, c, g, or t
  modified_base (430)..(444): a, c, t, g, unknown or other
  misc_feature (430)..(444): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcggtggcaggtgggtctgggacagacttcactctcaccatcagcagactggacgcctagaagtattttgctagtgtattactgtcaggtctagtggttactctaccgttcggttcagtcgtttcggaccgaaggggaccgaaggtggagtactacgaaacgactggtggctgcactntctcgtcttcattcctcccgacatcgtagagtagtcgtccgtctcgtgggacgggtcgggtcgtcgggacgaaacgggccganaagtgnnnnnnnnnnnnnnn

SEQ ID NO: 298827 - DNA, 405 bp, Homo sapiens
  misc_feature: GZ8MTXP01BRWXH.3.11.A11.1.454.CMB.2.raw
  modified_base (351)..(351): a, c, t, g, unknown or other
  misc_feature (351)..(351): n is a, c, g, or t
  modified_base (399)..(405): a, c, t, g, unknown or other
  misc_feature (399)..(405): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatccccagacaggttcagtggcagtgggtctgggacagacttcactctcaccatcagcagactggagcctgaagtattttgcagtgtattactgtcaggtctatggttactcacctcggttcagtctttggcccgagggggaccaagggtggagatcaaacgaactgtggctgcacctatcctgtcttcatccttcccgcntcctgagagtcgtcgttctggagcgggctgggctaagggcgacatagnnnnnnn

SEQ ID NO: 298828 - DNA, 417 bp, Homo sapiens
  misc_feature: GZ8MTXP01B0ZUS.3.11.A11.1.454.CMB.2.raw
  modified_base (385)..(385): a, c, t, g, unknown or other
  misc_feature (385)..(385): n is a, c, g, or t
  modified_base (406)..(417): a, c, t, g, unknown or other
  misc_feature (406)..(417): n is a, c, g, or t
tcagagacgcactccacgaccggtgctcgatttagctacgactgcagggccagtgagactgttagcagcagctacttagcctggtaccagcacaaacctgaccaggctcccagtctcctcatctttggtgcatccagcagggcccctggcatcccagacaggttcagtggcagtgggtctgggacagacttcactctcaccatcagcagactggagcctgaagtattttgcagttgtattactgtcaggtctatggttactcacctcggttcagtctttggccgaggggaccaaggtggagatacaaacgaactggtggctgcaccatcctgtcttcactccttaccccgctaatcctgagacgtgcgtctcgtgtacggcgggngtgggacaagggcgacatagnnnnnnnnnnnn

SEQ ID NO: 298829 - DNA, 396 bp, Homo sapiens
  misc_feature: GZ8MTXP01EHOKX.3.11.A11.1.454.CMB.2.raw
  modified_base (349)..(349): a, c, t, g, unknown or other
  misc_feature (349)..(349): n is a, c, g, or t
  modified_base (375)..(375): a, c, t, g, unknown or other
  misc_feature (375)..(375): n is a, c, g, or t
  modified_base (387)..(387): a, c, t, g, unknown or other
  misc_feature (387)..(387): n is a, c, g, or t
  modified_base (391)..(396): a, c, t, g, unknown or other
  misc_feature (391)..(396): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcaggtgggtctgggacagacttcactctcaccatcagcagactggagcctagaagtattttgctagtgtattactgtcaggtctatggttactcacctcggttcagtctttggccgaggggaccaaggtggagatacgaaacgactggtgctgcacatcctgtcttcattcctcccgcntctgagtgtgcgtctcgtgagcgggntgggcaaggcgnatgnnnnnn

SEQ ID NO: 298830 - DNA, 402 bp, Homo sapiens
  misc_feature: GZ8MTXP01CTQJC.3.11.A11.1.454.CMB.2.raw
  modified_base (313)..(313): a, c, t, g, unknown or other
  misc_feature (313)..(313): n is a, c, g, or t
  modified_base (316)..(316): a, c, t, g, unknown or other
  misc_feature (316)..(316): n is a, c, g, or t
  modified_base (392)..(402): a, c, t, g, unknown or other
  misc_feature (392)..(402): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagtattttgctagtgtattactgtcaggtctatggttactcacctcggttcagtctttggccaggggaccaaggtggagatacaaacgatgnggntgcacatcctgtcttcatccttacccgcaatctgagatcgctctctgagcgggtctgggacaagggcgacagtagnnnnnnnnnnn

SEQ ID NO: 298831 - DNA, 452 bp, Homo sapiens
  misc_feature: GZ8MTXP01D4J6A.3.11.A11.1.454.CMB.2.raw
  modified_base (439)..(439): a, c, t, g, unknown or other
  misc_feature (439)..(439): n is a, c, g, or t
  modified_base (441)..(446): a, c, t, g, unknown or other
  misc_feature (441)..(446): n is a, c, g, or t
  modified_base (448)..(452): a, c, t, g, unknown or other
  misc_feature (448)..(452): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcacgggcccctggcatcccagacaggttcagtggcaggtgggtctgggacagacttcactctcaccatcagcagactggagcctagaagtattttgctagttgttattactgtcaggtctatggttactctaccgtcggtcagtcgtttggccgtaggggaccaagggtgaagtaatacgaaaacgtaacgtgtcggctagactaccgtattcctgtcttctacttcccttaaccccgctaatccgtagagtacgtcgtcgtctcgtagacggcgggtcgtgggacgaagggccacgtaagngnnnnnngnnnnn

SEQ ID NO: 298832 - DNA, 396 bp, Homo sapiens
  misc_feature: GZ8MTXP01BILWJ.3.11.A11.1.454.CMB.2.raw
  modified_base (345)..(345): a, c, t, g, unknown or other
  misc_feature (345)..(345): n is a, c, g, or t
  modified_base (371)..(371): a, c, t, g, unknown or other
  misc_feature (371)..(371): n is a, c, g, or t
  modified_base (389)..(396): a, c, t, g, unknown or other
  misc_feature (389)..(396): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagtattttgctagtgtattactgtcaggtctatggttactcactcggttcagtctttggccaggggaccaagggtggagatcaaacgactgtggctgcacgatcctgtcttcatccttcccgcntctgagcgtgcgtctctgagcgggtntgggctaaggcgcatagnnnnnnnn

SEQ ID NO: 298833 - DNA, 395 bp, Homo sapiens
  misc_feature: GZ8MTXP01ALUJ7.3.11.A11.1.454.CMB.2.raw
  modified_base (346)..(346): a, c, t, g, unknown or other
  misc_feature (346)..(346): n is a, c, g, or t
  modified_base (349)..(349): a, c, t, g, unknown or other
  misc_feature (349)..(349): n is a, c, g, or t
  modified_base (356)..(356): a, c, t, g, unknown or other
  misc_feature (356)..(356): n is a, c, g, or t
  modified_base (363)..(363): a, c, t, g, unknown or other
  misc_feature (363)..(363): n is a, c, g, or t
  modified_base (390)..(395): a, c, t, g, unknown or other
  misc_feature (390)..(395): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagtattttgcagtgtattactgtcaggtctatggtactcacctcggttcagtctttggccagggggtaccaaaggtggagatacgaaacgactgtggcttgcacatctgtctcactccgttcccnccntctgacngtgcgtntactgagcgggctggcaaggcgcatgnnnnnn

SEQ ID NO: 298834 - DNA, 394 bp, Homo sapiens
  misc_feature: GZ8MTXP01CXIAO.3.11.A11.1.454.CMB.2.raw
  modified_base (351)..(351): a, c, t, g, unknown or other
  misc_feature (351)..(351): n is a, c, g, or t
  modified_base (382)..(382): a, c, t, g, unknown or other
  misc_feature (382)..(382): n is a, c, g, or t
  modified_base (388)..(394): a, c, t, g, unknown or other
  misc_feature (388)..(394): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagtatttgctagttgtattactgtcaggtctatggttactcactcggttcagtctttggccaggggaccaaggtggagatacgaaacgaactgtggctgcacatcctgtctcatctcccgcaatctgagngtgcgtctcgtgagcgggctggacgaaggcncaatgnnnnnnn

SEQ ID NO: 298835 - DNA, 552 bp, Homo sapiens
  misc_feature: GZ8MTXP01ASB1T.3.11.A11.1.454.CMB.2.raw
  modified_base (231)..(231): a, c, t, g, unknown or other
  misc_feature (231)..(231): n is a, c, g, or t
  modified_base (531)..(532): a, c, t, g, unknown or other
  misc_feature (531)..(532): n is a, c, g, or t
  modified_base (534)..(538): a, c, t, g, unknown or other
  misc_feature (534)..(538): n is a, c, g, or t
  modified_base (540)..(552): a, c, t, g, unknown or other
  misc_feature (540)..(552): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacagggttcggtggcaggtggtcgtgggacagtacttcactctcacatcagcagacgtggacgcctagaagttntttgctagttgttattacgtgtacgtaggttcttagtcggttactccgtaccgttcggttctaggtcggtttacgggaccggtaaacgggggaaccgtaaaggggtagggaaacgtacgtaaacgaaaacggtacgtgggtacggtctacgacctaacctattccgttacgttcctttacactttccccgtacccgtaacctaagttccgtagggtacggtacggttcggtcgttctcgggtacgggacggggtccggggacggttacggggaaccgaaacggggccgtaaacgtagtgnngnnnnngnnnnnnnnnnnnn

SEQ ID NO: 298836 - DNA, 409 bp, Homo sapiens
  misc_feature: GZ8MTXP01AUCAU.3.11.A11.1.454.CMB.2.raw
  modified_base (343)..(343): a, c, t, g, unknown or other
  misc_feature (343)..(343): n is a, c, g, or t
  modified_base (392)..(392): a, c, t, g, unknown or other
  misc_feature (392)..(392): n is a, c, g, or t
  modified_base (398)..(409): a, c, t, g, unknown or other
  misc_feature (398)..(409): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagtattttgctagtgtattactgtcaggtctatggttactcacctcggtcagtcttggcaggggaccaaggtggagatacgaaacgactgtggctgcacatctgtctcactccttcccgctntctgagtacgtgcgtctcgtggacggcgggactcgggacgaaggccganaagtgnnnnnnnnnnnn

SEQ ID NO: 298837 - DNA, 476 bp, Homo sapiens
  misc_feature: GZ8MTXP01C7RZ1.3.11.A11.1.454.CMB.2.raw
  modified_base (215)..(215): a, c, t, g, unknown or other
  misc_feature (215)..(215): n is a, c, g, or t
  modified_base (455)..(455): a, c, t, g, unknown or other
  misc_feature (455)..(455): n is a, c, g, or t
  modified_base (457)..(461): a, c, t, g, unknown or other
  misc_feature (457)..(461): n is a, c, g, or t
  modified_base (463)..(476): a, c, t, g, unknown or other
  misc_feature (463)..(476): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcacatcagcagactggancctgaagtattttgcagtgtattactgtcaggtctatggttactcaccttcggttcagtctttggccgagggggaccaaggtggaagaatacgaaaacgaacgttgacggctgcaccattcctgttacttcaacttccctttaccccgcctaagttcctagaagggtacgtcggtccgttcgtccgttgggacgggccggggtccgtggggacccgaaaggggcccggactaaagtaggngnnnnngnnnnnnnnnnnnnn

SEQ ID NO: 298838 - DNA, 417 bp, Homo sapiens
  misc_feature: GZ8MTXP01CD3KD.3.11.A11.1.454.CMB.2.raw
  modified_base (413)..(417): a, c, t, g, unknown or other
  misc_feature (413)..(417): n is a, c, g, or t
tcagagacgcactccacgaccggtgctcgatttagctacgactgcagggccatgggggggggggggggggggggggggggggggaactgttagcagcagctacttagcctggtaccagcacaaacctggccaggctcccagtctcctcatctttggtgcatccagcagggcccctggcatcccagacaggttcagtggcaggtgggtctgggacagacttcactctcaccatcagcagactggagcctgaagtattttgcagtgtattactgtcaggtctatggttactcacctggttcagctttggccaggggaccaaggtgagatcaaacgaactgtgctgcacatcctgtcttcatcttcccgcctaatctgagagtgcgtctctgagtcgggctggcaaggcgcatagnnnnn

SEQ ID NO: 298839 - DNA, 436 bp, Homo sapiens
  misc_feature: GZ8MTXP01C57FS.3.11.A11.1.454.CMB.2.raw
  modified_base (216)..(216): a, c, t, g, unknown or other
  misc_feature (216)..(216): n is a, c, g, or t
  modified_base (314)..(314): a, c, t, g, unknown or other
  misc_feature (314)..(314): n is a, c, g, or t
  modified_base (347)..(347): a, c, t, g, unknown or other
  misc_feature (347)..(347): n is a, c, g, or t
  modified_base (416)..(421): a, c, t, g, unknown or other
  misc_feature (416)..(421): n is a, c, g, or t
  modified_base (423)..(436): a, c, t, g, unknown or other
  misc_feature (423)..(436): n is a, c, g, or t
tcagagacgcactccacgaccggtgctcgattttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcacatcagcagactggancctgaagtatttgcagtgtattactgtcaggtcatggttactcacctcggttcagctttggccagggggaccaagggtggagatacgaaacgaactgngctgccacatcctgtcttcactccttccccgcntctagacggagtcgcgttctcttggaggccggggtacgtgggaccgaaaggggccgcgtaagttacggnnnnnngnnnnnnnnnnnnnn

SEQ ID NO: 298840 - DNA, 419 bp, Homo sapiens
  misc_feature: GZ8MTXP01AF3E6.3.11.A11.1.454.CMB.2.raw
  modified_base (357)..(357): a, c, t, g, unknown or other
  misc_feature (357)..(357): n is a, c, g, or t
  modified_base (364)..(364): a, c, t, g, unknown or other
  misc_feature (364)..(364): n is a, c, g, or t
  modified_base (405)..(405): a, c, t, g, unknown or other
  misc_feature (405)..(405): n is a, c, g, or t
  modified_base (410)..(419): a, c, t, g, unknown or other
  misc_feature (410)..(419): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcaggtgggtctgggacagacttcactctcaccatcagcagactggagcctagaagtattttgctagttgtattactgtcaggtctatggttactctacctcggttcagtcgtttggaccgagggggaccaagggtggaagatacgaaacgactgtggctgcacatcctgtcttcatccttcccgctntctgagngtcgcgtctacgtggacggcgggctgggaccaagggccganaatgnnnnnnnnnn

SEQ ID NO: 298841 - DNA, 400 bp, Homo sapiens
  misc_feature: GZ8MTXP01DEJDR.3.11.A11.1.454.CMB.2.raw
  modified_base (315)..(315): a, c, t, g, unknown or other
  misc_feature (315)..(315): n is a, c, g, or t
  modified_base (346)..(346): a, c, t, g, unknown or other
  misc_feature (346)..(346): n is a, c, g, or t
  modified_base (363)..(363): a, c, t, g, unknown or other
  misc_feature (363)..(363): n is a, c, g, or t
  modified_base (375)..(375): a, c, t, g, unknown or other
  misc_feature (375)..(375): n is a, c, g, or t
  modified_base (380)..(380): a, c, t, g, unknown or other
  misc_feature (380)..(380): n is a, c, g, or t
  modified_base (392)..(400): a, c, t, g, unknown or other
  misc_feature (392)..(400): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcacatcagcagactggagcctagaagtatttgcagttgtattactgtcaggtctatggttactcacctcggttcagtctttggccgaggggaccaaggtggagaatacaaacgactgnggctgcacatcctgtctcactcctcccgctntctgagtagtcgcgtcncgtgaggcgggntcggnaaggcgcatagnnnnnnnnn

SEQ ID NO: 298842 - DNA, 395 bp, Homo sapiens
  misc_feature: GZ8MTXP01D937A.3.11.A11.1.454.CMB.2.raw
  modified_base (328)..(328): a, c, t, g, unknown or other
  misc_feature (328)..(328): n is a, c, g, or t
  modified_base (338)..(338): a, c, t, g, unknown or other
  misc_feature (338)..(338): n is a, c, g, or t
  modified_base (346)..(346): a, c, t, g, unknown or other
  misc_feature (346)..(346): n is a, c, g, or t
  modified_base (386)..(395): a, c, t, g, unknown or other
  misc_feature (386)..(395): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagtattttgcagtgtattactgtcaggtctatggttactcactcggttcagtctttggccaggggaccaaggtgagatcaaacgactgtggctgcacatcctgtctnatcttcccgntaatctgngagtgcgtctctgagcgggctgggcaagggtcgacatagnnnnnnnnnn

SEQ ID NO: 298843 - DNA, 401 bp, Homo sapiens
  misc_feature: GZ8MTXP01ADTV7.3.11.A11.1.454.CMB.2.raw
  modified_base (392)..(392): a, c, t, g, unknown or other
  misc_feature (392)..(392): n is a, c, g, or t
  modified_base (394)..(394): a, c, t, g, unknown or other
  misc_feature (394)..(394): n is a, c, g, or t
  modified_base (396)..(401): a, c, t, g, unknown or other
  misc_feature (396)..(401): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagtattttgctagtgtattactgtcaggtctatggttactcacctcggttcagtctttggccaggggaccaaggtgagatcaaacgactgtgctgcaccatcctgtcttcacttccttcccgccaatcctagagtagtgcgtctacgtgaggcgggctgggcaaggccganangnnnnnn

SEQ ID NO: 298844 - DNA, 411 bp, Homo sapiens
  misc_feature: GZ8MTXP01C2SHQ.3.11.A11.1.454.CMB.2.raw
  modified_base (402)..(411): a, c, t, g, unknown or other
  misc_feature (402)..(411): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcaggtgggtctgggacagacttcactctcacatcagcagactggagcctagaagtatttgctagtgtattactgtcaggtctatggttactcacctggctcagtctttggccgaggggaccaagggtggaagatacgaaacgactgtggctgcaccatctgtcttcacttcccttcccgctatctagagagtcgcgtctcgtgacggtcgggctggacgaaggcgacatagnnnnnnnnnn

SEQ ID NO: 298845 - DNA, 388 bp, Homo sapiens
  misc_feature: GZ8MTXP01EJB4Y.3.11.A11.1.454.CMB.2.raw
  modified_base (218)..(218): a, c, t, g, unknown or other
  misc_feature (218)..(218): n is a, c, g, or t
  modified_base (383)..(388): a, c, t, g, unknown or other
  misc_feature (383)..(388): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcaggtgggtctggggacagacttcactctcaccatcagcagactggancctgaagtattttgcagtgtattactgtcaggtctatggttactcactcggtcagtcttggccaggggaccaaggtgagatacaaagactgtgctgcacatcctgtctcatcttacccgctaatctgagtagtcgcgtctcgtgagcggctggcaaggcgcatgnnnnnn

SEQ ID NO: 298846 - DNA, 408 bp, Homo sapiens
  misc_feature: GZ8MTXP01C10C2.3.11.A11.1.454.CMB.2.raw
  modified_base (217)..(217): a, c, t, g, unknown or other
  misc_feature (217)..(217): n is a, c, g, or t
  modified_base (313)..(313): a, c, t, g, unknown or other
  misc_feature (313)..(313): n is a, c, g, or t
  modified_base (347)..(347): a, c, t, g, unknown or other
  misc_feature (347)..(347): n is a, c, g, or t
  modified_base (366)..(366): a, c, t, g, unknown or other
  misc_feature (366)..(366): n is a, c, g, or t
  modified_base (395)..(395): a, c, t, g, unknown or other
  misc_feature (395)..(395): n is a, c, g, or t
  modified_base (401)..(408): a, c, t, g, unknown or other
  misc_feature (401)..(408): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcaggtgggtctgggacagacttcactctcaccatcagcagactggancctgaagtatttgcagtgtattactgtcaggtctatggttactcacctcggttcagtctttggccgaggggaccaagggtgagatacaaagactgngctgcacatcctgtcttctatcccttccccgctntctgacgtagtcgcgttcnctgaggcgggctgggaccgaaggggccanaagtgnnnnnnnn

SEQ ID NO: 298847 - DNA, 423 bp, Homo sapiens
  misc_feature: GZ8MTXP01EID65.3.11.A11.1.454.CMB.2.raw
  modified_base (413)..(423): a, c, t, g, unknown or other
  misc_feature (413)..(423): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcaggtgggtctggggacagacttcactctcaccatcagcagactggagcctgaagtattttgctagttgtattactgtcaggtctattggttactcaccttcggttcaggtctttggaccgagggggaccaagggtggagatacaaacgactgtggctgcacattcctgtcttcattccctccccgctctctagagagtgcgtctcgtggacgcggggtctgggacgaagggccgactagcgnnnnnnnnnnn

SEQ ID NO: 298848 - DNA, 410 bp, Homo sapiens
  misc_feature: GZ8MTXP01B1A7J.3.11.A11.1.454.CMB.2.raw
  modified_base (399)..(399): a, c, t, g, unknown or other
  misc_feature (399)..(399): n is a, c, g, or t
  modified_base (401)..(405): a, c, t, g, unknown or other
  misc_feature (401)..(405): n is a, c, g, or t
  modified_base (407)..(410): a, c, t, g, unknown or other
  misc_feature (407)..(410): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatccccagacaggttcagtggcagtgggtctgggacagacttcactctcaccatcagcagactggagcctgaagtattttgctagtgtattactgtcaggtctatggttactcacctcggttcagctttggccaggggaccaaggtggagatcaaacgactgtgctgcacatcctgtctcatccttccccgctaatctgagtagtgcgttctcgtgaggcggggctgggacaagggccgactagtaggngnnnnngnnnn

SEQ ID NO: 298849 - DNA, 432 bp, Homo sapiens
  misc_feature: GZ8MTXP01B6BCU.3.11.A11.1.454.CMB.2.raw
  modified_base (358)..(358): a, c, t, g, unknown or other
  misc_feature (358)..(358): n is a, c, g, or t
  modified_base (363)..(363): a, c, t, g, unknown or other
  misc_feature (363)..(363): n is a, c, g, or t
  modified_base (420)..(432): a, c, t, g, unknown or other
  misc_feature (420)..(432): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagtattttgctagttgtattactgtcaggttctatggttactcacttcggttcagtctttggccaggggacccaagggtggaagtatacaaacgactggtggtctgcacagtcctgtcttcacttccttaccccgcngttcnggaagtcgtgcgttctacgttggagcggggtctgggactaaggggccgcgaagtagnnnnnnnnnnnnn

SEQ ID NO: 298850 - DNA, 439 bp, Homo sapiens
  misc_feature: GZ8MTXP01ALWBV.3.11.A11.1.454.CMB.2.raw
  modified_base (372)..(372): a, c, t, g, unknown or other
  misc_feature (372)..(372): n is a, c, g, or t
  modified_base (421)..(421): a, c, t, g, unknown or other
  misc_feature (421)..(421): n is a, c, g, or t
  modified_base (427)..(432): a, c, t, g, unknown or other
  misc_feature (427)..(432): n is a, c, g, or t
  modified_base (434)..(439): a, c, t, g, unknown or other
  misc_feature (434)..(439): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagctagaagtattttgctagtgtattactgtacaggtctagtggttactcaccttcggttcagtctttggaccgaggggaccaagggtggaagactacgaaaacgtacttggtgctcgacacctagttcccttgttacttcacttccttacccgcctntcgtgagtagtcgtcgtcgtcgtgagtcgggcgtggacgaaggtccganagtagnnnnnngnnnnnn

SEQ ID NO: 298851 - DNA, 450 bp, Homo sapiens
  misc_feature: GZ8MTXP01AK7F5.3.11.A11.1.454.CMB.2.raw
  modified_base (436)..(436): a, c, t, g, unknown or other
  misc_feature (436)..(436): n is a, c, g, or t
  modified_base (443)..(450): a, c, t, g, unknown or other
  misc_feature (443)..(450): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcaggtgggtctgggacagacttcactctcaccatcagcagactggagcctgaagtattttgctagtgtattactgtcaggtctatggttactcaccgtcggttcagtctttggccgagggggaccaaggggtggaagactacgaaacgtacgtggtcggcttcgctactattccgtcgttacttactacttcccttccccgacctaagtccgtaggagtacgtgtccgtctcgtcgggacggcggggtcgtgggacgaagggccgntaagtgnnnnnnnn

SEQ ID NO: 298852 - DNA, 492 bp, Homo sapiens
  misc_feature: GZ8MTXP01DB3VC.3.11.A11.1.454.CMB.2.raw
  modified_base (450)..(450): a, c, t, g, unknown or other
  misc_feature (450)..(450): n is a, c, g, or t
  modified_base (472)..(477): a, c, t, g, unknown or other
  misc_feature (472)..(477): n is a, c, g, or t
  modified_base (479)..(492): a, c, t, g, unknown or other
  misc_feature (479)..(492): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcacgggccccctggcatcccagacaggttcagtggcaggttggtctgggacagacttcactctcaccatcagcagactggagcctagaagtattttgctagttgtattactgtcaggttctagttcggtactctaccgttcggttcagtcgtttggaccgtagggggaacctaaggggtggaagtaatacgaaacgtaccttggtcggcttcgaccaccgtacttcccgttacgtttcttcgtaccttcccgtttacccccgactgttccgtagaacggtcgttcgcgttcgtacgtggacggcgggttacgngggacaagggccgtatagacgnnnnnngnnnnnnnnnnnnnn

SEQ ID NO: 298853 - DNA, 454 bp, Homo sapiens
  misc_feature: GZ8MTXP01BUYOM.3.11.A11.1.454.CMB.2.raw
  modified_base (220)..(220): a, c, t, g, unknown or other
  misc_feature (220)..(220): n is a, c, g, or t
  modified_base (441)..(441): a, c, t, g, unknown or other
  misc_feature (441)..(441): n is a, c, g, or t
  modified_base (443)..(454): a, c, t, g, unknown or other
  misc_feature (443)..(454): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggccccctggcatcccagacaggttcagtggcaggtgggtctggggacagtacttcactctcaccatcagcagactggancctgaagtattttgctagttgtattacgtgtcgaggtctagtcggttactctaccgttcggttcagtcgtttggaccgtaggggaaccaagggtggagtaatacgaaacgaactggtggctgcacgatcctgtcttctacgttcccttacccgcctaagtctaggacgtgtcggtcgttcgtcgtggaggccgggtcgtcgggaccgaacgggcgataagngnnnnnnnnnnnn

SEQ ID NO: 298854 - DNA, 422 bp, Homo sapiens
  misc_feature: GZ8MTXP01BTQI3.3.11.A11.1.454.CMB.2.raw
  modified_base (325)..(325): a, c, t, g, unknown or other
  misc_feature (325)..(325): n is a, c, g, or t
  modified_base (343)..(343): a, c, t, g, unknown or other
  misc_feature (343)..(343): n is a, c, g, or t
  modified_base (356)..(356): a, c, t, g, unknown or other
  misc_feature (356)..(356): n is a, c, g, or t
  modified_base (363)..(363): a, c, t, g, unknown or other
  misc_feature (363)..(363): n is a, c, g, or t
  modified_base (376)..(376): a, c, t, g, unknown or other
  misc_feature (376)..(376): n is a, c, g, or t
  modified_base (409)..(422): a, c, t, g, unknown or other
  misc_feature (409)..(422): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcaggtgggtctgggacagacttcactctcaccatcagcagactggagcctagaagtattttgctagttgtattacgtgtctaggttctattggttactctaccgttcggttcagtcgtttggccgaggggaccaaggtgagatacaaacgactgnggctgcacatctgtctcnctcctacccgctntctgagngtcgtcgtctcgnggagccgggtacgtgggacgaagggcacagtgnnnnnnnnnnnnnn

SEQ ID NO: 298855 - DNA, 384 bp, Homo sapiens
  misc_feature: GZ8MTXP02FRE7B.3.11.A11.1.454.CMB.2.raw
  modified_base (381)..(384): a, c, t, g, unknown or other
  misc_feature (381)..(384): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagatttgcagtgtattactgtcaggtctatggttactcacctcggttcagctttggccaggggaccaaggtggagatcaaacgaactgtggctgcaccatcctgtctcatcttcccgcatctgagagtgcgtctctgagcgggctggcaaggcgcatagnnnn

SEQ ID NO: 298856 - DNA, 383 bp, Homo sapiens
  misc_feature: GZ8MTXP02GAWVO.3.11.A11.1.454.CMB.2.raw
  modified_base (338)..(338): a, c, t, g, unknown or other
  misc_feature (338)..(338): n is a, c, g, or t
  modified_base (344)..(344): a, c, t, g, unknown or other
  misc_feature (344)..(344): n is a, c, g, or t
  modified_base (379)..(383): a, c, t, g, unknown or other
  misc_feature (379)..(383): n is a, c, g, or t
tcagagacgcactccacgaccggtgctcgatttagctacgactgcaggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagattttgcagtgtattactgtcaggtctatggtactcactcggttcagctttggccaggggaccaaggtggagatcaaacgactgtggctgcaccatcctgtcttcatcttcccgcntctganagtgcgtctctgagcggctgggcaaggcgcatagnnnnn

SEQ ID NO: 298857 - DNA, 382 bp, Homo sapiens
  misc_feature: GZ8MTXP02FVNUC.3.11.A11.1.454.CMB.2.raw
  modified_base (380)..(382): a, c, t, g, unknown or other
  misc_feature (380)..(382): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagatttgcagtgtattactgtcaggtctatggtactcactcggttcagctttggccaggggaccaaggtggagatcaaaacgaactgtggctgcacatcctgtcttcatcttcccgcatctgagagtgcgtctctgagcgggctggcaaggcgcatagnnn

SEQ ID NO: 298858 - DNA, 379 bp, Homo sapiens
  misc_feature: GZ8MTXP02JP20N.3.11.A11.1.454.CMB.2.raw
  modified_base (340)..(340): a, c, t, g, unknown or other
  misc_feature (340)..(340): n is a, c, g, or t
  modified_base (362)..(362): a, c, t, g, unknown or other
  misc_feature (362)..(362): n is a, c, g, or t
  modified_base (373)..(373): a, c, t, g, unknown or other
  misc_feature (373)..(373): n is a, c, g, or t
  modified_base (375)..(379): a, c, t, g, unknown or other
  misc_feature (375)..(379): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagattttgcagtgtattactgtcaggtctatggttactcacctcggttcagctttggccaggggaccaaggtggagatcaaacgaactgtgctgcacatcctgtcttcatcttcccgcntctgagagtgcgtctgagcggntggcaaggcgnannnnn

SEQ ID NO: 298859 - DNA, 386 bp, Homo sapiens
  misc_feature: GZ8MTXP02G2DXQ.3.11.A11.1.454.CMB.2.raw
  modified_base (341)..(341): a, c, t, g, unknown or other
  misc_feature (341)..(341): n is a, c, g, or t
  modified_base (382)..(386): a, c, t, g, unknown or other
  misc_feature (382)..(386): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagattttgcagtgtattactgtcaggtctatggttactcacctcggtcagctttggccaggggaccaaggtcggagatcaaaagactgtggctgcacatccctgtcttcatcttcccgcntctgagagtgcgtctctgagcgggctggcaaggcgcatagnnnnn

SEQ ID NO: 298860 - DNA, 432 bp, Homo sapiens
  misc_feature: GZ8MTXP02G4UH3.3.11.A11.1.454.CMB.2.raw
  modified_base (400)..(400): a, c, t, g, unknown or other
  misc_feature (400)..(400): n is a, c, g, or t
  modified_base (409)..(432): a, c, t, g, unknown or other
  misc_feature (409)..(432): n is a, c, g, or t
tcagagacgcactccacgaccggtgctcgatttagctacgactgcagggccagtgagactgttagcagcagctacttagcctggtaccagcaccaaacctggccaggctcccagtctcctcatctttggtgcatccagcagggcccctggcatcccagacaggttcagtggcagtgggtctgggacagacttcactcgtcaccatcagcagactggagcctgaagtattttgctagtgtattactgtcaggtctatggttactcacctcggttcagtctttggccaggggaccaagggtggagatacaaaacgactggtgctgacacatcctgtccttcacttccttcccgcatcctgacgagtcgcgttctcgtgaggccgggtctgggacaaggggcnctaagtagnnnnnnnnnnnnnnnnnnnnnnnn

SEQ ID NO: 298861 - DNA, 433 bp, Homo sapiens
  misc_feature: GZ8MTXP02IJ7O5.3.11.A11.1.454.CMB.2.raw
  modified_base (350)..(350): a, c, t, g, unknown or other
  misc_feature (350)..(350): n is a, c, g, or t
  modified_base (400)..(431): a, c, t, g, unknown or other
  misc_feature (400)..(431): n is a, c, g, or t
  modified_base (433)..(433): a, c, t, g, unknown or other
  misc_feature (433)..(433): n is a, c, g, or t
tcagagacgcactccacgaccggtgctcgatttagctacgactgcagggccgagtgagactgttagcagcagctacttagcctggtaccagcacaaacctggccaggctcccagtctcctcatctttggttgcatccagcagggcccctggcatcccagacaggttcagtggcagtgggtctggggacaggacttcactctcaccatcagcagactggagcctgaagattttgcagtgtattactgtcaggtctatggttactcacctcggttcagctttggccaggggacccaaggtcggagagtacaaacgaaactgtggctgcacatcctgtcttcatcttccgccntctgagagtgcgtctctgagcgggactggactaaagggcgaccaattagnnnnnnnnnnnnnnnnnnnnnnnnnnnnnnnncn

SEQ ID NO: 298862 - DNA, 388 bp, Homo sapiens
  misc_feature: GZ8MTXP02HJNQL.3.11.A11.1.454.CMB.2.raw
  modified_base (340)..(340): a, c, t, g, unknown or other
  misc_feature (340)..(340): n is a, c, g, or t
  modified_base (383)..(388): a, c, t, g, unknown or other
  misc_feature (383)..(388): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagattttgcagtgtattactgtcaggtctatggttactcactcggttcagctttggccaggggaccaaggtggagatcaaacgactgtggctgcaccatcctgtcttcatcttcccgcntctgagagtgcgtctctgagcgggctggcaaggcgacgatagnnnnnn

SEQ ID NO: 298863 - DNA, 386 bp, Homo sapiens
  misc_feature: GZ8MTXP02FZ81G.3.11.A11.1.454.CMB.2.raw
  modified_base (341)..(341): a, c, t, g, unknown or other
  misc_feature (341)..(341): n is a, c, g, or t
  modified_base (382)..(386): a, c, t, g, unknown or other
  misc_feature (382)..(386): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagattttgcagtgtattactgtcaggtctatggtactcacctcggttcagctttggccaggggaccaaggtgagatcaaacgaactgtggctgcaccatcctgtcttcatcttcccgctntctgagagtgcgtctctgagcgggctggcaaggcgcatagnnnnn

SEQ ID NO: 298864 - DNA, 385 bp, Homo sapiens
  misc_feature: GZ8MTXP02J0CGY.3.11.A11.1.454.CMB.2.raw
  modified_base (339)..(339): a, c, t, g, unknown or other
  misc_feature (339)..(339): n is a, c, g, or t
  modified_base (379)..(385): a, c, t, g, unknown or other
  misc_feature (379)..(385): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagattttgcagtgtattactgtcaggtctatggttactcacctcggttcagctttggccaggggaccaaggtgagatcaaacgactgtggctgcaccatcctgtcttcatcttccgcntctgagagtgcgtctgagcgggctgggcaaggcgcatagnnnnnnn

SEQ ID NO: 298865 - DNA, 388 bp, Homo sapiens
  misc_feature: GZ8MTXP02H8VTP.3.11.A11.1.454.CMB.2.raw
  modified_base (363)..(363): a, c, t, g, unknown or other
  misc_feature (363)..(363): n is a, c, g, or t
  modified_base (380)..(388): a, c, t, g, unknown or other
  misc_feature (380)..(388): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagattttgcagtgtatactgtcaggtctatggttactcacctcggttcagctttggccaggggaccaaggtggagatacaaaacgaactgtggctgacaccatcctgtcttcatctcccgcatctgagagtgcgtcttcagngcggcgtgcgagcgcannnnnnnnn

SEQ ID NO: 298866 - DNA, 379 bp, Homo sapiens
  misc_feature: GZ8MTXP02FHRWC.3.11.A11.1.454.CMB.2.raw
  modified_base (341)..(341): a, c, t, g, unknown or other
  misc_feature (341)..(341): n is a, c, g, or t
  modified_base (375)..(379): a, c, t, g, unknown or other
  misc_feature (375)..(379): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacagtttcagtggcagtgggtctgggacagacttcactctcaccatcagcagactggagcctgaagattttgcagtttatactgtcagcagggttacttctggcccactttcggcccctgggaccaaagtggatatcaaacgactgtggctgcaccatctgtcttcatcttcccgcatctgagngtgcgtctctgagcgggctggcaaggcgcatagnnnnn

SEQ ID NO: 298867 - DNA, 385 bp, Homo sapiens
  misc_feature: GZ8MTXP02HVP79.3.11.A11.1.454.CMB.2.raw
  modified_base (340)..(340): a, c, t, g, unknown or other
  misc_feature (340)..(340): n is a, c, g, or t
  modified_base (364)..(364): a, c, t, g, unknown or other
  misc_feature (364)..(364): n is a, c, g, or t
  modified_base (374)..(374): a, c, t, g, unknown or other
  misc_feature (374)..(374): n is a, c, g, or t
  modified_base (381)..(385): a, c, t, g, unknown or other
  misc_feature (381)..(385): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagattttgcagtgtattactgtcaggtctatggttactcacctcggttcagctttggccaggggaccaaggtggagatcaaacgaactgtgctgcacatcctgtcttcatcttcccgcntctgagagtgcgtctctgagcggntggcaaggcncgatagnnnnn

SEQ ID NO: 298868 - DNA, 395 bp, Homo sapiens
  misc_feature: GZ8MTXP02F1UUV.3.11.A11.1.454.CMB.2.raw
  modified_base (343)..(343): a, c, t, g, unknown or other
  misc_feature (343)..(343): n is a, c, g, or t
  modified_base (368)..(368): a, c, t, g, unknown or other
  misc_feature (368)..(368): n is a, c, g, or t
  modified_base (384)..(395): a, c, t, g, unknown or other
  misc_feature (384)..(395): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagattttgcagtgtattactgtcaggtctatggttactcacctcggttcagctttggccaggggaccaaggtggagatcaaacgaactgtggctgcaccatcctgtcttcatcttcccgctntctgagagtgcgtctctgagccggntggcaaggcgcatagnnnnnnnnnnnn

SEQ ID NO: 298869 - DNA, 386 bp, Homo sapiens
  misc_feature: GZ8MTXP02HE6VY.3.11.A11.1.454.CMB.2.raw
  modified_base (342)..(342): a, c, t, g, unknown or other
  misc_feature (342)..(342): n is a, c, g, or t
  modified_base (383)..(386): a, c, t, g, unknown or other
  misc_feature (383)..(386): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagattttgcagtgtattactgtcaggtctatggttactcacctcggttcagctttggccaggggaccaaggtggagatcaaacgaactgtggctgcaccatcctgtcttcatcttcccgcntctgagagtgcgtctctgagcgggctggcaaggcgcatagnnnn

SEQ ID NO: 298870 - DNA, 386 bp, Homo sapiens
  misc_feature: GZ8MTXP02GJM04.3.11.A11.1.454.CMB.2.raw
  modified_base (341)..(341): a, c, t, g, unknown or other
  misc_feature (341)..(341): n is a, c, g, or t
  modified_base (383)..(386): a, c, t, g, unknown or other
  misc_feature (383)..(386): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagattttgcagtgtattactgtcaggtctatggttactcacctcggttcagctttggccaggggaccaaggtggagatcaaacgactgtggctgcaccatcctgtcttcatcttcccgcntctgagagtgcgtctctgagcgggctgggcaaggcgcatagnnnn

SEQ ID NO: 298871 - DNA, 387 bp, Homo sapiens
  misc_feature: GZ8MTXP02GCTCO.3.11.A11.1.454.CMB.2.raw
  modified_base (379)..(379): a, c, t, g, unknown or other
  misc_feature (379)..(379): n is a, c, g, or t
  modified_base (384)..(387): a, c, t, g, unknown or other
  misc_feature (384)..(387): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagaccttcactctcaccatcagcagactggagcctgaagattttgcagtgtattactgtcaggtctatggttactcacctcggttcagctttggccaggggaccaaggtggagatcaaaacgaactgtggctgcaccatcctgtcttcatcttcccgcatctgagagtgcgtctctgagcggctggcaaggcgnatagnnnn

SEQ ID NO: 298872 - DNA, 387 bp, Homo sapiens
  misc_feature: GZ8MTXP02HC2N7.3.11.A11.1.454.CMB.2.raw
  modified_base (383)..(387): a, c, t, g, unknown or other
  misc_feature (383)..(387): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagattttgcagtgtattactgtcaggtctatggtactcacctcggttcagctttggccaggggaccaaggtggagatcaaacgaactgtggctgcaccatcctgtctcatcttcccgcatcctgagtagtgcgtctctgagcgggctggcaaggcgcatagnnnnn

SEQ ID NO: 298873 - DNA, 385 bp, Homo sapiens
  misc_feature: GZ8MTXP02GWZ1Q.3.11.A11.1.454.CMB.2.raw
  modified_base (381)..(385): a, c, t, g, unknown or other
  misc_feature (381)..(385): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagattttgcagtgtattactgtcaggtctatggtactcacctcggttcagctttggccaggggaccaaggtggagatcaaaacgactgtggctgcaccatcctgtcttcatcttcccgcatctgagagtgcgtctctgagcggctggcaaggcgcatagnnnnn

SEQ ID NO: 298874 - DNA, 400 bp, Homo sapiens
  misc_feature: GZ8MTXP02JDZ43.3.11.A11.1.454.CMB.2.raw
  modified_base (387)..(400): a, c, t, g, unknown or other
  misc_feature (387)..(400): n is a, c, g, or t
tcagagacgcactccacgaccggtgctcgatttagctacgactgcagggccgagtgagactgttagcagcagctacttagcctggtaccagcacaaacctggccaggctcccagtctcctcatctttggtgcatccagctagggcccctggcatcccaagacaggttcagtggcagtgggtctgggacagacttcactctcaccatcagcagactggagcctgaagattttgcagtgtattactgtcaggtctatggtactcactcggttcagctttggccaggggaccaaggtggagatcaaacgaactgtggctgcaccatcctgtcttcactcttcccgcactctgagagtgcgtctctgagcggggctggcaaggcgcatagnnnnnnnnnnnnnn

SEQ ID NO: 298875 - DNA, 384 bp, Homo sapiens
  misc_feature: GZ8MTXP02I8SQX.3.11.A11.1.454.CMB.2.raw
  modified_base (339)..(339): a, c, t, g, unknown or other
  misc_feature (339)..(339): n is a, c, g, or t
  modified_base (380)..(384): a, c, t, g, unknown or other
  misc_feature (380)..(384): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagattttgcagtgtattactgtcaggtctatggtactcactcggttcagctttggccaggggaccaaggtggagatcaaacgaactgtgctgcaccatcctgtcttcatcttcccgcntctgagagtgcgtctctgagcggctgggcaaggcgcatagnnnnn

SEQ ID NO: 298876 - DNA, 379 bp, Homo sapiens
  misc_feature: GZ8MTXP02FKFKT.3.11.A11.1.454.CMB.2.raw
  modified_base (336)..(336): a, c, t, g, unknown or other
  misc_feature (336)..(336): n is a, c, g, or t
  modified_base (378)..(379): a, c, t, g, unknown or other
  misc_feature (378)..(379): n is a, c, g, or t
tcagagacgcactccacgaccggtgctcgatttagctacgactgcagggccagtgagactgttagcagcagctacttagcctggtaccagcacaaacctggccaggctcccagtctcctcatcttggtgcatccagcagggcccctggcatcccagacaggttcagtggcatggtctggacagactcactctcaccatcagcagactggagcctgaagatttgcagtgtattactgtcaggtctatggttactcacctcggttcagctttggccaggggaccaaggtggagatcaaacgactgtggctgcaccatcctgtcttcatcttcccgctntctgagagttgcgtctctgagcggggctggcaagcgcatagnn

SEQ ID NO: 298877 - DNA, 385 bp, Homo sapiens
  misc_feature: GZ8MTXP02GQUOK.3.11.A11.1.454.CMB.2.raw
  modified_base (339)..(339): a, c, t, g, unknown or other
  misc_feature (339)..(339): n is a, c, g, or t
  modified_base (373)..(373): a, c, t, g, unknown or other
  misc_feature (373)..(373): n is a, c, g, or t
  modified_base (379)..(385): a, c, t, g, unknown or other
  misc_feature (379)..(385): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagattttgcagtgtattactgtcaggtctatggtactcacctcgttcagctttggccaggggaccaaggtggagatcaaaacgaactgtggctgcacatcctgtctcatcttcccgcntctgagagtgctctctgagcgggctggcaaggcncatagnnnnnnn

SEQ ID NO: 298878 - DNA, 387 bp, Homo sapiens
  misc_feature: GZ8MTXP02GO0V0.3.11.A11.1.454.CMB.2.raw
  modified_base (337)..(337): a, c, t, g, unknown or other
  misc_feature (337)..(337): n is a, c, g, or t
  modified_base (382)..(387): a, c, t, g, unknown or other
  misc_feature (382)..(387): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagatttgcagtgtattactgtcaggtctatgtactcactcggtcagtctttggccaggggaccaaggtggagatacgaaacgactgtggctgcaccatcctgtctcatctcccgcntctgagagtgcgtctctgagcgggctgggcaagggcgacagtagnnnnnn

SEQ ID NO: 298879 - DNA, 399 bp, Homo sapiens
  misc_feature: GZ8MTXP02IKNCC.3.11.A11.1.454.CMB.2.raw
  modified_base (392)..(399): a, c, t, g, unknown or other
  misc_feature (392)..(399): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctggggacagacttcactctcaccatcagcagactggagcctgaagattttgcagtgtattactgtcaggtctaatggttactcactcggttcagctttggccaggggaccaaggtggagatcaaaacgaactgtggctgcaccatcctgtctttcatcttcccgccatcctgacgagtgcgtctctgagcgggctgggcaaaggcgcagtagnnnnnnnn

SEQ ID NO: 298880 - DNA, 388 bp, Homo sapiens
  misc_feature: GZ8MTXP02IKGV4.3.11.A11.1.454.CMB.2.raw
  modified_base (339)..(339): a, c, t, g, unknown or other
  misc_feature (339)..(339): n is a, c, g, or t
  modified_base (374)..(374): a, c, t, g, unknown or other
  misc_feature (374)..(374): n is a, c, g, or t
  modified_base (381)..(388): a, c, t, g, unknown or other
  misc_feature (381)..(388): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctggggacagacttcactctcaccatcagcagactggagcctgaagattttgcagtgtattactgtcaggtctatggttactcacctcggttcagctttggccaggggaccaaggtggagatcaaacgactgtgctgcacatctgtcttcatcttcccgcntctgagagtgcgtctctgagcggctggcaagggcncgatagnnnnnnnn

SEQ ID NO: 298881 - DNA, 421 bp, Homo sapiens
  misc_feature: GZ8MTXP02GURPI.3.11.A11.1.454.CMB.2.raw
  modified_base (219)..(219): a, c, t, g, unknown or other
  misc_feature (219)..(219): n is a, c, g, or t
  modified_base (344)..(344): a, c, t, g, unknown or other
  misc_feature (344)..(344): n is a, c, g, or t
  modified_base (386)..(386): a, c, t, g, unknown or other
  misc_feature (386)..(386): n is a, c, g, or t
  modified_base (393)..(421): a, c, t, g, unknown or other
  misc_feature (393)..(421): n is a, c, g, or t
tcagagacgcactccacgaccggtgctcgatttagctacgactgcaggggccagtgagactgttagcagcagctacttagcctggtaccagcacaaacctggccaggcctcccagtctcctcatctttggtgcatccagcagggcccctggcatcccagacaggttcagtggcaggtgggtctgggacagacttcactctcaccatcagcagactggancctgaagattttgctagtgtattactgtcaggtctatggttactcactcggtcagctttggcaggggaccaggtgagatcgaaagactgtggctgccaccatcctagtcttcattcctcccgccntcctagagagtgacgtctctgagcggggactgggcaagggcncatacgnnnnnnnnnnnnnnnnnnnnnnnnnnnnn

SEQ ID NO: 298882 - DNA, 392 bp, Homo sapiens
  misc_feature: GZ8MTXP02GVAMO.3.11.A11.1.454.CMB.2.raw
  modified_base (325)..(325): a, c, t, g, unknown or other
  misc_feature (325)..(325): n is a, c, g, or t
  modified_base (343)..(343): a, c, t, g, unknown or other
  misc_feature (343)..(343): n is a, c, g, or t
  modified_base (379)..(379): a, c, t, g, unknown or other
  misc_feature (379)..(379): n is a, c, g, or t
  modified_base (385)..(392): a, c, t, g, unknown or other
  misc_feature (385)..(392): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagattttgcagtgtattactgtcaggtctatggttactcacctcggttcagctttggccaggggaccaaggtggagatcaaacgaactgtggctgcaccatccngtcttcatcttcccgccntctgagagtgcgtctctgagcgggctgggcaaggcncatagnnnnnnnn

SEQ ID NO: 298883 - DNA, 388 bp, Homo sapiens
  misc_feature: GZ8MTXP02JKKU4.3.11.A11.1.454.CMB.2.raw
  modified_base (342)..(342): a, c, t, g, unknown or other
  misc_feature (342)..(342): n is a, c, g, or t
  modified_base (381)..(388): a, c, t, g, unknown or other
  misc_feature (381)..(388): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagattttgcagtgtattactgtcaggtctatggttactcacctggttcagctttggccaggggtaccaaggtggagatcaaacgaactgtggctgcaccatcctgtcttcatcttcccgcntctgagagtgcgtctgagcgggctggcaggcgcagtagnnnnnnnn

SEQ ID NO: 298884 - DNA, 386 bp, Homo sapiens
  misc_feature: GZ8MTXP02IIM8R.3.11.A11.1.454.CMB.2.raw
  modified_base (342)..(342): a, c, t, g, unknown or other
  misc_feature (342)..(342): n is a, c, g, or t
  modified_base (382)..(386): a, c, t, g, unknown or other
  misc_feature (382)..(386): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagattttgcagtgtattactgtcaggtctatggttactcacctcggttcagctttggccaggggaccaaggtggagatcaaacgaactgtggctgcacatcctgtcttcatcttcccgccntctgaagtgcgtctctgagcgggctggcaaggcgcatagnnnnn

SEQ ID NO: 298885 - DNA, 389 bp, Homo sapiens
  misc_feature: GZ8MTXP02FQU94.3.11.A11.1.454.CMB.2.raw
  modified_base (342)..(342): a, c, t, g, unknown or other
  misc_feature (342)..(342): n is a, c, g, or t
  modified_base (383)..(389): a, c, t, g, unknown or other
  misc_feature (383)..(389): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagattttgcagtgtattactgtcaggtctatggttactcacctcggttcagctttggccaggggaccaaggtggagatcaaaacgaactgtggctgcaccatcctgtctcatcttcccgcntctgagagtgcgtctctgagcggctggcaaggcgcaatagnnnnnnn

SEQ ID NO: 298886 - DNA, 382 bp, Homo sapiens
  misc_feature: GZ8MTXP02HF2T4.3.11.A11.1.454.CMB.2.raw
  modified_base (336)..(336): a, c, t, g, unknown or other
  misc_feature (336)..(336): n is a, c, g, or t
  modified_base (361)..(361): a, c, t, g, unknown or other
  misc_feature (361)..(361): n is a, c, g, or t
  modified_base (378)..(382): a, c, t, g, unknown or other
  misc_feature (378)..(382): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagactcactctcaccatcagcagactggagcctgaagattttgcagtgtattactgtcaggtctatggttactcactgtcagctttggccaggggaccaaggtggagatacaaacgactgtggctgcaccatcctgtctcatcttcccgcntctgagagtgcgtctctgagcgggntgggcaaggcgcatagnnnnn

SEQ ID NO: 298887 - DNA, 396 bp, Homo sapiens
  misc_feature: GZ8MTXP02IM0S2.3.11.A11.1.454.CMB.2.raw
  modified_base (343)..(343): a, c, t, g, unknown or other
  misc_feature (343)..(343): n is a, c, g, or t
  modified_base (370)..(370): a, c, t, g, unknown or other
  misc_feature (370)..(370): n is a, c, g, or t
  modified_base (382)..(382): a, c, t, g, unknown or other
  misc_feature (382)..(382): n is a, c, g, or t
  modified_base (388)..(396): a, c, t, g, unknown or other
  misc_feature (388)..(396): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagtattttgcagtgtattactgtcaggtctatggttactcacctcggtcagtctttggccaggggaccaggtggagatacaaacgaactgtggctgcacatcctgtcttcatccttcccgcntctgagagtgcgtctcgtgagcgggtntgggacaaggcncaatgnnnnnnnnn

SEQ ID NO: 298888 - DNA, 421 bp, Homo sapiens
  misc_feature: GZ8MTXP02HSFXJ.3.11.A11.1.454.CMB.2.raw
  modified_base (375)..(375): a, c, t, g, unknown or other
  misc_feature (375)..(375): n is a, c, g, or t
  modified_base (402)..(421): a, c, t, g, unknown or other
  misc_feature (402)..(421): n is a, c, g, or t
tcagagacgcactccacgaccggtgctcgatttagctacgactgcagggccgagtgagactgttagcagcagctacttagcctggtaccagcacaaacctggccaggctcccagtctcctcatctttggtgcatccagctagggcccctggcatcccagacaggttcagtggcagtgggtctgggacaggacttcactctcacatcagcagactggagcctgaagattttgcagtgtattactgtcaggtctatggttactcactcgttcagtctttggccaggggaccaagggtcggagagtacgaaaacgaactgtggcttgcaccatcctgttcttcacttcttcccgctatcctagagacgtgcgtcttcngagcgggtctggccaaggcgacaatgnnnnnnnnnnnnnnnnnnnn

SEQ ID NO: 298889 - DNA, 392 bp, Homo sapiens
  misc_feature: GZ8MTXP02I2LSV.3.11.A11.1.454.CMB.2.raw
  modified_base (343)..(343): a, c, t, g, unknown or other
  misc_feature (343)..(343): n is a, c, g, or t
  modified_base (346)..(346): a, c, t, g, unknown or other
  misc_feature (346)..(346): n is a, c, g, or t
  modified_base (380)..(380): a, c, t, g, unknown or other
  misc_feature (380)..(380): n is a, c, g, or t
  modified_base (386)..(392): a, c, t, g, unknown or other
  misc_feature (386)..(392): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcaggtgggtctgggacagacttcactctcaccatcagcagactggagcctgaagtatttgctagtgtattactgtcaggtctatggttactcacctcggttcagtctttggccaggggaccaaggtggagatacgaaacgactgtgctgcacatcctgtctcatcttcccgcntcngagagtgcgtctctgacgcgggctggacaaggcncatagnnnnnnn

SEQ ID NO: 298890 - DNA, 391 bp, Homo sapiens
  misc_feature: GZ8MTXP02ILPC1.3.11.A11.1.454.CMB.2.raw
  modified_base (330)..(330): a, c, t, g, unknown or other
  misc_feature (330)..(330): n is a, c, g, or t
  modified_base (342)..(342): a, c, t, g, unknown or other
  misc_feature (342)..(342): n is a, c, g, or t
  modified_base (361)..(361): a, c, t, g, unknown or other
  misc_feature (361)..(361): n is a, c, g, or t
  modified_base (367)..(367): a, c, t, g, unknown or other
  misc_feature (367)..(367): n is a, c, g, or t
  modified_base (384)..(391): a, c, t, g, unknown or other
  misc_feature (384)..(391): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagccaggttcagtggcagtgggtctggggacagacttcactctcaccatcagcagcctagacgcctgaagtattttgctagtttattactgtcagcagcgtagcaactggcctctcacgtttcggcggagggaccaaggtggagatacaaacgactgtggctgcacatctgtctnacttctccgctntctgagagtgcgtctctgngcgggntggcgaagcgacatagnnnnnnnn

SEQ ID NO: 298891 - DNA, 386 bp, Homo sapiens
  misc_feature: GZ8MTXP02IV9UC.3.11.A11.1.454.CMB.2.raw
  modified_base (383)..(386): a, c, t, g, unknown or other
  misc_feature (383)..(386): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagattttgcagtgtattactgtcaggtctatggttactcactcggttcagctttggccaggggaccaaggtggagatcaaacgaactgtggctgcaccatcctgtcttcatcttcccgcatctgacgagtgcgtctctgagcgggctggcaaggcgcatagnnnn

SEQ ID NO: 298892 - DNA, 406 bp, Homo sapiens
  misc_feature: GZ8MTXP02H5SV6.3.11.A11.1.454.CMB.2.raw
  modified_base (390)..(390): a, c, t, g, unknown or other
  misc_feature (390)..(390): n is a, c, g, or t
  modified_base (395)..(406): a, c, t, g, unknown or other
  misc_feature (395)..(406): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagattttgcagtgtattactgtcaggtctatggttactcacctcggttcagtctttggccaggggaccaaggtggagatacaaaacgactgtgctgcacgatctgtcttcacttcttccccgctatctgagtagtgcgtctcgtgagcggggctgggacaaggggccgnaatgnnnnnnnnnnnn

SEQ ID NO: 298893 - DNA, 386 bp, Homo sapiens
  misc_feature: GZ8MTXP02FQDO5.3.11.A11.1.454.CMB.2.raw
  modified_base (383)..(386): a, c, t, g, unknown or other
  misc_feature (383)..(386): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagattttgcagtgtattactgtcaggtctatggttactcacctcggttcagctttggccaggggaccaaggtggagatcaaaacgaactgtggctgcaccatcctgtctcatcttcccgcatctgagagtgcgtctctgagcgggctggcaaggcgcatagnnnn

SEQ ID NO: 298894 - DNA, 390 bp, Homo sapiens
  misc_feature: GZ8MTXP02IQY6B.3.11.A11.1.454.CMB.2.raw
  modified_base (381)..(390): a, c, t, g, unknown or other
  misc_feature (381)..(390): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctggggacagacttcactctcaccatcagcagactggagcctgaagattttgcagtgtattactgtcaggtctatgtactcactcggtcagctttggcaggggaccaaggtggagatacaaacgaactgtgctgcacatcctgtcttcattcttcccgcctatctgagatgcgtctctgagcggctgggcaaggcacagtagnnnnnnnnnn

SEQ ID NO: 298895 - DNA, 393 bp, Homo sapiens
  misc_feature: GZ8MTXP02IZI0K.3.11.A11.1.454.CMB.2.raw
  modified_base (345)..(345): a, c, t, g, unknown or other
  misc_feature (345)..(345): n is a, c, g, or t
  modified_base (388)..(393): a, c, t, g, unknown or other
  misc_feature (388)..(393): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagattttgcagtgtattactgtcaggtctatggttactcacctcggttcagtctttggccaggggaccaaggtggagatacgaaacgaactgtggctgcaccatcctgtcttcatcttcccgcntctgagagtgcgtctcgtgagccggtctggcaaggcgcatagnnnnnn

SEQ ID NO: 298896 - DNA, 403 bp, Homo sapiens
  misc_feature: GZ8MTXP02FZ5YS.3.11.A11.1.454.CMB.2.raw
  modified_base (326)..(326): a, c, t, g, unknown or other
  misc_feature (326)..(326): n is a, c, g, or t
  modified_base (380)..(403): a, c, t, g, unknown or other
  misc_feature (380)..(403): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtggtctgggacagacttcactctcaccatcagcagactggagcctgaagattttgcagtgtattactgtcaggtctatggtactcactcggtcagctttggccaggggaccaaggtgagatcaaacgaactgtggctgcaccatcctgtcttnatctcccgcatctgagagtgcgtctctgagcgggctggcaaaggcgcagtacgnnnnnnnnnnnnnnnnnnnnnnnn

SEQ ID NO: 298897 - DNA, 384 bp, Homo sapiens
  misc_feature: GZ8MTXP02IU63V.3.11.A11.1.454.CMB.2.raw
  modified_base (340)..(340): a, c, t, g, unknown or other
  misc_feature (340)..(340): n is a, c, g, or t
  modified_base (381)..(384): a, c, t, g, unknown or other
  misc_feature (381)..(384): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagattttgcagtgtattactgtcaggtctatggttactcacctcggttcagctttggccaggggaccaaggtggagatcaaacgactgtggctgcacatctgtcttcatcttcccgccntctgagagtgcgtctctgagcgggctggcaaggcgcatagnnnn

SEQ ID NO: 298898 - DNA, 392 bp, Homo sapiens
  misc_feature: GZ8MTXP02FPAD9.3.11.A11.1.454.CMB.2.raw
  modified_base (286)..(286): a, c, t, g, unknown or other
  misc_feature (286)..(286): n is a, c, g, or t
  modified_base (313)..(313): a, c, t, g, unknown or other
  misc_feature (313)..(313): n is a, c, g, or t
  modified_base (358)..(358): a, c, t, g, unknown or other
  misc_feature (358)..(358): n is a, c, g, or t
  modified_base (377)..(392): a, c, t, g, unknown or other
  misc_feature (377)..(392): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagatttgcagtgtattactgtcaggtctatggtactcactcgtcagcttgcagggaccaggtganatcaaacgactgtggctgcaccatccngtctcatccttccgctatctgagagtgacgtctcgtgaggtcggntggacaaggcgacagtagnnnnnnnnnnnnnnnn

SEQ ID NO: 298899 - DNA, 384 bp, Homo sapiens
  misc_feature: GZ8MTXP02G1IFB.3.11.A11.1.454.CMB.2.raw
  modified_base (339)..(339): a, c, t, g, unknown or other
  misc_feature (339)..(339): n is a, c, g, or t
  modified_base (357)..(357): a, c, t, g, unknown or other
  misc_feature (357)..(357): n is a, c, g, or t
  modified_base (365)..(365): a, c, t, g, unknown or other
  misc_feature (365)..(365): n is a, c, g, or t
  modified_base (380)..(384): a, c, t, g, unknown or other
  misc_feature (380)..(384): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagtattttgcagtgtattactgtcaggtctatggtactcacctcggtcagctttggccaggggaccaaggtggagatcaaacgactgtaggctgcacatcctgtctcatcttcccgcntcctgagtagtgcgtctntgagcggntggcaagcgcatagnnnnn

SEQ ID NO: 298900 - DNA, 406 bp, Homo sapiens
  misc_feature: GZ8MTXP02H7FNB.3.11.A11.1.454.CMB.2.raw
  modified_base (241)..(241): a, c, t, g, unknown or other
  misc_feature (241)..(241): n is a, c, g, or t
  modified_base (349)..(349): a, c, t, g, unknown or other
  misc_feature (349)..(349): n is a, c, g, or t
  modified_base (355)..(355): a, c, t, g, unknown or other
  misc_feature (355)..(355): n is a, c, g, or t
  modified_base (383)..(383): a, c, t, g, unknown or other
  misc_feature (383)..(383): n is a, c, g, or t
  modified_base (388)..(406): a, c, t, g, unknown or other
  misc_feature (388)..(406): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagattttgcagtgtattacngtcaggtctatggtactcactcggttcagctttggccaaggggtaccaaaggtggagatacgaaaacgaactgtggctgcacatccctgtcttcatctcccgcatctnagagtncgtctctcgagcggctggcaaggccganagagnnnnnnnnnnnnnnnnnnn

SEQ ID NO: 298901 - DNA, 490 bp, Homo sapiens
  misc_feature: GZ8MTXP02JH95G.3.11.A11.1.454.CMB.2.raw
  modified_base (458)..(458): a, c, t, g, unknown or other
  misc_feature (458)..(458): n is a, c, g, or t
  modified_base (460)..(460): a, c, t, g, unknown or other
  misc_feature (460)..(460): n is a, c, g, or t
  modified_base (462)..(463): a, c, t, g, unknown or other
  misc_feature (462)..(463): n is a, c, g, or t
  modified_base (465)..(490): a, c, t, g, unknown or other
  misc_feature (465)..(490): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcggtggcaggtgggtcgtgggacagacttcactctcaccatcagcagactggagcctagaagtattttgctagtgttattactgtctaggttctagttcggttactccaccgttcggttcagtcgtttcggccgagggaccgaaggtggagtatacgaaaacgtaacgtggtggctgccacctatctgtccttcacttcccgttcccactacttcgtgaaaggtgttcgtccgttcgtttcgagggacgggtccggggtcgtcggggaacgaacggggccgtacaagttacggngngnngnnnnnnnnnnnnnnnnnnnnnnnnnn

SEQ ID NO: 298902 - DNA, 395 bp, Homo sapiens
  misc_feature: GZ8MTXP02IZAYZ.3.11.A11.1.454.CMB.2.raw
  modified_base (389)..(395): a, c, t, g, unknown or other
  misc_feature (389)..(395): n is a, c, g, or t
tcagagacgcactccacgaccggtgctcgatttagctacgactgcagggccagtgagactgttagcagcagctacttagcctggtaccagcacaaacctggccaggctcccagtctccttatctttggtgcatccagcagggcccctggcatcccagacaggttcagtggcagtgggtctgggacagacttcactctcaccatcagcagactggagcctgaagattttgcagtgtattactgtcaggtctatggttactcacctcggttcagtctttggccaggggaccaaggtggagatcaaacgaactgtggctgcaccatctgtcttcatccttcccgccatctgagagtgccgtctctggacgcgggctgggcaaggcgcatagnnnnnnn

SEQ ID NO: 298903 - DNA, 415 bp, Homo sapiens
  misc_feature: GZ8MTXP02IUDPY.3.11.A11.1.454.CMB.2.raw
  modified_base (401)..(415): a, c, t, g, unknown or other
  misc_feature (401)..(415): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagtattttgcagtgtattactgtcaggtctatggttactcacctcggtcagtctttggccaggggaccaaggtggagatacaaacgaactgtggctgcacatcctgtctcacttctcccgcatcctgagtagtcgcgtctcgtggaggccgggcgtggacgaaagggcgacgtaaagtgnnnnnnnnnnnnnnn

SEQ ID NO: 298904 - DNA, 391 bp, Homo sapiens
  misc_feature: GZ8MTXP02HOHQM.3.11.A11.1.454.CMB.2.raw
  modified_base (371)..(371): a, c, t, g, unknown or other
  misc_feature (371)..(371): n is a, c, g, or t
  modified_base (381)..(381): a, c, t, g, unknown or other
  misc_feature (381)..(381): n is a, c, g, or t
  modified_base (387)..(391): a, c, t, g, unknown or other
  misc_feature (387)..(391): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagattttgcagtgtattactgtcaggtctatggtactcacctcggttcagtctttggccaggggaccaaaggtggaagatacaaacgaactgtggctgcaccatcctgtcttcattcttcccgcatctgagagtgcgtctctgagcgggntggcaaggcncatagnnnnn

SEQ ID NO: 298905 - DNA, 386 bp, Homo sapiens
  misc_feature: GZ8MTXP02F3MTO.3.11.A11.1.454.CMB.2.raw
  modified_base (348)..(348): a, c, t, g, unknown or other
  misc_feature (348)..(348): n is a, c, g, or t
  modified_base (379)..(379): a, c, t, g, unknown or other
  misc_feature (379)..(379): n is a, c, g, or t
  modified_base (382)..(386): a, c, t, g, unknown or other
  misc_feature (382)..(386): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagattttgcagtgtattactgtcaggtctatggttactcacctcggttcagctttggccaggggaccaaggtgagatcaaaacgaactgtggctgcaccatccctgtctcatcttcccgcatctganagtgcgtctctgagcggctggcaaggcgcanagnnnnn

SEQ ID NO: 298906 - DNA, 385 bp, Homo sapiens
  misc_feature: GZ8MTXP02IQN4E.3.11.A11.1.454.CMB.2.raw
  modified_base (308)..(308): a, c, t, g, unknown or other
  misc_feature (308)..(308): n is a, c, g, or t
  modified_base (378)..(385): a, c, t, g, unknown or other
  misc_feature (378)..(385): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagattttgcagtgtattactgtcaggtctatggtactcacctggttcagctttggccaggggaccaaggtgagatacaaacgactgnggctgcacatcctagtctcactcttcccgcatctgagagtgcgtctctgagcggctggcaagcgcatagnnnnnnnn

SEQ ID NO: 298907 - DNA, 434 bp, Homo sapiens
  misc_feature: GZ8MTXP02JW1UY.3.11.A11.1.454.CMB.2.raw
  modified_base (313)..(313): a, c, t, g, unknown or other
  misc_feature (313)..(313): n is a, c, g, or t
  modified_base (343)..(343): a, c, t, g, unknown or other
  misc_feature (343)..(343): n is a, c, g, or t
  modified_base (350)..(350): a, c, t, g, unknown or other
  misc_feature (350)..(350): n is a, c, g, or t
  modified_base (393)..(393): a, c, t, g, unknown or other
  misc_feature (393)..(393): n is a, c, g, or t
  modified_base (396)..(396): a, c, t, g, unknown or other
  misc_feature (396)..(396): n is a, c, g, or t
  modified_base (400)..(418): a, c, t, g, unknown or other
  misc_feature (400)..(418): n is a, c, g, or t
  modified_base (420)..(434): a, c, t, g, unknown or other
  misc_feature (420)..(434): n is a, c, g, or t
tcagagacgcactccacgaccggtgctcgatttagctacgactgcagggccagtgagactgttagcagcagctacttagcctggtaccagcacaaacctggccaggctcccagtctcctcatcttggtgcatccagcagggcccctggcatcccagacaggttcagtggcagtgggtctgggacagacttcactctcaccatcagcagactggagcctgaagattttgcagtgtattactgtcaggtctatggttactcacctcggtcagtctttggcccaggggacccaaggtggagatcgaaaacgactgnggctgcaccatcctgtctcatcttcccgcntctgagngtgcgtctctgagtccgggctgggacctaaggccgcaagtagnagnacgnnnnnnnnnnnnnnnnnnncnnnnnnnnnnnnnnn

SEQ ID NO: 298908 - DNA, 397 bp, Homo sapiens
  misc_feature: GZ8MTXP02GUKRA.3.11.A11.1.454.CMB.2.raw
  modified_base (341)..(341): a, c, t, g, unknown or other
  misc_feature (341)..(341): n is a, c, g, or t
  modified_base (386)..(397): a, c, t, g, unknown or other
  misc_feature (386)..(397): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagattttgctagtgtattactgtcaggtctatggttactcaactcggttcagctttggccaggggaccaaggtggagatcaaacgactgtggctgcaccatcctgtctcatcttcccgcntctgagtagtgcgtctctgagcggctgggcaagggcgcagtacgnnnnnnnnnnnn

SEQ ID NO: 298909 - DNA, 395 bp, Homo sapiens
  misc_feature: GZ8MTXP02FUNPV.3.11.A11.1.454.CMB.2.raw
  modified_base (384)..(384): a, c, t, g, unknown or other
  misc_feature (384)..(384): n is a, c, g, or t
  modified_base (386)..(386): a, c, t, g, unknown or other
  misc_feature (386)..(386): n is a, c, g, or t
  modified_base (388)..(395): a, c, t, g, unknown or other
  misc_feature (388)..(395): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagtattttgcagtgtattactgtcaggtctatggttactcacctcggttcagtctttggccaggggaccaaggtggagatcgaaaacgactgtggctgcaccatcctgtcttcattccttcccgctatctgagagtgcgtctctgagcggctggcaaggcganangnnnnnnnn

SEQ ID NO: 298910 - DNA, 392 bp, Homo sapiens
  misc_feature: GZ8MTXP02JWRWF.3.11.A11.1.454.CMB.2.raw
  modified_base (378)..(378): a, c, t, g, unknown or other
  misc_feature (378)..(378): n is a, c, g, or t
  modified_base (384)..(392): a, c, t, g, unknown or other
  misc_feature (384)..(392): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagattttgcagtgtattactgtcaggtctatggttactcacctcggttcagctttggccaggggaccaaggtggagatcaaacgaactgtggctgcaccatcctgtcttcatcttcccgcatcctgacgagtgcgtctctgagcggctggcaaggcncatagnnnnnnnnn

SEQ ID NO: 298911 - DNA, 388 bp, Homo sapiens
  misc_feature: GZ8MTXP02GVMEL.3.11.A11.1.454.CMB.2.raw
  modified_base (267)..(267): a, c, t, g, unknown or other
  misc_feature (267)..(267): n is a, c, g, or t
  modified_base (325)..(325): a, c, t, g, unknown or other
  misc_feature (325)..(325): n is a, c, g, or t
  modified_base (336)..(336): a, c, t, g, unknown or other
  misc_feature (336)..(336): n is a, c, g, or t
  modified_base (340)..(340): a, c, t, g, unknown or other
  misc_feature (340)..(340): n is a, c, g, or t
  modified_base (362)..(362): a, c, t, g, unknown or other
  misc_feature (362)..(362): n is a, c, g, or t
  modified_base (368)..(368): a, c, t, g, unknown or other
  misc_feature (368)..(368): n is a, c, g, or t
  modified_base (370)..(370): a, c, t, g, unknown or other
  misc_feature (370)..(370): n is a, c, g, or t
  modified_base (372)..(372): a, c, t, g, unknown or other
  misc_feature (372)..(372): n is a, c, g, or t
  modified_base (374)..(388): a, c, t, g, unknown or other
  misc_feature (374)..(388): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagtatttgcagtgtattactgtcaggtctatggtactcactcgttnagcttggccaggggaccaaggtgagatacaaaagatgtagctgcacatcctgtacttnatcttcccgcntctnagagtgcgtctctgagcggcgngagagngnanannnnnnnnnnnnnnn

SEQ ID NO: 298912 - DNA, 382 bp, Homo sapiens
  misc_feature: GZ8MTXP02F2Y35.3.11.A11.1.454.CMB.2.raw
  modified_base (373)..(373): a, c, t, g, unknown or other
  misc_feature (373)..(373): n is a, c, g, or t
  modified_base (379)..(382): a, c, t, g, unknown or other
  misc_feature (379)..(382): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagattttgcagtgtattactgtcaggtctatggtactcacctcggtcagctttggcaggggaccaaggtgagatcaaaacgactgtggctgcaccatcctgtcttcactcttcccgcatctgagagtgcgtctctgagcggctggcaaggcncatagnnnn

SEQ ID NO: 298913 - DNA, 415 bp, Homo sapiens
  misc_feature: GZ8MTXP02JRD9C.3.11.A11.1.454.CMB.2.raw
  modified_base (389)..(389): a, c, t, g, unknown or other
  misc_feature (389)..(389): n is a, c, g, or t
  modified_base (394)..(394): a, c, t, g, unknown or other
  misc_feature (394)..(394): n is a, c, g, or t
  modified_base (403)..(403): a, c, t, g, unknown or other
  misc_feature (403)..(403): n is a, c, g, or t
  modified_base (408)..(408): a, c, t, g, unknown or other
  misc_feature (408)..(408): n is a, c, g, or t
  modified_base (410)..(415): a, c, t, g, unknown or other
  misc_feature (410)..(415): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacagggttcggtggcaggtgggtctgggacagacttcactctcaccatcagcagactggagcctagaagtattttgctagtgtattactgtcaggtctatggttactcaccgttcggtcagtcgtttggccgaggggacctaagggtggagatacaaaacgactgggtagctagcaccattctgtcttcattccttcccgactatctagagcgtcgctctctggacgcgggntcggnaagggtccntaagngnnnnnn

SEQ ID NO: 298914 - DNA, 400 bp, Homo sapiens
  misc_feature: GZ8MTXP02I85R3.3.11.A11.1.454.CMB.2.raw
  modified_base (384)..(384): a, c, t, g, unknown or other
  misc_feature (384)..(384): n is a, c, g, or t
  modified_base (391)..(400): a, c, t, g, unknown or other
  misc_feature (391)..(400): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcaggggcccctggcatccccagacaggttcagtggcagtgggtctgggacagacttcactctcaccatcagcagactggagcctgaagattttgcagtgtattactgtcaggtctatggttactcactcggtcagctttggccaggggaccaggtgagatcaaacgaactgtagctgcacatcctgtcttcacttcttaccccgctatctgagagtcgacgtctcgtgagcgggctggcaagggtcncagtagnnnnnnnnnn

SEQ ID NO: 298915 - DNA, 413 bp, Homo sapiens
  misc_feature: GZ8MTXP02FHYFB.3.11.A11.1.454.CMB.2.raw
  modified_base (394)..(394): a, c, t, g, unknown or other
  misc_feature (394)..(394): n is a, c, g, or t
  modified_base (400)..(413): a, c, t, g, unknown or other
  misc_feature (400)..(413): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagtattttgcagtgtattactgtcaggtctatggttactcacctcggttcagtctttggcccaggggaccaaaggtggagatacaaaacgactgtggctgcaccatccctgtcttcatccttcccgctatctgagtagtgcgtctcgtgacggcgggctggcaaagggccaanaatagnnnnnnnnnnnnnn

SEQ ID NO: 298916 - DNA, 400 bp, Homo sapiens
  misc_feature: GZ8MTXP02IDQE6.3.11.A11.1.454.CMB.2.raw
  modified_base (348)..(348): a, c, t, g, unknown or other
  misc_feature (348)..(348): n is a, c, g, or t
  modified_base (397)..(400): a, c, t, g, unknown or other
  misc_feature (397)..(400): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctggacagacttcactctcaccatcagcagactggagcctgaagtattttgcagtgttattactgtcagtctatggttactcaccttcgtcagtcgtttggccgaggggaccaaggtggagatacgaaacgaactgtggctgcaccatcctgtcttcatccttcccgctntctgagtagtcgctctctggagcggtctgggacgtaaggcgacagtagnnnn

SEQ ID NO: 298917 - DNA, 390 bp, Homo sapiens
  misc_feature: GZ8MTXP02GXXXL.3.11.A11.1.454.CMB.2.raw
  modified_base (298)..(298): a, c, t, g, unknown or other
  misc_feature (298)..(298): n is a, c, g, or t
  modified_base (336)..(336): a, c, t, g, unknown or other
  misc_feature (336)..(336): n is a, c, g, or t
  modified_base (338)..(338): a, c, t, g, unknown or other
  misc_feature (338)..(338): n is a, c, g, or t
  modified_base (351)..(351): a, c, t, g, unknown or other
  misc_feature (351)..(351): n is a, c, g, or t
  modified_base (381)..(390): a, c, t, g, unknown or other
  misc_feature (381)..(390): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagtattttgcagtgtattactgtcaggtctatggttactcacctcggtcagctttggccaggggaccaaggtggagntacaaacgactgtggctgcacatctgtctcatctcccncntctgagatgcgtntctgaggcggctggctaagggcgcagtagnnnnnnnnnn

SEQ ID NO: 298918 - DNA, 468 bp, Homo sapiens
  misc_feature: GZ8MTXP02FXTZW.3.11.A11.1.454.CMB.2.raw
  modified_base (133)..(133): a, c, t, g, unknown or other
  misc_feature (133)..(133): n is a, c, g, or t
  modified_base (222)..(222): a, c, t, g, unknown or other
  misc_feature (222)..(222): n is a, c, g, or t
  modified_base (321)..(321): a, c, t, g, unknown or other
  misc_feature (321)..(321): n is a, c, g, or t
  modified_base (458)..(468): a, c, t, g, unknown or other
  misc_feature (458)..(468): n is a, c, g, or t
tcagagacgcactccacgaccggtgctcgatttagctacgactgcagggccagtgagactgttagcagcagctaacttagcctggtaccagcacaaacctggccaggctcccagtcctcctcattctttggtncatccagcagggcccctggcatcccagacaggttcagtggcaggtgggtctgggacagacttcactctacaccatcagcaagactgganctagaagtatttgactagttgtattacgtgtacgtaggttctagttcggttactctaccgttcggtcagtcgtttcgggacgaaggggacaaggtgaanactacaaaacggtactggaggctgaccactatcccttgtccttacacttcccgttcccactagtccgtagaaggtcgtcgtcgttctcggtagggacgggtcccggggatacgggggaacctaaggggccataaggnnnnnnnnnnn

SEQ ID NO: 298919 - DNA, 412 bp, Homo sapiens
  misc_feature: GZ8MTXP02JOCZS.3.11.A11.1.454.CMB.2.raw
  modified_base (216)..(216): a, c, t, g, unknown or other
  misc_feature (216)..(216): n is a, c, g, or t
  modified_base (395)..(395): a, c, t, g, unknown or other
  misc_feature (395)..(395): n is a, c, g, or t
  modified_base (398)..(412): a, c, t, g, unknown or other
  misc_feature (398)..(412): n is a, c, g, or t
tcagagacgcactccacgaccggtgctcgatttagctacgactgcagggccagtgagagtgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggancctgaagattttgcagtgtattactgtcaggtctatggttactcacctcggttcagtctttggccaggggaccaaggtgagatcaaacgaactgtgctgcaccatccctgtcttcatccttcccgcatcctgagagtgccgtctcgtgaggtccgggctcgggacgaagggcgacgaanagnnnnnnnnnnnnnnn

SEQ ID NO: 298920 - DNA, 389 bp, Homo sapiens
  misc_feature: GZ8MTXP02I9EJA.3.11.A11.1.454.CMB.2.raw
  modified_base (341)..(341): a, c, t, g, unknown or other
  misc_feature (341)..(341): n is a, c, g, or t
  modified_base (348)..(348): a, c, t, g, unknown or other
  misc_feature (348)..(348): n is a, c, g, or t
  modified_base (377)..(377): a, c, t, g, unknown or other
  misc_feature (377)..(377): n is a, c, g, or t
  modified_base (383)..(389): a, c, t, g, unknown or other
  misc_feature (383)..(389): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagattttgcagtgtattactgtcaggtctatggttactcacctcggttcagctttggccaggggaccaaggtggagatcaaacgaactgtggctgcacatcctgtcttcatcttcccgcntctgagngtgcgtctctgagcgggctggcaagggcncatagnnnnnnn

SEQ ID NO: 298921 - DNA, 385 bp, Homo sapiens
  misc_feature: GZ8MTXP02ITJSZ.3.11.A11.1.454.CMB.2.raw
  modified_base (292)..(292): a, c, t, g, unknown or other
  misc_feature (292)..(292): n is a, c, g, or t
  modified_base (344)..(344): a, c, t, g, unknown or other
  misc_feature (344)..(344): n is a, c, g, or t
  modified_base (360)..(360): a, c, t, g, unknown or other
  misc_feature (360)..(360): n is a, c, g, or t
  modified_base (364)..(364): a, c, t, g, unknown or other
  misc_feature (364)..(364): n is a, c, g, or t
  modified_base (370)..(370): a, c, t, g, unknown or other
  misc_feature (370)..(370): n is a, c, g, or t
  modified_base (379)..(379): a, c, t, g, unknown or other
  misc_feature (379)..(379): n is a, c, g, or t
  modified_base (384)..(385): a, c, t, g, unknown or other
  misc_feature (384)..(385): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagattttgcagtgtattactgtcaggtctatggttactcacctcggtcagctttggccaggggaccaaggnggagatacgaaacgaactggtggctgcacatcctgtctcactcttcccgctntctgagagtgcgtctntagngcgggntggcaagcnatagnn

SEQ ID NO: 298922 - DNA, 413 bp, Homo sapiens
  misc_feature: GZ8MTXP02H6SLO.3.11.A11.1.454.CMB.2.raw
  modified_base (320)..(320): a, c, t, g, unknown or other
  misc_feature (320)..(320): n is a, c, g, or t
  modified_base (397)..(397): a, c, t, g, unknown or other
  misc_feature (397)..(397): n is a, c, g, or t
  modified_base (402)..(402): a, c, t, g, unknown or other
  misc_feature (402)..(402): n is a, c, g, or t
  modified_base (404)..(413): a, c, t, g, unknown or other
  misc_feature (404)..(413): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcaggtgggtctgggacagacttcactctcaccatcagcagactggagctagaagtattttgctagtgtattactgtcaggtctatggttactcaccttcggttcagtcgtttggccgaggggaccaaggtgagatacgaaacgatgtgcngcacatctgtcttcactcctcccgctatctgacgtagtcgcgtcttccgaggtcggcggcgtggaccgaagggccgntaagngnnnnnnnnnn

SEQ ID NO: 298923 - DNA, 434 bp, Homo sapiens
  misc_feature: GZ8MTXP02GOM0K.3.11.A11.1.454.CMB.2.raw
  modified_base (403)..(403): a, c, t, g, unknown or other
  misc_feature (403)..(403): n is a, c, g, or t
  modified_base (413)..(434): a, c, t, g, unknown or other
  misc_feature (413)..(434): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagacgtggagcctagaagtatttgctagtgtattactgtcaggtctatggttactctaccgtcgtcagtctttggccaggggaccaaggtggagactacaaacgactgtggctgacacctatcctgtctcacttccttcccgctatcgtagacgtcgtgtcgtcctgtgaggtcgggtctgggacgtaaccggggnacgtaagtgnnnnnnnnnnnnnnnnnnnnnn

SEQ ID NO: 298924 - DNA, 406 bp, Homo sapiens
  misc_feature: GZ8MTXP02HXTSK.3.11.A11.1.454.CMB.2.raw
  modified_base (397)..(406): a, c, t, g, unknown or other
  misc_feature (397)..(406): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctagaagtattttgctagtgtattactgtcagtctatggtactcactcggtcagtctttggccgaggggaccaggtggagatacaaacgactggtgctgcactatcctgttcctcacttccttcccgctgtctgagtgtcgcgtctcgtgaggcgggactgggcaagggtcacgagtagnnnnnnnnnn

SEQ ID NO: 298925 - DNA, 456 bp, Homo sapiens
  misc_feature: GZ8MTXP02IFMLE.3.11.A11.1.454.CMB.2.raw
  modified_base (387)..(387): a, c, t, g, unknown or other
  misc_feature (387)..(387): n is a, c, g, or t
  modified_base (433)..(456): a, c, t, g, unknown or other
  misc_feature (433)..(456): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagctgaagtattttgcagttgttaattactgtcaggtctagtggtactctacctcggttcagtctttggccaggggaccaaggtggagatacaaaacgactgtggctgacaccgtatccgtagttccttcatttcctttccccgctacttcctggacgtagtcgtcgtcttcnggtacggccggggtcttgggaccgaaagggccgacgtagtaagggnnnnnnnnnnnnnnnnnnnnnnnn

SEQ ID NO: 298926 - DNA, 392 bp, Homo sapiens
  misc_feature: GZ8MTXP02GKW8W.3.11.A11.1.454.CMB.2.raw
  modified_base (342)..(342): a, c, t, g, unknown or other
  misc_feature (342)..(342): n is a, c, g, or t
  modified_base (383)..(392): a, c, t, g, unknown or other
  misc_feature (383)..(392): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagtattttgcagtgtattactgtcaggtctatggttactcacctcggttcagtctttggccaggggaccaaggtggagatcaaacgactgtggctgcacatcctgtcttcatcttcccgcntctgagagtgcgtctctgagcggctggcaaggcgcagtagnnnnnnnnnn

SEQ ID NO: 298927 - DNA, 403 bp, Homo sapiens
  misc_feature: GZ8MTXP02IEG50.3.11.A11.1.454.CMB.2.raw
  modified_base (225)..(225): a, c, t, g, unknown or other
  misc_feature (225)..(225): n is a, c, g, or t
  modified_base (331)..(331): a, c, t, g, unknown or other
  misc_feature (331)..(331): n is a, c, g, or t
  modified_base (343)..(343): a, c, t, g, unknown or other
  misc_feature (343)..(343): n is a, c, g, or t
  modified_base (362)..(362): a, c, t, g, unknown or other
  misc_feature (362)..(362): n is a, c, g, or t
  modified_base (387)..(403): a, c, t, g, unknown or other
  misc_feature (387)..(403): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagtnttttgcagtgtattactgtcaggtctatggttactcacctcggttcagtctttggccaggggaccaaggtggagatacaaacgatgtggctgcacatcctgtcttnactcttcccgcntctgagagtgtcgtctcgngacgcggctggcgaaggcgcatagnnnnnnnnnnnnnnnnn

SEQ ID NO: 298928 - DNA, 394 bp, Homo sapiens
  misc_feature: GZ8MTXP02JXHE4.3.11.A11.1.454.CMB.2.raw
  modified_base (340)..(340): a, c, t, g, unknown or other
  misc_feature (340)..(340): n is a, c, g, or t
  modified_base (385)..(394): a, c, t, g, unknown or other
  misc_feature (385)..(394): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagattttgcagtgtattactgtcaggtctatggttactcacctcggttcagtctttggccaggggaccaaggtggagatacaaacgactgtgctgcaccatcctgtctcatcctccgcntctgagagtgcgtctctagaggcggctggcgaaggcgacagtagnnnnnnnnnn

SEQ ID NO: 298929 - DNA, 392 bp, Homo sapiens
  misc_feature: GZ8MTXP02HUAYA.3.11.A11.1.454.CMB.2.raw
  modified_base (356)..(356): a, c, t, g, unknown or other
  misc_feature (356)..(356): n is a, c, g, or t
  modified_base (368)..(368): a, c, t, g, unknown or other
  misc_feature (368)..(368): n is a, c, g, or t
  modified_base (385)..(392): a, c, t, g, unknown or other
  misc_feature (385)..(392): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagattttgcagtgtattactgtcaggtctatggttactcacctcggttcagctttggccaggggaccaaggtgagatacaaagaactgagctgcacatctagtcttcattcttccccgctatctgagagtgcgtntctgagcgggtntggcaaggcgcaatagnnnnnnnn

SEQ ID NO: 298930 - DNA, 426 bp, Homo sapiens
  misc_feature: GZ8MTXP02FUL3N.3.11.A11.1.454.CMB.2.raw
  modified_base (320)..(320): a, c, t, g, unknown or other
  misc_feature (320)..(320): n is a, c, g, or t
  modified_base (407)..(407): a, c, t, g, unknown or other
  misc_feature (407)..(407): n is a, c, g, or t
  modified_base (411)..(411): a, c, t, g, unknown or other
  misc_feature (411)..(411): n is a, c, g, or t
  modified_base (413)..(426): a, c, t, g, unknown or other
  misc_feature (413)..(426): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcggtggcaggtgggtctgggacagacttcactctcaccatcagcagactggacgcctagaagtattttgctagtgtattactgtcaggtctagtgttactcacctcggtcagtcgttggccgaggggaccaagggtggagatacgaaacgaactgnggctgcacatctgtctcattcctccgcatcgtgagtagtcgtccgttctcgtggacgggcggggtctaggggactaaaggggccaanagtncnnnnnnnnnnnnnn

SEQ ID NO: 298931 - DNA, 388 bp, Homo sapiens
  misc_feature: GZ8MTXP02FY0UN.3.11.A11.1.454.CMB.2.raw
  modified_base (350)..(350): a, c, t, g, unknown or other
  misc_feature (350)..(350): n is a, c, g, or t
  modified_base (366)..(366): a, c, t, g, unknown or other
  misc_feature (366)..(366): n is a, c, g, or t
  modified_base (382)..(388): a, c, t, g, unknown or other
  misc_feature (382)..(388): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagtatttgcagtgtattactgtcaggtctatggtactcacctcggtcagtctttggccaggggaccaaggtgagatcaaacgaactgtggctgcacatctgtctcatccttcccgcctatctgagagtncgtctcgtgagtcggntggcaaggcgcaatgnnnnnnn

SEQ ID NO: 298932 - DNA, 399 bp, Homo sapiens
  misc_feature: GZ8MTXP02HTPSW.3.11.A11.1.454.CMB.2.raw
  modified_base (388)..(399): a, c, t, g, unknown or other
  misc_feature (388)..(399): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagtattttgcagtgtatactgtcaggtctatggtactcactggttcagctttggccaggggaccaggtgagatcaaacgactgtgctgcacatcctgtcttcacttcttaccccgctactctgagtagtgcgtctcgtgagcgggctgggaccaaggcgacaagtgnnnnnnnnnnnn

SEQ ID NO: 298933 - DNA, 386 bp, Homo sapiens
  misc_feature: GZ8MTXP02IWO0B.3.11.A11.1.454.CMB.2.raw
  modified_base (240)..(240): a, c, t, g, unknown or other
  misc_feature (240)..(240): n is a, c, g, or t
  modified_base (257)..(257): a, c, t, g, unknown or other
  misc_feature (257)..(257): n is a, c, g, or t
  modified_base (321)..(321): a, c, t, g, unknown or other
  misc_feature (321)..(321): n is a, c, g, or t
  modified_base (373)..(373): a, c, t, g, unknown or other
  misc_feature (373)..(373): n is a, c, g, or t
  modified_base (378)..(386): a, c, t, g, unknown or other
  misc_feature (378)..(386): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagctgaagattttgcagtgtattacngtcagtctatggttacnactcgtcagctttgccagggaccaggtgagatacaaacgacgtgtagctgcaccatctgtcttnacttcttcccgcatctgagagtgcgtctctgagcggactggaccaaggccgnaatgnnnnnnnnn

SEQ ID NO: 298934 - DNA, 452 bp, Homo sapiens
  misc_feature: GZ8MTXP02GK3EM.3.11.A11.1.454.CMB.2.raw
  modified_base (252)..(252): a, c, t, g, unknown or other
  misc_feature (252)..(252): n is a, c, g, or t
  modified_base (276)..(276): a, c, t, g, unknown or other
  misc_feature (276)..(276): n is a, c, g, or t
  modified_base (301)..(301): a, c, t, g, unknown or other
  misc_feature (301)..(301): n is a, c, g, or t
  modified_base (439)..(439): a, c, t, g, unknown or other
  misc_feature (439)..(439): n is a, c, g, or t
  modified_base (441)..(443): a, c, t, g, unknown or other
  misc_feature (441)..(443): n is a, c, g, or t
  modified_base (445)..(452): a, c, t, g, unknown or other
  misc_feature (445)..(452): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcaggtgggtctgggacagtacttcactctcaccatcagcagactggacgcctagaagttatttgctagttgtattactgtcnggtctatggttactcacttcggtngtcgtttggcgagggacaggtgganatacgaaacgagtgtcgctgaccactatccttagtctttacacgttccttacccccgctacgttcctaggtaacgtcggttacgtcccgtttactcgtaggacgggtccggggacgtgggacgaacggccgcgtaagngnnngnnnnnnnn

SEQ ID NO: 298935 - DNA, 447 bp, Homo sapiens
  misc_feature: GZ8MTXP02GUXMR.3.11.A11.1.454.CMB.2.raw
  modified_base (356)..(356): a, c, t, g, unknown or other
  misc_feature (356)..(356): n is a, c, g, or t
  modified_base (430)..(447): a, c, t, g, unknown or other
  misc_feature (430)..(447): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagtattttgcagtgtattactgtcaggtctatggttactcaccttgttcagtctttggccagggggacctaagggtcggaagtactacaaacggaactggtaggctgcaccgatcctgtcttcatccttcccgcntccgtagacgacgttgccgtttctctgggacggccgggtctcggggacccgaaagggtccggaccaagttaggnnnnnnnnnnnnnnnnnn

SEQ ID NO: 298936 - DNA, 477 bp, Homo sapiens
  misc_feature: GZ8MTXP02I7PIJ.3.11.A11.1.454.CMB.2.raw
  modified_base (272)..(272): a, c, t, g, unknown or other
  misc_feature (272)..(272): n is a, c, g, or t
  modified_base (285)..(285): a, c, t, g, unknown or other
  misc_feature (285)..(285): n is a, c, g, or t
  modified_base (436)..(437): a, c, t, g, unknown or other
  misc_feature (436)..(437): n is a, c, g, or t
  modified_base (439)..(443): a, c, t, g, unknown or other
  misc_feature (439)..(443): n is a, c, g, or t
  modified_base (445)..(473): a, c, t, g, unknown or other
  misc_feature (445)..(473): n is a, c, g, or t
  modified_base (475)..(477): a, c, t, g, unknown or other
  misc_feature (475)..(477): n is a, c, g, or t
tcagagacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcaggtggtctgggacagacttcactctcaccatcagcagccggagcctgaagtattttgcagtgttattactgtcaggtctattggtactcaccttcgttcngtcgtttgaccgnggggaacaaggtggagtaatccgaaaacggtacgtgtcggtctacgtccacagttctcgtcttcactccttacccggccactcgtagtacgtaacggtcgtccgtctcgttaggacgcgggtaccgtcggacgacggcccgtagacgaagnngnnnnngnnnnnnnnnnnnnnnnnnnnnnnnnnnnncnnn

SEQ ID NO: 298937 - DNA, 531 bp, Homo sapiens
  misc_feature: GZ8MTXP01EGS4N.13.21.B10.1.454.CMB.2.raw
  modified_base (470)..(470): a, c, t, g, unknown or other
  misc_feature (470)..(470): n is a, c, g, or t
  modified_base (519)..(519): a, c, t, g, unknown or other
  misc_feature (519)..(519): n is a, c, g, or t
tcagtcacgtactacacgaccggtgctcgatttagtgtcgtcgcaaagagagaggagccttagccctggactccaaggcctttccacttggtgatcagcactgagcacagaggactcaccatggcattggggctgaactgggttttcctgttgctattttagaaggtgtccagtgtgaggtgcaactggtggagtctgggggaggcttggtccagcctggggggtccctgagactctcctgtcaagcctctgggttcagcttcagtgtatattggatgagctgggtccgccagactccgagggaaggggctggagtgggtggccaaacataaaacacagacggaagtgacccatactatgcggactctgtgaagggccgattcaccatctccagagacaacgccaagaactcactatattgcaaatgaccgctgagagacgaggacaggctatgtattactgtgcgaagnggattgagagttgggcttacgaagttgggggccgggaaccctgggttcnccggttcaaccg

SEQ ID NO: 298938 - DNA, 542 bp, Homo sapiens
  misc_feature: GZ8MTXP01EJQYI.13.21.B10.1.454.CMB.2.raw
tcagtcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtcgtgggggaggcttggtccagcctggggggtccctgagactctcctgtcaagcctctgggttcagcttcagtgtatattggatgagctgggtccgccagactccgagggaaggggctgggagtggggtggccaacgataaaacacagacggaagtgacccatactatgcggactctgtgaaagggccgattcacatctccagagacaacgccaaagaactcactatatttagacaaatgaccgcgtgagagacgaggacaggctatgtattactgtgcgagagattgagagttgggcttacgaaggttgggggcccggggaaccctgggttcaaccggttcgaacc

SEQ ID NO: 298939 - DNA, 538 bp, Homo sapiens
  misc_feature: GZ8MTXP01AOB17.13.21.B10.1.454.CMB.2.raw
  modified_base (329)..(329): a, c, t, g, unknown or other
  misc_feature (329)..(329): n is a, c, g, or t
tcagtcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtctgggggaggcttggtccagcctggggggtccctgagactctcctgtcaagcctctgggttcagcttcagtgtatattggatgagcgtgggtccgccagactccgaggggaggggctggagtgggtggccaanataaacacagacggaagtgacccatactatgcggactctgtggaagggccgattcaccatctccagacgacaacgcaagaactcactatattgacaaatgaccgcgtgagagacgagacacggctagtgtattactgtgcgagaggtagcgggggacccaacgacgttacacgctagtcggacgtcgttcggggccgaaggggaacccg

SEQ ID NO: 298940 - DNA, 606 bp, Homo sapiens
  misc_feature: GZ8MTXP01AGXHS.13.21.B10.1.454.CMB.2.raw
  modified_base (291)..(291): a, c, t, g, unknown or other
  misc_feature (291)..(291): n is a, c, g, or t
  modified_base (401)..(401): a, c, t, g, unknown or other
  misc_feature (401)..(401): n is a, c, g, or t
tcagtcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtcgtgggggaggcttggtccagcctggggggtccctgagactctcctgtcaagcctctgggttcagcttcagtgtatattggatgagctgggtccnccagactccgagggaaggggctgggagtgggtggaccaacataaacacagacggaagtgacccatactatgcggactcgtgtggaacgggcctattccaccatctcaganacacgaccaagaactcactaatatttagactaaagtcggtaccgcgtaggaaggagaaccggaggaaccgacggacttaatcgtaattacgtgtggaacgaagagaagttggaaaggtggttcggacgttacggaacgggggtttcggggggaaccccggggtaaacccggttcgggttacccgtaaccggttcccgtaaacccg

SEQ ID NO: 298941 - DNA, 541 bp, Homo sapiens
  misc_feature: GZ8MTXP01CV9BJ.13.21.B10.1.454.CMB.2.raw
  modified_base (432)..(432): a, c, t, g, unknown or other
  misc_feature (432)..(432): n is a, c, g, or t
  modified_base (446)..(446): a, c, t, g, unknown or other
  misc_feature (446)..(446): n is a, c, g, or t
  modified_base (450)..(450): a, c, t, g, unknown or other
  misc_feature (450)..(450): n is a, c, g, or t
  modified_base (463)..(463): a, c, t, g, unknown or other
  misc_feature (463)..(463): n is a, c, g, or t
  modified_base (469)..(469): a, c, t, g, unknown or other
  misc_feature (469)..(469): n is a, c, g, or t
  modified_base (474)..(474): a, c, t, g, unknown or other
  misc_feature (474)..(474): n is a, c, g, or t
  modified_base (536)..(536): a, c, t, g, unknown or other
  misc_feature (536)..(536): n is a, c, g, or t
tcagtcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtctgggggaggcttggtccagcctggggggtccctgagactctcctgtcaagcctctgggttcagcttcagtgtatattggatgagctgggtccgccagactccgagggaaggggctgggagtgggtgccaacataaacacagacggaagtgaccatactatgcgactctgtgaagggccgattcgacatctcagacgacaacgccaaagaactcaactatattgacaaatcgaccnctgagagcgagacncggntaatgtaattacnggtcgngaagngattggagagttgggcttacgaagggttcgggggaaccggtaacctgggttcaacccggttnaaccg

SEQ ID NO: 298942 - DNA, 546 bp, Homo sapiens
  misc_feature: GZ8MTXP01DD69Y.13.21.B10.1.454.CMB.2.raw
  modified_base (332)..(332): a, c, t, g, unknown or other
  misc_feature (332)..(332): n is a, c, g, or t
  modified_base (393)..(393): a, c, t, g, unknown or other
  misc_feature (393)..(393): n is a, c, g, or t
  modified_base (413)..(413): a, c, t, g, unknown or other
  misc_feature (413)..(413): n is a, c, g, or t
  modified_base (468)..(468): a, c, t, g, unknown or other
  misc_feature (468)..(468): n is a, c, g, or t
  modified_base (490)..(490): a, c, t, g, unknown or other
  misc_feature (490)..(490): n is a, c, g, or t
  modified_base (525)..(525): a, c, t, g, unknown or other
  misc_feature (525)..(525): n is a, c, g, or t
tcagtcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtcgtgggggaggcttggtccagccgtggggggtccctgagactctcctgtcaagcctctgggttcagcttcagtgtatattggatgagctgggtccgccagactccgagggaaggggctgggaggtgggtggccaanataaaacacagacggaagtgacccatactatgcggactctgtgaagggccgattcacatcncagagacaacgcaagaactnactatattgacaaatggacccgctaggagaagagagacaggctaatgtaattacnggtgaacgagagcttggaaagngttggcttacgaagggttcgggggccgggtaaccngggttaccaaccgttcgaacc

SEQ ID NO: 298943 - DNA, 561 bp, Homo sapiens
  misc_feature: GZ8MTXP01DYZED.13.21.B10.1.454.CMB.2.raw
  modified_base (335)..(335): a, c, t, g, unknown or other
  misc_feature (335)..(335): n is a, c, g, or t
  modified_base (343)..(343): a, c, t, g, unknown or other
  misc_feature (343)..(343): n is a, c, g, or t
  modified_base (401)..(401): a, c, t, g, unknown or other
  misc_feature (401)..(401): n is a, c, g, or t
  modified_base (446)..(446): a, c, t, g, unknown or other
  misc_feature (446)..(446): n is a, c, g, or t
  modified_base (501)..(501): a, c, t, g, unknown or other
  misc_feature (501)..(501): n is a, c, g, or t
  modified_base (514)..(514): a, c, t, g, unknown or other
  misc_feature (514)..(514): n is a, c, g, or t
tcagtcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtcgtgggggaggcttggtccagccgtggggggtccctgagactctcctgtcaagcctctgggttcagcttcagtgtatattggatgagctgggtccgccagactccgaggggaaggggctgggagtggggtggaccaaanataaaacncgagaacggaagtgacccatactatgcggactctgtggaaagggccgattccaaccanctccagagacaacgcaaagactcactatattgacaaatggacccncgtgaagagacgaggacacggctaatgtattacgtgtgcgagagagttgaacggngttaggcttacgngggttcgggggcccggggtaacctggttacctaacccggttcaaccg

SEQ ID NO: 298944 - DNA, 609 bp, Homo sapiens
  misc_feature: GZ8MTXP01AIWAC.13.21.B10.1.454.CMB.2.raw
  modified_base (169)..(169): a, c, t, g, unknown or other
  misc_feature (169)..(169): n is a, c, g, or t
  modified_base (254)..(254): a, c, t, g, unknown or other
  misc_feature (254)..(254): n is a, c, g, or t
  modified_base (332)..(332): a, c, t, g, unknown or other
  misc_feature (332)..(332): n is a, c, g, or t
  modified_base (366)..(366): a, c, t, g, unknown or other
  misc_feature (366)..(366): n is a, c, g, or t
tcagtcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtntccagtgtgaggtgcaactggtggagtcgtggggggaggcttggtccagccgtggggggtccctgagactctcctgtcaagcctntgggttcagcttcagtgtatatggatgagcgtgggtccgccagactcgagggaaggggctggagtgggtggaccaaanataaaacacgaagacggaagtgaacccatactangcggactcgtagtgaagggccgattcgacctatcctaccgaagaacgaaccaaacgaccaaagaacctacaacttaatattacgactaaaagtcggaacccgccgtaggaagacgaaccggaggaccaggtactagtgttattacgtgtgcgaagagattaggacggtagttcgggcttacgggtaacggggttcggggggaacccgggtaaacctcggggttacctaaccggttccaaaccg

SEQ ID NO: 298945 - DNA, 581 bp, Homo sapiens
  misc_feature: GZ8MTXP01EUWWN.13.21.B10.1.454.CMB.2.raw
  modified_base (344)..(344): a, c, t, g, unknown or other
  misc_feature (344)..(344): n is a, c, g, or t
  modified_base (466)..(466): a, c, t, g, unknown or other
  misc_feature (466)..(466): n is a, c, g, or t
  modified_base (484)..(484): a, c, t, g, unknown or other
  misc_feature (484)..(484): n is a, c, g, or t
  modified_base (501)..(501): a, c, t, g, unknown or other
  misc_feature (501)..(501): n is a, c, g, or t
  modified_base (503)..(503): a, c, t, g, unknown or other
  misc_feature (503)..(503): n is a, c, g, or t
  modified_base (505)..(505): a, c, t, g, unknown or other
  misc_feature (505)..(505): n is a, c, g, or t
  modified_base (511)..(511): a, c, t, g, unknown or other
  misc_feature (511)..(511): n is a, c, g, or t
  modified_base (567)..(567): a, c, t, g, unknown or other
  misc_feature (567)..(567): n is a, c, g, or t
tcagtcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtcgtggggggaggcttggtccaggccgtggggggtccctgagactctcctgtcaagcctcgtgggttcagtcttcagtgtatattggatgagcgtcgggtccgccagactccgaaggggaaggggctgggaggtggggtcggaccaaanaataaacacgaaggacggaagtcgacccatactatgcggactcgtgtggaacgggccattccaccatcctaccagacgaaccaacgaccaaagactacacttatattgacaaagtcggaccncgtgaagagacgaggacncggctagtgtattacgngngngagagnttgagtggttggcttacggaagggggttccgggggaacccgggtaacctggacccnccggttaacaaccg

SEQ ID NO: 298946 - DNA, 613 bp, Homo sapiens
  misc_feature: GZ8MTXP01DAOMX.13.21.B10.1.454.CMB.2.raw
  modified_base (436)..(436): a, c, t, g, unknown or other
  misc_feature (436)..(436): n is a, c, g, or t
  modified_base (450)..(450): a, c, t, g, unknown or other
  misc_feature (450)..(450): n is a, c, g, or t
  modified_base (490)..(490): a, c, t, g, unknown or other
  misc_feature (490)..(490): n is a, c, g, or t
  modified_base (505)..(505): a, c, t, g, unknown or other
  misc_feature (505)..(505): n is a, c, g, or t
tcagtcacgtactacacgaccggtgctcgatttagtgtcgtcgcaaagagagaggagccttagccctggactccaaggcctttccacttggtgatcagcaatgagcacagaggactcaccatggcattggggctgaactgggttttccttgttgctattttagaaggtgtccagtgtgaggtgcaacgtggtggagtcgtggggggaggcttggtccagccgtggggggtccctgagactctcctgtcaagccctcgtgggttcagcttcagtgtatattggatggagcgtgggtccgccagactccgaaggggaaggggctggggaggtggggtacggaccaaacgaactaaaacgacgaaggaacggaagtcgaaccccatacctatggccggactcgtaggtggaacgggcccgtaattccaccatcacaganacaacgcaagaacncactatattgacaaagtcgaccgcgtagagagacgagacnggctagtgtattcgngtgaacgtaagagtagttggaagtggttacggttcttaacgggtaaggggttaccggggggaaccccgggtaacccgtgggttaccctaacccggttaacctaacccg

SEQ ID NO: 298947 - DNA, 574 bp, Homo sapiens
  misc_feature: GZ8MTXP01CIG9N.13.21.B10.1.454.CMB.2.raw
tcagtcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtcgtggggggaggcttggtccagccgtggggggtccctgagactctcctgtcaagcctctgggttcagcttcagtgtatattggatgagctgggtccgccagactccgaggggaaggggctgggaggtgggtggccaagataaacgacagacggaagtcgacccatactatgcggactcgtgtgaacgggccagttcaccatctacccagacgacaacgccaaagaactacaactatattgacaaagtcgaccgctgagagacgagacaggctagtcgtattacgtgtgaacgtagagattggaagtggttggcgttacggtaacggggttcgggggaacccgggtaacccgtcgggacctaacccggttaacaacccg

SEQ ID NO: 298948 - DNA, 699 bp, Homo sapiens
  misc_feature: GZ8MTXP01C8IXS.13.21.B10.1.454.CMB.2.raw
  modified_base (541)..(541): a, c, t, g, unknown or other
  misc_feature (541)..(541): n is a, c, g, or t
tcagtcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaacgtggtggagtcgtggggggaggtcgttggtccaggccgtggggggtccctgagactctctgtcagtcctcgtgggttcagtcttcgagtgtatagttggatgagcgtcgggtcccgcgagacgtccggaaggggaacggggcgtagggagggtggggtacggaccaaactaacgtaaaacgacgaaggaacggtaaagtacgaaccctaaagtacgtagtcggacggtactacgttggtaacggaaacggggcctaacttccgaacctacgtcctacccgaagaacgaaccgaaaccgaccgaaaagtaaccctactaaactttataagtttacgaactaaaagtcgggacccncgggtaggaacggaacgaacggtaacggaccacgggtacttaagttacgttaattacggtggtacgaacggtaagagtaagttggaaagtgttcgggcttaacgggtcggggttaccgggggaacccgggtaacctggttaccaaccgttaacaaccg

SEQ ID NO: 298949 - DNA, 576 bp, Homo sapiens
  misc_feature: GZ8MTXP01A1MPB.13.21.B10.1.454.CMB.2.raw
  modified_base (291)..(291): a, c, t, g, unknown or other
  misc_feature (291)..(291): n is a, c, g, or t
  modified_base (336)..(336): a, c, t, g, unknown or other
  misc_feature (336)..(336): n is a, c, g, or t
  modified_base (529)..(529): a, c, t, g, unknown or other
  misc_feature (529)..(529): n is a, c, g, or t
tcagtcacgtactacacgaccggtgctcgatttagtgtcgtcgcagagagaggaggccagcactaggagtcggcggtgtttccattcggtgatcagcagtgaacacagaggactcaccatggagtttgggctgagctgggttttcctcgttgctcttttaagaggtgtccagtgtcaggtgcagctggtggaatcgtgggggagcgtggtccagccgtggggaactccctgacactgtcttgtgtagcctctggattcagcttcagacctatggcatgcacgtgggtcccnccacggcccccaggcgaagggggctggagtggctgacttctttancatatgagtaggaatactaaaattcaatgacaagacctccggtaggaacgggcctactccaccgtcctccgaacgggaccaactaccaaacgaacctacttatactctagacaggatagaacacgtacctagacggaggtacgacgtacgtcggtctaggtaacttcttcgtagttcgacgtaacaaacgttnttaggtaagttggttaagggagtggttagttcgttaacggttaaccg

SEQ ID NO: 298950 - DNA, 649 bp, Homo sapiens
  misc_feature: GZ8MTXP01DVUZY.13.21.B10.1.454.CMB.2.raw
tcagtcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtcgtggggggagtcttggtccagccgtggggggtccctgagactctcctgtcagcctctgggttcagcttcagtgtatattggatgagcgtgggtccgcagactccgaaggggaggggctggggagtggggtagaccaaacataaacacgagacggaagtcgacccatactatgcggactcgtgtgaacgggccctaattcaaccatcctacccgagaacggaaccaaacggtacccaaaggaaccttacaactttataatttcggaacctaaaagttcggggaacccctccggttagggaacggaacggacggaagggaccaccgggtattaaagttggttaaaccttttacggtggtaggaacggtaagttagtagttaggaggtacggttcggttcgttacgggtaacggggtccgggggaacccggtacgtcggacctaaccgttcaacg

SEQ ID NO: 298951 - DNA, 536 bp, Homo sapiens
  misc_feature: GZ8MTXP01ANWZY.13.21.B10.1.454.CMB.2.raw
  modified_base (417)..(417): a, c, t, g, unknown or other
  misc_feature (417)..(417): n is a, c, g, or t
  modified_base (424)..(424): a, c, t, g, unknown or other
  misc_feature (424)..(424): n is a, c, g, or t
  modified_base (462)..(462): a, c, t, g, unknown or other
  misc_feature (462)..(462): n is a, c, g, or t
  modified_base (471)..(471): a, c, t, g, unknown or other
  misc_feature (471)..(471): n is a, c, g, or t
tcagtcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtctgggggagcttggtccagccgtggggggtccctgagactctcctgtcaagcctcgtgggttcagcttcagtgtatattggatgagctgggtccgcagactccgagggaaggggctggagtgggtggccaagataaacacagacagaagtgaaccccccatactatgcgaactctgtgaagggccatcaccatcaccagagacaacgtccaaagaacctanatatatnacaagtcgacgcagagagacgagacagatatgtatcgngtgagaganagtagagcggttgacgtaaggtggggtccgggggacccgggtaccgttggtaacccaaccgtaac

SEQ ID NO: 298952 - DNA, 585 bp, Homo sapiens
  misc_feature: GZ8MTXP01DPFXF.13.21.B10.1.454.CMB.2.raw
  modified_base (482)..(482): a, c, t, g, unknown or other
  misc_feature (482)..(482): n is a, c, g, or t
tcagtcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaacgtggtggagtcgtggggggaggcttggtccagccgtggggggtccctgagactctctgtcaagcctcgtgggttcagcttcagtgtatattggatgagcgtgggtccgccagactccggaaggggaggggctggggaggtggggtggaccaacataaacacgaggacggaagtgaccccatactatgcgactcgtgtggaagggccgattccaccatctcagagaacaacgaccaaagaactacaacttatattgactaaagtcggacccgcgtagagaagacgaggacacggtntatgttattacgtgtgaagagagtattggaagaggttggttcttacggtaagggggttcgggggaacccggggtaacctgggaccctaaccggttctaacccg

SEQ ID NO: 298953 - DNA, 633 bp, Homo sapiens
  misc_feature: GZ8MTXP01A9G0G.13.21.B10.1.454.CMB.2.raw
  modified_base (297)..(297): a, c, t, g, unknown or other
  misc_feature (297)..(297): n is a, c, g, or t
  modified_base (529)..(529): a, c, t, g, unknown or other
  misc_feature (529)..(529): n is a, c, g, or t
  modified_base (548)..(548): a, c, t, g, unknown or other
  misc_feature (548)..(548): n is a, c, g, or t
tcagtcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgcttattttagaaggtgtccagtgtgaggtgcaactggtggagtcgtgggggagtcttggtccagccgtggggggtccctgacgactctcctgtcaagtcctgtgggttcagtcttcagtgtatattggatgagcgtgggtccncagctccgagggagggctggagtgggtaggaccaagaataaacacgaggaacggtaagtcgacccctaatacctagtcggacggtactccgtggtaaggaacggggtcccatttaccaccctaattcctaccgagaacgaaccaaaccgtacccaaagtaaacctacctaaactttataacgtttcgactaaaagtcgggaacccgcgtaggagagacggaggtacacggtntaagtgtattacgtgtcgnggtagagagttgaggtagttgggccttagggaacgggttcgggggaacccgggtaacccggtggttccctaaccggttctccccg

SEQ ID NO: 298954 - DNA, 588 bp, Homo sapiens
  misc_feature: GZ8MTXP01EERE4.13.21.B10.1.454.CMB.2.raw
tcagtcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtcgtgggggaggcttggtccagccgtggggggtccctgagactctcctgtcaagcctctgggttcagcttcagtgtatattggatgagcgtgggtccgccagactccgaggggaaggggctgggagtggggtggaccaaacataaaacgacagaacggaagtcgacccatactatgcgactctgtggaaggccgattccaccatctaccagacgaccaacgccaaagaactacaacttaatattacgactaaagtcggaccgcgtagagacgaccgaggaccacggctaatgtattacgtgtggcgaagagtattggagtacggttggcttacggtaaggggttcgggggaacccgggtaacccgtgggttaccctaaccgttaacgaacccg

SEQ ID NO: 298955 - DNA, 532 bp, Homo sapiens
  misc_feature: GZ8MTXP01EUL7C.13.21.B10.1.454.CMB.2.raw
  modified_base (249)..(249): a, c, t, g, unknown or other
  misc_feature (249)..(249): n is a, c, g, or t
  modified_base (330)..(330): a, c, t, g, unknown or other
  misc_feature (330)..(330): n is a, c, g, or t
  modified_base (490)..(490): a, c, t, g, unknown or other
  misc_feature (490)..(490): n is a, c, g, or t
tcagtcacgtactacacgaccggtgctcgatttagtgtcgtcgcagagagaggaggccagcactaggagtcggcggtgtttccattcggtgatcagcagtgaacacagaggactcaccatggagtttgggctgagctgggttttcctcgttgctcttttaagaggtgtccagtgtcaggtgcagctggtggaatcgtgggggagcgtggtccagcctggggaatccctgacactgtcttgtgtagcctntggattcagcttcagaacctatggcatgcactgggtccgccaggcccccaggcaagggggctggagtggctgactctttancatatgataggaaagtacaaaaattcaatgcagactccgtagaagggccattcaccgtcaccagggacaactaccaaagaacaccttatatctagacaggatagaaacagcctgagaggtgacgatcggctgtaattacttctgttacgcgaacaaacgnttaggtaattggtttgggagtgggattgggttcgtttaaccg

SEQ ID NO: 298956 - DNA, 582 bp, Homo sapiens
  misc_feature: GZ8MTXP01D9M31.13.21.B10.1.454.CMB.2.raw
  modified_base (330)..(330): a, c, t, g, unknown or other
  misc_feature (330)..(330): n is a, c, g, or t
  modified_base (406)..(406): a, c, t, g, unknown or other
  misc_feature (406)..(406): n is a, c, g, or t
  modified_base (438)..(438): a, c, t, g, unknown or other
  misc_feature (438)..(438): n is a, c, g, or t
  modified_base (486)..(486): a, c, t, g, unknown or other
  misc_feature (486)..(486): n is a, c, g, or t
tcagtcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgcttattttaaaaggtgcccagtgtgaggtgcagctggtggagtcgtggaggaggcttgatccagccgtggggggtccctgagactctcctgtgcagcctcgtgggttcaccgtcagtcacacctacatgagcgtgggtccgccaggctcgagggaggggctggagtcgcgtctttnttttattatagtagtggtagtacatactcgcagaactcgtgaggggccattcacatctacagagacaattccaaanacctacgtcttgttacttacaaaatcgaaacncgacctgaagacgccgaagtcgacgaccgggtcttagtattacgtggngcggtagacggtcggttaccgggaccctaacggttaacgttaccgacgtcgtaggtcgggtacggtcgggttacggggtaaccgttaacgggtccg

SEQ ID NO: 298957 - DNA, 616 bp, Homo sapiens
  misc_feature: GZ8MTXP01CF06R.13.21.B10.1.454.CMB.2.raw
  modified_base (336)..(336): a, c, t, g, unknown or other
  misc_feature (336)..(336): n is a, c, g, or t
  modified_base (343)..(343): a, c, t, g, unknown or other
  misc_feature (343)..(343): n is a, c, g, or t
  modified_base (364)..(364): a, c, t, g, unknown or other
  misc_feature (364)..(364): n is a, c, g, or t
  modified_base (492)..(492): a, c, t, g, unknown or other
  misc_feature (492)..(492): n is a, c, g, or t
  modified_base (524)..(524): a, c, t, g, unknown or other
  misc_feature (524)..(524): n is a, c, g, or t
  modified_base (540)..(540): a, c, t, g, unknown or other
  misc_feature (540)..(540): n is a, c, g, or t
tcagtcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgcttattttagaaggtgtccagtgtgaggtgcaactggtggagtcgtgggggaggcttggtccagccgtggggggtccctgagactctcctgtcaagcctgtgggttcagtcttcagtgtatattggatgagcgtcgggtccgccagacctccgaggggaaggggctgggagtgggtgccaanataaacncaggagagtcgaccatactangcgactctgtggaacgggccgtattcaaccgtatcctacccgaagacgaaccaacgaccgaaaacgaacctctaacttaatacgtttgaaccaaagtcgggacccctacgtaggaacgacggaaccgnggaaccacgggaccttagtcgttatttacggngtgaacggaagagtangggaagtggttacggcgttacgggtaaggggtcccgggggaacccgggtacctggttacccaaccggttaacaacg

SEQ ID NO: 298958 - DNA, 546 bp, Homo sapiens
  misc_feature: GZ8MTXP01DDUH0.13.21.B10.1.454.CMB.2.raw
  modified_base (375)..(375): a, c, t, g, unknown or other
  misc_feature (375)..(375): n is a, c, g, or t
  modified_base (404)..(404): a, c, t, g, unknown or other
  misc_feature (404)..(404): n is a, c, g, or t
  modified_base (427)..(427): a, c, t, g, unknown or other
  misc_feature (427)..(427): n is a, c, g, or t
  modified_base (449)..(449): a, c, t, g, unknown or other
  misc_feature (449)..(449): n is a, c, g, or t
  modified_base (478)..(478): a, c, t, g, unknown or other
  misc_feature (478)..(478): n is a, c, g, or t
  modified_base (489)..(490): a, c, t, g, unknown or other
  misc_feature (489)..(490): n is a, c, g, or t
  modified_base (495)..(495): a, c, t, g, unknown or other
  misc_feature (495)..(495): n is a, c, g, or t
  modified_base (508)..(508): a, c, t, g, unknown or other
  misc_feature (508)..(508): n is a, c, g, or t
  modified_base (527)..(527): a, c, t, g, unknown or other
  misc_feature (527)..(527): n is a, c, g, or t
tcagtcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtcgtggggggaggcttggtccagccgtggggggtccctgagactctcctgtcaagcctcgtgggttcagcttcagtgtatattggatgagctgggtccgccaggactccgaaggggaaggggctggggaggtggggtggaccaaacaataaaacacgaggacggaagtgacccatactangcggactctgtgagggccgattcacatcnccagagaacacgccaaagactanactatattgacaaatcggaccncgtagagagacgagcacggctatgtatangtgaagagagnnggagngttggcttacggngggtcggggccgggtaacngggacctaacgttcaaccg

SEQ ID NO: 298959 - DNA, 652 bp, Homo sapiens
  misc_feature: GZ8MTXP01ALS77.13.21.B10.1.454.CMB.2.raw
  modified_base (344)..(344): a, c, t, g, unknown or other
  misc_feature (344)..(344): n is a, c, g, or t
  modified_base (378)..(378): a, c, t, g, unknown or other
  misc_feature (378)..(378): n is a, c, g, or t
tcagtcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaggtgtccagtgtgaggtgcaactggtggagtcgtgggggaggcttggtccagccgtggggggtccctgagactctcctgtcagcctcgtgggttcagtcttcagtgtatagttggatggagtcgtcgggtccgaccgagacgtccggaggggaggggctggggaggtggggtcgaccaanaataaacgacgaggaacggagcgaccatactagnggcgactcgtgtcggaacgggccgtattccgaccactctaccgagaacgaaccaaccgaccaaagaactaccacttatacgtttacgactaaacgtcggaacccgtacggtaggaacggaacggaacgggaacggaccgacggtacttagtacgttacttacgtggtggaacgaaggacgtagttaggaaggtaggttcgggacgttacgggtaacgggggttcgggggaaccccggggtaccggtcgggttaccgtaaccccgttcgaacccg

SEQ ID NO: 298960 - DNA, 645 bp, Homo sapiens
  misc_feature: GZ8MTXP01CS1U4.13.21.B10.1.454.CMB.2.raw
  modified_base (297)..(297): a, c, t, g, unknown or other
  misc_feature (297)..(297): n is a, c, g, or t
  modified_base (399)..(399): a, c, t, g, unknown or other
  misc_feature (399)..(399): n is a, c, g, or t
tcagtcacgtactacacgaccggtgctcgatttagtgtcgtcgcaaagagagaggagcccagccctgggattttcaggtgttttcatttggtgatcaggactgaacagagagaactcaccatggagtttgggctgaactggtcttttttcttgtggcttattttaagaggtgtccagtgtgaggtgcaactgttggagtcgtgggggagcttggtcagccgtgggggtccctgacgactctcgtgtgcagcctcgtggtatttagttttagctagttatgcctatgagctgggtccnccgaggctccgaggggaagggcgtgggaggttgggggtttcggtagttagtgtctcgttgatgatagcacactactatgcagactccgtaaggcctctcacntctcagacgacactacaagtaacacgactatactctagcaagatacgaacgacggtacccggtagggaaccggacccggaacgggtaacccggaccggtacccgttttaacgtcccgtaacgtggtaacggaacgtaaaaggttatttaaagttaggtaaagttcggttaagttacgggttacgtaaccgtggttaacccttaacgttaccgttaaccgtttttcgaacccggtttaacccggggg

SEQ ID NO: 298961 - DNA, 604 bp, Homo sapiens
  misc_feature: GZ8MTXP01BD7RJ.13.21.B10.1.454.CMB.2.raw
  modified_base (439)..(439): a, c, t, g, unknown or other
  misc_feature (439)..(439): n is a, c, g, or t
tcagtcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttaaaaggtgcccagtgtgaggtgcagctggtggagtctggaggaggcttgatccagccgtgggggtccctgagactctcctgtgcagcctctgggtcaccgtcagtcacacctacatgagcgtgggtccgccgaggcctccgaggggaaggggctggagtgcgtcttcttttattatagtagtggtataccatactccgcagaactccgtggacggggccgattcacctatctaccagagacaatccaaagaacacgtcttgtttctacaaatgaaacngccgtagagagccgatgaaccacggaccgttgtaacgttacctgggtcgaacggaaggttaaggaggttccgggggacccctaacggttaaaccggtttcttaaccggaacgttaggtcggggtaccgtcggttacggggggaaccccgttaaagggggaacccc

SEQ ID NO: 298962 - DNA, 614 bp, Homo sapiens
  misc_feature: GZ8MTXP01D25WK.13.21.B10.1.454.CMB.2.raw
  modified_base (486)..(486): a, c, t, g, unknown or other
  misc_feature (486)..(486): n is a, c, g, or t
  modified_base (519)..(519): a, c, t, g, unknown or other
  misc_feature (519)..(519): n is a, c, g, or t
  modified_base (529)..(529): a, c, t, g, unknown or other
  misc_feature (529)..(529): n is a, c, g, or t
tcagtcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgcttattttagaaggtgtccagtgtgaggtgcaacgtgggtggagtcgtggggggaggtcgttggtccaggccgtggggggtccctgagactctcctgtcaagcctgtgggttcagcttcagtgtatattggatgagcgtgggtccgccagactccgaggggaagggggctgggaggtggggtggacccaaacgataaaaccacgaaggaacggaaagtcgaacccaatactagtggacggactcctggtggaaaggggcccattccaaccgtatcctcaagacgaacaacgaccaaagaactacaacttatacttagacaaagtggaacccncgtagagagacgaggacacggctatgtatacgngtgcgtaagngattggaagagggttcgcgttaacgggtgggttacgggggcccggggtaacccgtcgggttaccgtaacccggttaacaaacccg

SEQ ID NO: 298963 - DNA, 690 bp, Homo sapiens
  misc_feature: GZ8MTXP01AU9BL.13.21.B10.1.454.CMB.2.raw
  modified_base (350)..(350): a, c, t, g, unknown or other
  misc_feature (350)..(350): n is a, c, g, or t
  modified_base (548)..(548): a, c, t, g, unknown or other
  misc_feature (548)..(548): n is a, c, g, or t
tcagtcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtcgtgggggagcttggtccagccgtgggggtcctgagactctcctgtcaagcctcgtgggttcagtcttcgagtgtatattggatgagtcgtcgggtccgccgaggacctccggaagggggacggggcgtgggaggtgggggtacggacccaaanaagtaaaaccgacgaaggaacggaagtacggaccccaattacctaagtcggacggaacctcgttagggtaacgggaaacgggtcccgaatttcccaacgtactcctacccgaagaacgaaccaacgaccctaaaagaaccttcaacttatattacgacaaagtcggaacccgcgtaggaacggagaccggaaggaccncgggtactaagttcggtaattacgtgtggaacgaaggttagaagttggaaaccggtgttacgggccgttaagggtaaccgggggttacggggggccccggggttaaccctggggttaccccctaacgggttaacctaaaccg

SEQ ID NO: 298964 - DNA, 615 bp, Homo sapiens
  misc_feature: GZ8MTXP01DSKE6.13.21.B10.1.454.CMB.2.raw
  modified_base (390)..(390): a, c, t, g, unknown or other
  misc_feature (390)..(390): n is a, c, g, or t
  modified_base (528)..(528): a, c, t, g, unknown or other
  misc_feature (528)..(528): n is a, c, g, or t
  modified_base (550)..(550): a, c, t, g, unknown or other
  misc_feature (550)..(550): n is a, c, g, or t
tcagtcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaacgtggtggaggtcgtggggggaggcttggtccagccgtggggggtccctgagactctcctgtcaagcctcgtgggttcagtcttcagtgtatattggatgagcgtgggtccgccgagacgtccgaaggggaagggggctggggaggtggggtacggaccaaacaacgtaaaacacgaagaacggaagtcgaccctagtactagngcgactcgtagtggaacgggccattccacactctcagaacgaacaacgacaaagaactacaacttattattacgacaaacgtcggaacccgcgtagaaggacgaacggaggaaccgacggtactagtcttacgttacnggtgcgaaggagacttaggagnggttggcttaggaacggggttacgggggaacccgggacccgttggacctaaccgttaaccaaccg

SEQ ID NO: 298965 - DNA, 712 bp, Homo sapiens
  misc_feature: GZ8MTXP01BVGUX.13.21.B10.1.454.CMB.2.raw
tcagtcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtcgtggggggaggcttggtccagccgtggggggtccctgagactctcctgtcaagcctcgtgggttcagtcttcagtgtatagttggatgagcgtgggtccgcaggactccgaaggggacgggcgtgggaggtgggtcggaccaaacgaataaaacgacgaaggtaacggaaggtcgaaccactacctagtcggacggaacttcgtagggtcggaaacggggcccgtaattacccaacctatccgtacccgaaggaaacgaaccaaaaccggaccaaaagtaaaccttaccaaacctttaagttaacgtttacgaaacctaaaagttccggggaacccgtcccggtaagggaaacggaacgaccgggaaacggaaccgaccgggtacttaagttacgttaattacgtgggttgaacgggtaagaggtaacggttccgggggaacccctaaggttaaccgtttacgaccgtgtacgtcgggacggttcggacgggggtaacccgaaaggggaaccccg

SEQ ID NO: 298966 - DNA, 831 bp, Homo sapiens
  misc_feature: GZ8MTXP01D0MDJ.13.21.B10.1.454.CMB.2.raw
  modified_base (349)..(349): a, c, t, g, unknown or other
  misc_feature (349)..(349): n is a, c, g, or t
tcagtcacgtactacacgaccggtgctcgatttagtgtcgtcgcaaagagagaggagccttagccctggactccaaggcctttccacttggtgatcagcactgagcacagaggactcaccatggcattggggctgaacttgggttttccttgttgctattttagaaggtgtccagtgtgaggtgcaagtggtggagtcgtggggggaggtcttggtccaggccgtggggggtccctggagctctcctgtcagcctgtgggttcagtcttcgagtgtatagttggatggagtcgtggtcccgcgagacctccggaggggaggggctggggaggtggggtaggacccaaanaactaaaacgaccgaaaggaaccggtaaagtccgaaacccctaagttaaccgtaagtcggaccgtacttaccgttagggtaacgggaaccggggcctaactttacccaaccgtaacttcgtacccaaaggaaacgaacccaaaccgggaaccctaaaaggaaaccttaccctaaaactttacgtttaaagtttcgggaaaaccttaaaacggttaccggggtaacccccgcggttaaaggggaaaccggtaagggaaacccgggaacgggaaaccgtaaaccgggggttacctttaaagttacggtttaaaccgtttttaacgggcggtaacgggaaacggaaagggaggtaacgttaaggggtaacgggtagggttccggttaaccgggttaaccgggggttaacggggggttaccccggggggtaaccccggggttaaccccgttcgggttaacccctaacccgggttaacctaaacccg

SEQ ID NO: 298967 - DNA, 569 bp, Homo sapiens
  misc_feature: GZ8MTXP01ADPZY.13.21.B10.1.454.CMB.2.raw
  modified_base (291)..(291): a, c, t, g, unknown or other
  misc_feature (291)..(291): n is a, c, g, or t
  modified_base (323)..(323): a, c, t, g, unknown or other
  misc_feature (323)..(323): n is a, c, g, or t
  modified_base (330)..(330): a, c, t, g, unknown or other
  misc_feature (330)..(330): n is a, c, g, or t
tcagtcacgtactacacgaccggtgctcgatttagtgtcgtcgcaaagagagaggagccttagccctggactccaaggcctttccacttggtgatcagcaatgagcacagaggactcaccatggcattggggctgaactgggtttcctgttgctattttagaaggtgtccagtgtgaggtgcaactggtggagtcgtgggggaggcttggtccagccgtggggggtccctgagactctcctgtcaagcctcgtgggttcagcttcgagtgtatatggatgagctgggtccncagactcgagggagggctggagtggtgccaanataaacncagacggagtcgaccatactagtgcgactctgtcgaggccgattcacatctcagagacaacgcaagactcgactatagttacgactaaagtcgggaccgccgtaggaacgtacggacgaacgggactacgggacttaagtgtaattaccgtggtgcgtagacgaagttggaacgtagttcggacttacggaagggttcgggggaacccgggtaccgtggttacccaacggttctaaccg

SEQ ID NO: 298968 - DNA, 716 bp, Homo sapiens
  misc_feature: GZ8MTXP01DZDEX.13.21.B10.1.454.CMB.2.raw
  modified_base (275)..(275): a, c, t, g, unknown or other
  misc_feature (275)..(275): n is a, c, g, or t
  modified_base (600)..(600): a, c, t, g, unknown or other
  misc_feature (600)..(600): n is a, c, g, or t
tcagtcacgtactacacgaccggtgctcgatttagtgtcgtcgcaaagagagaggagccttagccctggactccaaggcctttccacttggtgatcagcactgagcacagaggactcaccatggcagttggggctgaacttgggtttttccttgttgcttattttagaaggtgtcagtgtgaggtgcaacgtggtggagtcggtggggggaggtcgttggtccaggccgtggggggtccctgacgtctctcctgtcagcctgtgggtcagtcttnagtgtatagtggatggagtcgtcgggtcccgcacgctccggaagggggacggggtcgtagggaggtgggtacggacaaacataaacacgagacggaagtcgaacctatactagtcggaccgtacttcgtaggtcgggaaacgggtcccgtaacttcccgaaccgtacttacccgtaccgaagggaacaaccccgaaacgacccaaaacggtaaacttacccctaatttaattaacgttacgaaaccttaaaaggtccgggaaccctcggtaggaaggaacgaacggacgaaccgacgggttcttaaatggtttaaacttcgtggnggaacgaagggttaagtagttagggaaacggttagggttcgggttaccgttacgggtgggggttaccgggggaaccccggtaaccggttggaacccctcccgggttaataacccgg

SEQ ID NO: 298969 - DNA, 804 bp, Homo sapiens
  misc_feature: GZ8MTXP01DEEGO.13.21.B10.1.454.CMB.2.raw
  modified_base (298)..(298): a, c, t, g, unknown or other
  misc_feature (298)..(298): n is a, c, g, or t
  modified_base (655)..(655): a, c, t, g, unknown or other
  misc_feature (655)..(655): n is a, c, g, or t
tcagtcacgtactacacgaccggtgctcgatttagtgtcgtcgcaaagagagaggagccttagccctggactccaaggcctttccacttggtgatcagcactgagcacagaggactcaccatggcattggggctgaactggtattttccttgttgcttattttagaaggtgtcagtgtgaggtgcaacgtggtggagtcgtgggggagcttggtccaggccgtgggggtccctgagactctcctgtcaacgtcctcgtgggttcagtcttcagtgtatagtggatgagcgtcggtccncagactcggaggggaggcgtgggagtgggtacgaccaaagaataaacacgaagaacggaagtcgaacccccagtactagcggacggtaaaccttgtggtacgggaaacgggtccgtaacttaccgaacctacttacccgtaaccgaaagggaaaccggaaaccccaaaacggaccccttaaaaaggtaaaacccctttacccgtaaaacttttaatttaaaagtttcggaaaaaccccgtttaaaagggtccggggaaaccccccggtgttaaaggggaaaaccgaacgggaaacccgggaaagggtttaaccccaacggggtttactttaaagttacggttaaaattttaccgggnggggtaacgaacgggttaaaggtaaaggttaccggtaggggtaaaggggttcccggttacggggttaaccgttaaaccgggggtcggggggtttaaccccggggggaaccccgggttaaccttacgggttaaccccgaaaccgtaaccg

SEQ ID NO: 298970 - DNA, 718 bp, Homo sapiens
  misc_feature: GZ8MTXP01AXWWU.13.21.B10.1.454.CMB.2.raw
  modified_base (616)..(616): a, c, t, g, unknown or other
  misc_feature (616)..(616): n is a, c, g, or t
  modified_base (643)..(643): a, c, t, g, unknown or other
  misc_feature (643)..(643): n is a, c, g, or t
tcagtcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaacgtggtggagtcggtgggggaggtcgttgggtccaggccggtggggggtccctggagactctcctgtcaagcctcgtggttcagtcttcagtgtatagttggatgagtcgtcgggtccgccaggaccgtaccggagggggaacgggggtcgtggggaggttgggggtcggaaccaaacgaagtaaaacacgaaggaacggaagtcgaaccctatactagtcgaccggtactcgtagggtaacggaaacggggtcccgtaacgttacccaaccgtactaccctacccgaaaggaaccgaaaccgaaacccggacccaaaagtaacctacctaaactttaagttaactttacggaaactaaaagtcgggaacccctcgggtaggaaacggacgaacgggaaggaccgacggtacttagtgttaactttacgnggtcggaagagttaggagttaggaagnggttcggcttacgggtaagggggttcccgggggaacccggtaaccgtgggttaccctaaccgggttctaaacccg

SEQ ID NO: 298971 - DNA, 557 bp, Homo sapiens
  misc_feature: GZ8MTXP01CAB2W.13.21.B10.1.454.CMB.2.raw
  modified_base (371)..(371): a, c, t, g, unknown or other
  misc_feature (371)..(371): n is a, c, g, or t
  modified_base (386)..(386): a, c, t, g, unknown or other
  misc_feature (386)..(386): n is a, c, g, or t
  modified_base (457)..(457): a, c, t, g, unknown or other
  misc_feature (457)..(457): n is a, c, g, or t
tcagtcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtcgtgggggaggcttggtccagcctggggggtccctgagactctcctgtcaagcctctgggttcagcttcagtgtatattggatgagctgggtccgcagactccgaggggaaggggctggagtgggtgccaacataaacacgagacggaagtcgacccatactatgcggactctgngaagggccattcacntctcagagacaacgcaagactcacttatattgacaaagtcgaccgccgtagagaagacgaggaccacgggntagtgtattacgtggtgcgagagattggaagtggttcggcttacggtggggttccgggggcccgggtaacccgtgggttaccctcccgttaacgaacccg

SEQ ID NO: 298972 - DNA, 555 bp, Homo sapiens
  misc_feature: GZ8MTXP01AHIYB.13.21.B10.1.454.CMB.2.raw
  modified_base (455)..(455): a, c, t, g, unknown or other
  misc_feature (455)..(455): n is a, c, g, or t
  modified_base (515)..(515): a, c, t, g, unknown or other
  misc_feature (515)..(515): n is a, c, g, or t
  modified_base (550)..(550): a, c, t, g, unknown or other
  misc_feature (550)..(550): n is a, c, g, or t
tcagtcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtcgtgggggaggcttggtccagccgtggggggtccctgagactctcctgtcaagcctcgtgggttcagtcttcagtgtatattggatgagctgggtccgccagactccgaggggaaggggctgggagtggggtcgaccaaacataaaacacgaggaacggaagtcgaaccccatacctatgcggactctgtggaagggcccgtattccaccatctaccagagacaacgcaaagactcactatattgacaaatcggaaccnctagagagacgagcaggcttatgtatacgtgtgcgagagattgaagagttcgcttacggngggtcgggggcccgggtactgggcctaaccggttnaaccg

SEQ ID NO: 298973 - DNA, 639 bp, Homo sapiens
  misc_feature: GZ8MTXP01BFV7M.13.21.B10.1.454.CMB.2.raw
  modified_base (382)..(382): a, c, t, g, unknown or other
  misc_feature (382)..(382): n is a, c, g, or t
tcagtcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtcgtgggggaggcttggtccagccgtgggggtccctgagactctcctgtcaagtcctcgtgggttcagcttcagtgtatattggatggagcgtgggtccgccagacgtccgaaggggacggggctgggaggtggggtggacccaaacaagtaaaacacgaggaacggaagtcgaacccaatacgtanggcgactcgtaggtgaacggggcctaattccacctatcctaccaagaacgaaccaaaccggaccaaaggaaccctacgaacttaattaatttagacctaaaagttcgggaccgaccgtaggaacgaacggacgaacggaccgacggtcctaagttcgtaattacgtggtagcgaggttaagagttaggagtacgttacggcttacggtgggtccgggggaacccgggtaaccgtggacccgtaaccgttcgaacccg

SEQ ID NO: 298974 - DNA, 668 bp, Homo sapiens
  misc_feature: GZ8MTXP01CYDQI.13.21.B10.1.454.CMB.2.raw
  modified_base (271)..(271): a, c, t, g, unknown or other
  misc_feature (271)..(271): n is a, c, g, or t
  modified_base (594)..(594): a, c, t, g, unknown or other
  misc_feature (594)..(594): n is a, c, g, or t
tcagtcacgtactacacgaccggtgctcgatttagtgtcgtcgcaaagagagaggagccttagccctggactccaaggcctttccacttggtgatcagcactgagcacagaggactcaccatggcattggggctgaacttgggttttccttgttgctattttagaaggtgtccagtgtgaggtgcaactggtggagtcgtggggggagcttggtccaggccgtggggggtccctgacgactctcctgtcaacgcctgtgggttcagtcttnagtgtatatggatggagtcgtgggtccgcaggactccggaagggggaggggcgtgggaggtgggggtacgaccaaactaacgtaaacgacgaggaacggaaagtcgaaccctaatacgtagtggaccgactcgtaggtcggaaacggggtcccgtaattaccatacacttccgaccgaagaaacgaacaaaccgacctaaaagaacccttactaacttaattagttacgaactaaacgtcggaccgtcgtaaggaacgacgaaccggaagaccgtacgtaattacgtgttaaaccttgtaggtcgaaggagagttagtacggnggttaacgttcggaaccgttaagggaagggggttcccggggaacccgggtaccttacgggtccgaaacccggtc

SEQ ID NO: 298975 - DNA, 643 bp, Homo sapiens
  misc_feature: GZ8MTXP01DUYBN.13.21.B10.1.454.CMB.2.raw
  modified_base (289)..(289): a, c, t, g, unknown or other
  misc_feature (289)..(289): n is a, c, g, or t
  modified_base (333)..(333): a, c, t, g, unknown or other
  misc_feature (333)..(333): n is a, c, g, or t
  modified_base (569)..(569): a, c, t, g, unknown or other
  misc_feature (569)..(569): n is a, c, g, or t
tcagtcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaacgtggtggagtcgtgggggaggctggccaggccgtgggggtccctgagctctctgtcagcctcgtgggtcagtcttcagtgtatatggatgagcgtgggtccncagactccggaaggggaggggcgtggaggtgggtacgaccaaanaagtaaaacacgagaacggaagtcgaacccatactagtcggcgtactcgtgtcgggaacgggacccgtacttaccaacctacttacctaaccgagaacgaaccgaaccgacccaaagaaacctactaacttaattagttacgaactaaagttccggaacccgtcggtaaggaaggaacgaacgggaacgaccgacggacttaagtcgttaattacgtgtagaacgtaaggagtagnggaagtggttaggacgttagggtaacggggtaccgggggccgggtaacctcgggacctaaccggttaacaaccg

SEQ ID NO: 298976 - DNA, 654 bp, Homo sapiens
  misc_feature: GZ8MTXP01BXIX4.13.21.B10.1.454.CMB.2.raw
tcagtcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgcttattttagaaggtgtccagtgtgaggtgcaactggtggagtcgtgggggaggtcttggtccaggccgtcggggggtccctgagactctcctgtcagcctcgtgggttcagtcttcagtgtatagttggatgagcgtgggtcccgccaggacgtccggaaggggaggggcgtgggaggtggggtaggaccaaacaataaacacgaggacggaagtcgaccatactagtgcgactcgtggtcggaacgggtccacttccacctactcctaccagaacgaccaacgacaaagaacctacgaacttaattacttcgaaccgtaaagtcgggaacccgtcgtaggaaaggacggacgaggaaccgacggtcttaagtcgtaattaccggtgtgaacggtaagagtagttggaaggtggttggttcgttaacgggtaagggggtttcccgggggaacccggggttaaccccttgggttaacccctaaccggttaacctaacccg

SEQ ID NO: 298977 - DNA, 716 bp, Homo sapiens
  misc_feature: GZ8MTXP01BAG44.13.21.B10.1.454.CMB.2.raw
  modified_base (171)..(171): a, c, t, g, unknown or other
  misc_feature (171)..(171): n is a, c, g, or t
  modified_base (524)..(524): a, c, t, g, unknown or other
  misc_feature (524)..(524): n is a, c, g, or t
tcagtcacgtactacacgaccggtgctcgatttagtgtcgtcgcaaagagagaggagccttagccctggactccaaggcctttccacttggtgatcagcactgagcacagaggactcaccatggcattggggctgaacttgggttttccttgttgcttattttagaaggtntccagtgtgaggtgcaacgtggtggagtcgtgggggagtcttggtccagccggtgggggtccctgacgtactctcctgtcaagtcctgtggttcagtcttctagtgtatattgatgagcgtcggtccgcacgtacgtaccggaaggggaacggggtctaggggaggtcgggtacggaacccaaacgaacgtaaaacgacgaacggtaaacggtaacgtacgacccctaattaaccgtaagtcggtaccggtacttacgtacggtaaggggaaacgggaccctaacttacccgtaacctactacctaccgagacgaacaaacgtacaaacgtactaacctagtaacttagttanaactaagtacgggaccctacgggtaggaaacggtaggaaaccgtacggaaccgacggtaacttagtgtttaaccgttagtgtcggaagtaaaggagttagttgtaaggacggttacgttacgttacgggtaacgggggttcccggggaacccgggttaccgtacgggacccgtaacccgttaactaaccccg

SEQ ID NO: 298978 - DNA, 359 bp, Homo sapiens
  misc_feature: GZ8MTXP01AJRT8.13.21.B10.1.454.CMB.2.raw
  modified_base (352)..(359): a, c, t, g, unknown or other
  misc_feature (352)..(359): n is a, c, g, or t
tcagtcacgtactacacgaccggtgctcgatttagtgtcgtcgcaagagaggaggggggtgccagggggaagaccgatgggcccttggtgaaggcctcggacaccgccatgtattactgtgcaaatacgcatactacggtaattcaccggcttactactacaacggtatggacgtctggggccaagggaccacggtcaccgtctcctcagcctccaccaagggcccatcggtcttccccctggcaccctcctccaagagcacctcgtgggggcacgagcggccctgggctggccctggtcaaggactacttacctagtacgtgactgagcgggctggcaaggtcgctatagnnnnnnnn

SEQ ID NO: 298979 - DNA, 539 bp, Homo sapiens
  misc_feature: GZ8MTXP02HPQUE.13.21.B10.1.454.CMB.2.raw
  modified_base (327)..(327): a, c, t, g, unknown or other
  misc_feature (327)..(327): n is a, c, g, or t
  modified_base (334)..(334): a, c, t, g, unknown or other
  misc_feature (334)..(334): n is a, c, g, or t
tcagtcacgtactacacgaccggtgctcgatttagtgtcgtcgcaaagagagaggagccttagccctggactccaaggcctttccacttggtgatcagcactgagcacagaggactcaccatggcattggggctgaactgggtttccttgttgctattttagaaggtgtccagtgtgaggtgcaactggtggagtctgggggaggcttggtccagcctgggggtccctgagactctcctgtcaagcctctgggttcagcttcagtgtatattggatgagctgggtccgccagacctccgagggaaggggctggagtgggtggccaanataaacnagacggaagtgacccatactatgcggactctgtgaaagggccattccacatctccagagacaacgcaagaactcactatatttgactaaatggaccgcctagagagacgagacacggctatgtattacgtgtagcgagagatggagagtcggctacgaaggttcgggggacccggggtaacccgtggtaccaccggttcaaaccg

SEQ ID NO: 298980 - DNA, 544 bp, Homo sapiens
  misc_feature: GZ8MTXP02HEMZD.13.21.B10.1.454.CMB.2.raw
  modified_base (329)..(329): a, c, t, g, unknown or other
  misc_feature (329)..(329): n is a, c, g, or t
  modified_base (437)..(437): a, c, t, g, unknown or other
  misc_feature (437)..(437): n is a, c, g, or t
  modified_base (479)..(479): a, c, t, g, unknown or other
  misc_feature (479)..(479): n is a, c, g, or t
tcagtcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtcgtgggggaggcttggtccagccgtgggggtccctgagactctcctgtcaagcctctgggttcagcttcagtgtatattggatgagctgggtccgcagactccgagggaaggggctggagtgggtggccaaanataaaacacagaacggaagtgaccatactatgcggactctgtgaaagggcattcaccatctccagagaacaacgccaaagaactcactatattgacaaaatggaaccnctagagagacgagacacggctatgtattactgtagcgaaganatgagacgtggactaacgaaggttcgggggacccggggaaccctggtccgaacccggtcaaaccg

SEQ ID NO: 298981 - DNA, 550 bp, Homo sapiens
  misc_feature: GZ8MTXP02I47E5.13.21.B10.1.454.CMB.2.raw
  modified_base (440)..(440): a, c, t, g, unknown or other
  misc_feature (440)..(440): n is a, c, g, or t
  modified_base (472)..(472): a, c, t, g, unknown or other
  misc_feature (472)..(472): n is a, c, g, or t
  modified_base (514)..(514): a, c, t, g, unknown or other
  misc_feature (514)..(514): n is a, c, g, or t
  modified_base (519)..(519): a, c, t, g, unknown or other
  misc_feature (519)..(519): n is a, c, g, or t
tcagtcacgtactacacgaccggtgctcgatttagtgtcgtcgcaaagagagaggagccttagccctggactccaaggcctttccacttggtgatcagcactgagcacagaggactcaccatggcattggggctgaactgggtttccttgttgctattttagaaggtgtccagtgtgaggtgcaactggtggagtctgggggaggcttggtccagcctgggggtccctgagactctcctgtcaagcctctgggttcagcttcagtgtatattggatgagcgtgggtccgccagacctccgaggggaggggctggaggtgggtggaccaacataaacacaggacggaagtcgacccatactatgcggactcgtgtggaagggccgattccaccatcctccagagacaacgcaaagactcactatattgacaaatcggaccncctagagagacgagacaggctatgttattacngtgacgagagacgtcggggacccaacggtaaccgttacacgntacgnggtaccgtgtacggggacctaacggggaccc

SEQ ID NO: 298982 - DNA, 539 bp, Homo sapiens
  misc_feature: GZ8MTXP02HL2R4.13.21.B10.1.454.CMB.2.raw
  modified_base (472)..(472): a, c, t, g, unknown or other
  misc_feature (472)..(472): n is a, c, g, or t
tcagtcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtctgggggaggcttggtccagcctgggggtccctgagactctcctgtcaagcctctgggttcagcttcagtgtatattggatgagctgggtccgccagactccgagggaaggggctggagtgggtggccaacataaacacagacggaagtgacccatacatgcggactctgtgaaagggccgattcaccatctccagagacaacgccaaagactcactatattgacaaatggaccgctggagagacgaggacacggctatgtattactgtcgcgagngactgaagaggtcggactacgaaggttcgggggacccggggaaccctgggtccaccggttcaaaccg

SEQ ID NO: 298983 - DNA, 541 bp, Homo sapiens
  misc_feature: GZ8MTXP02FW8RG.13.21.B10.1.454.CMB.2.raw
  modified_base (434)..(434): a, c, t, g, unknown or other
  misc_feature (434)..(434): n is a, c, g, or t
tcagtcacgtactacacgaccggtgctcgatttagtgtcgtcgcaaagagagaggagccttagccctggactccaaggcctttccacttggtgatcagcaatgagcacagaggactcaccatggcattggggctgaactgggttttccttgttgctattttagaaggtgtccagtgtgaggtgcaactggtggagtcgtgggggaggcttggtccagcctgggggtccctgagactctcctgtcaagcctctgggttcagcttcagtgtatattggatgagctgggtccgccagactccgagggaaggggctggagtgggtggccaacataaacacagacgaagtgacccatactatgcggactctgtgaagggccgattccaccatctccagagacaacgccaaagaactcactatatttgacaaatggaccnctgagagacgagacaggctatgtattacgtgtgacgagagatgagacgtggcttaacgaagggttcgggggacccggggtaaaccctgggtaccaccggtcaaaccg

SEQ ID NO: 298984 - DNA, 568 bp, Homo sapiens
  misc_feature: GZ8MTXP02JMD41.13.21.B10.1.454.CMB.2.raw
  modified_base (389)..(389): a, c, t, g, unknown or other
  misc_feature (389)..(389): n is a, c, g, or t
  modified_base (392)..(392): a, c, t, g, unknown or other
  misc_feature (392)..(392): n is a, c, g, or t
tcagtcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtcgtgggggaggcttggtccagccgtggggggtccctgagactctcctgttaagcctctgggttcagcttcagtgtatattggatgagctgggtccgccagactccgaggggagggctggagtgggtggccaacataaacacaggacggaagtgacccatacctatgcggactctgtgaggggccattccaccntcncagagacaacgccaagactcactatatttagacaaagtcggaacctccgtaggacgaggacgagggaaccacggctaagtggttaattactggtgacgtagagataggagtaggtcggactacggaggggttcgggggacccggggtaaccctggggtaccaccggtcaactaccg

SEQ ID NO: 298985 - DNA, 587 bp, Homo sapiens
  misc_feature: GZ8MTXP02H9VDG.13.21.B10.1.454.CMB.2.raw
  modified_base (335)..(335): a, c, t, g, unknown or other
  misc_feature (335)..(335): n is a, c, g, or t
  modified_base (436)..(436): a, c, t, g, unknown or other
  misc_feature (436)..(436): n is a, c, g, or t
  modified_base (460)..(460): a, c, t, g, unknown or other
  misc_feature (460)..(460): n is a, c, g, or t
tcagtcacgtactacacgaccggtgctcgatttagtgtcgtcgcaaagagagaggagccttagccctggactccaaggcctttccacttggtgatcagcactgagcacagaggactcaccatggcattggggctgaactgggttttcctgttgctattttagaaggtgtccagtgtgaggtgcaactggtggagtcgtggggggaggcttggtccagccgtgggggtccctgagactctcctgtcagcctcgtggttcagcttcagtgtatattgggatggagctgggtccgccagacctccgaggggaaggggctggagtggggtggaccaaanataaacacgagacggaagtcgacccatactatcgcggactcgtgtggaacggggccattccacctatcctacccaagacgaacaaccgaccaaagaacctnacttatattgacaaatcggaaccnctaggacgaaggacgaagggtaccacgggtacttagtagttaattacgtggtcgacggaagagatggagtacgggcgtacgacggtaaggggtcgggggacccggtaccgtggtaccaccgtacacg

SEQ ID NO: 298986 - DNA, 544 bp, Homo sapiens
  misc_feature: GZ8MTXP02GDHE8.13.21.B10.1.454.CMB.2.raw
  modified_base (439)..(439): a, c, t, g, unknown or other
  misc_feature (439)..(439): n is a, c, g, or t
tcagtcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccgagggaggggctggagtgcgtctcttttattatagtagtggtagtaccatactccgcagactccgtgaggggccgattcaccatctccagagacaattcccaaagaacacgctgtttcttacaaatgaaacagcctgagngcccgatgaccacggccgttgtattactgtgcgaggagagtcgggggccccacggaaacgttactacggctaagtcggacgtcgtgggggacccaaggggacccg

SEQ ID NO: 298987 - DNA, 531 bp, Homo sapiens
  misc_feature: GZ8MTXP02F2HMN.13.21.B10.1.454.CMB.2.raw
  modified_base (391)..(391): a, c, t, g, unknown or other
  misc_feature (391)..(391): n is a, c, g, or t
  modified_base (395)..(395): a, c, t, g, unknown or other
  misc_feature (395)..(395): n is a, c, g, or t
  modified_base (432)..(432): a, c, t, g, unknown or other
  misc_feature (432)..(432): n is a, c, g, or t
  modified_base (465)..(465): a, c, t, g, unknown or other
  misc_feature (465)..(465): n is a, c, g, or t
tcagtcacgtactacacgaccggtgctcgatttagtgtcgtcgcaaagagagaggagccttagccctggactccaaggcctttccacttggtgatcagcaatgagcacagaggactcaccatggcattggggctgaactgggttttccttgttgctattttagaaggtgtccagtgtgaggtgcaactggtggagtctgggggaggcttggtccagcctgggggtccctgagactctcctgtcaagcctctgggttcagcttcagtgtatattggatgagctgggtccgccagactccaggggaaggggctggaggtggggtggccaacataaacacagacggaagtgacccatactatgcggactctgtggaagggccgattcaccatcncagngacacgcaagaactcactatatttgacaaatggaccnctagagagacgaggaccaggctatgtattacgngtgcgagagatggagacgtgctacgaagggttcggggccgggaacccgtgggaccaccggtacaac

SEQ ID NO: 298988 - DNA, 541 bp, Homo sapiens
  misc_feature: GZ8MTXP02JTUN6.13.21.B10.1.454.CMB.2.raw
  modified_base (435)..(435): a, c, t, g, unknown or other
  misc_feature (435)..(435): n is a, c, g, or t
  modified_base (454)..(454): a, c, t, g, unknown or other
  misc_feature (454)..(454): n is a, c, g, or t
  modified_base (466)..(466): a, c, t, g, unknown or other
  misc_feature (466)..(466): n is a, c, g, or t
tcagtcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtctgggggaggcttggtccagcctggggggtccctgagactctcctgtcaagcctctgggttcagcttcagtgtatattggatgagctgggtccgccagactccgaggggaaggggctggagtgggtggccaacataaacacagaacggaagtgaccatacatgcggactctgtgaagggccgattcaaccatctccagagaacaacgccaaagaactcactatattgacaaatggaccnctgagagacgagacacggntatgtattacgngtgacgagagaagtgagacgtggactacgaagggttcgggggacccggggtaaccctggtaccaccggtcaaccg

SEQ ID NO: 298989 - DNA, 543 bp, Homo sapiens
  misc_feature: GZ8MTXP02J0OHG.13.21.B10.1.454.CMB.2.raw
  modified_base (432)..(432): a, c, t, g, unknown or other
  misc_feature (432)..(432): n is a, c, g, or t
  modified_base (468)..(468): a, c, t, g, unknown or other
  misc_feature (468)..(468): n is a, c, g, or t
  modified_base (497)..(497): a, c, t, g, unknown or other
  misc_feature (497)..(497): n is a, c, g, or t
tcagtcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtctgggggaggcttggtccagcctggggggtccctgagactctcctgtcaagcctctgggttcagcttcagtgtatattggatgagctgggtccgccagactccgagggaaggggctggagtggggtggccaacataaacacagacggaagtgacccatactatgcgactctgtgaagggccatcaccatctccagacgacaacgcaaagactcactatatttgacaaatcggaccncctagagagacggaggacacggctagtgtattacgngtcgcgagagataggagtagtggctaagngggttcgggggacccggggtaacctgggtaccacccggtacaaccg

SEQ ID NO: 298990 - DNA, 557 bp, Homo sapiens
  misc_feature: GZ8MTXP02IIMVY.13.21.B10.1.454.CMB.2.raw
tcagtcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtctgggggaggcttggtccagcctgggggtccctgagactctcctgtcaagcctctgggttcaccgtcagtcacacctacatgagctgggtcccgccaggctccgaggggaaggggctggagtgcgtctcttttatttatagttagtggtagtacatactcccgcagactccgtgaggggccattcaccatcctccagagacaattccaagaacacgctgtttctacaaatgaaacagcctagagagccgatgacacggccgtgtattactgtgcgagagagtcgggggacccacggtaaacgttactacgactagtcgggaacgttcgtcgggggaccaagggacccacgggtactacccg

SEQ ID NO: 298991 - DNA, 561 bp, Homo sapiens
  misc_feature: GZ8MTXP02F273P.13.21.B10.1.454.CMB.2.raw
  modified_base (384)..(384): a, c, t, g, unknown or other
  misc_feature (384)..(384): n is a, c, g, or t
  modified_base (456)..(456): a, c, t, g, unknown or other
  misc_feature (456)..(456): n is a, c, g, or t
tcagtcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtccgccaggctccgaggggaggggctggagtgcgtctctttattatagtagtggtagtaccatactcgcagacctcgtgaggggccattcaccatcnccagagacaattccaaagaaccacgcttgtttactacaaaatcgaaacagcctagagacgccgaatcgaacncgggccgtagtacttacgtgtgcggagagacgtcgggggacccaacggtaaccgttacctacggctaagcggtacggttccgacgggggacccaacgggaacccg

SEQ ID NO: 298992 - DNA, 558 bp, Homo sapiens
  misc_feature: GZ8MTXP02I5DAB.13.21.B10.1.454.CMB.2.raw
  modified_base (309)..(309): a, c, t, g, unknown or other
  misc_feature (309)..(309): n is a, c, g, or t
  modified_base (365)..(365): a, c, t, g, unknown or other
  misc_feature (365)..(365): n is a, c, g, or t
tcagtcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtcgtgggggaggcttggtccagccgtgggggtccctgagactctcctgtcaagcctctgggttcagcttcagtgtatatggatgagctggtccgcagactcgagggaaggggcnggagtgggtgccaaacataaacacagacgaagtcgaccatactatgcgactcgtgngaagggccattccacctatctaccgagacgaacaacgacaaagaactacactaattattcgactaaagtcggacccgtccgtggacgagacggaagacacggctagtgtatacgtggtgacgagtagataggagtacgtcgaccgtagaacggggttcgggggacccgggtaaccgtggtaccaccgataccg

SEQ ID NO: 298993 - DNA, 566 bp, Homo sapiens
  misc_feature: GZ8MTXP02JUQLW.13.21.B10.1.454.CMB.2.raw
  modified_base (290)..(290): a, c, t, g, unknown or other
  misc_feature (290)..(290): n is a, c, g, or t
  modified_base (335)..(335): a, c, t, g, unknown or other
  misc_feature (335)..(335): n is a, c, g, or t
  modified_base (367)..(367): a, c, t, g, unknown or other
  misc_feature (367)..(367): n is a, c, g, or t
  modified_base (444)..(444): a, c, t, g, unknown or other
  misc_feature (444)..(444): n is a, c, g, or t
tcagtcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtcgtgggggagcttggtccagccgtggggggtccctgagactctcctgtcaagcctctggttcagcttcagtgtatattggatgagctgggtccnccagactccgagggaggggctggagtgggtgccaaacataaacanagacggaagtgacccatactatgcggactcgngtcggaaaggggccgattccaccatcctaccaagagaccaacgaccaaagaactcaactatattgacaaatggaccnctgagagacgagacacggctatgtatacgtgtgacgagaggactggaagcgtacggacttacggaaggggtttcgggggacccgggggtaaacccttggggacctaacccggtacaaacccg

SEQ ID NO: 298994 - DNA, 483 bp, Homo sapiens
  misc_feature: GZ8MTXP02GEST0.13.21.B10.1.454.CMB.2.raw
  modified_base (308)..(308): a, c, t, g, unknown or other
  misc_feature (308)..(308): n is a, c, g, or t
tcagtcacgtactacacgaccggtgctcgatttagtgtcgtcgcaagagagggggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccatcatcacctgctctggagataaattgggggataaatatgcttgctggtatcagcagaagccaggccagtcccctgtgctggtcatctatcaagataccaagcggccctnagggatcctgagcgattctctggctccaactctgggaacacagccactctgacccatcagcggacccaggctgtgatgaggctgactatactgtcaggcgtgggacagcagcactcgctctcggactgggaccaaggtccacgtcctaggtcacgacccacggcccaaccctacg

SEQ ID NO: 298995 - DNA, 612 bp, Homo sapiens
  misc_feature: GZ8MTXP02HVH30.13.21.B10.1.454.CMB.2.raw
  modified_base (253)..(253): a, c, t, g, unknown or other
  misc_feature (253)..(253): n is a, c, g, or t
tcagtcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtcgtgggggaggcttggtccagccgtggggggtccctgagactctcctgtcaagcctntgggttcagcttcagtgtatatggatgagctggtcctcagactccgaggggaaggggctggagtgggtggaccaaacataaaacacgaaggaacggaagtcgaacccatactagtcgacggactcgtgtgaaacggggccattccaacctactcctacccaagaacgaaccaaaccgaccctaaaaggaaccctacaacttaattaatttacgactaaaagtcgggaacccgtcctaggaagacgaacggaggtacaacgggactagtacggtattacagtgacgagagactaggagacggtgaccgttagaaggggttcggggacccgggtaaccctgggtacccacggttacaaccg

SEQ ID NO: 298996 - DNA, 684 bp, Homo sapiens
  misc_feature: GZ8MTXP02HPRSW.13.21.B10.1.454.CMB.2.raw
  modified_base (308)..(308): a, c, t, g, unknown or other
  misc_feature (308)..(308): n is a, c, g, or t
tcagtcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgcttattttagaaggtgtccagtgtgaggtgcagttggtggagtctgggagggaggtcttgggtccgagggcccggggggggtccctggagactctcatgtgcggcctgtgggctcaccgtcaacaccaactacatgagctcgggggggggtccnccgaggcctaccggaggggaaggacgggccggaggtggtctcgtagtttatttagtggtcgacggtcgccactacttcgtacgcacgtacgtccggtggcggggtccggttcaacctacgtcctaccgaacgaacgaacctaaacttacccgaaagtaacgtacggttagttacttacttaacaaatacggaaccgacgtagaaggacggtacggaacggaccgaccgggtaccgttacgtacgttacgtaggtacgaacggaaagacgtacgacgacggacgggacccggaccccggttaaaggcggggtaccggtaggggtagggttaacggtttcgtttcggttcgtacgttcggccggttacggggacccgg

SEQ ID NO: 298997 - DNA, 538 bp, Homo sapiens
  misc_feature: GZ8MTXP02HNNO9.13.21.B10.1.454.CMB.2.raw
  modified_base (432)..(432): a, c, t, g, unknown or other
  misc_feature (432)..(432): n is a, c, g, or t
tcagtcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtctgggggaggcttggtccagcctggggggtccctgagactctcctgtcaagcctctgggttcagcttcagtgtatattggatgagctgggtccgccagactccgagggaaggggctggagtgggtgccaacataaacacagacggaagtgacccatactatgcggactctgtgaagggcgattcaccatctcagagacaacgccaaagaactcaactatattgacaaagtggaccnctagagagacgagacacggctatgtattacgtgtagcggagagatgagagtggactacgaagggttcgggggacccgggtaacccgtggcctaccggtctaaaccg

SEQ ID NO: 298998 - DNA, 541 bp, Homo sapiens
  misc_feature: GZ8MTXP02GTRJV.13.21.B10.1.454.CMB.2.raw
  modified_base (437)..(437): a, c, t, g, unknown or other
  misc_feature (437)..(437): n is a, c, g, or t
tcagtcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtctgggggaggcttggtccagccgtgggggtccctgagactctcctgtcaagcctctgggttcagcttcagtgtatattggatgagctggtccgcagactccgagggaaggggctggagtgggtggccaacataaacacagaacggaagtcgaccatactatgacgactctgtggaagggccgtattcaccatctaccagacgaacaacgaccaaagaactcactatattgacaaatgaccnctcgagagacgagacacggctatgtatactgcgtacgagagataggagcgtaggctacgaagggttcgggggacccggggaacctggtaccaccggtacaaccg

SEQ ID NO: 298999 - DNA, 552 bp, Homo sapiens
  misc_feature: GZ8MTXP02HH4D1.13.21.B10.1.454.CMB.2.raw
  modified_base (288)..(288): a, c, t, g, unknown or other
  misc_feature (288)..(288): n is a, c, g, or t
  modified_base (320)..(320): a, c, t, g, unknown or other
  misc_feature (320)..(320): n is a, c, g, or t
  modified_base (372)..(372): a, c, t, g, unknown or other
  misc_feature (372)..(372): n is a, c, g, or t
  modified_base (394)..(394): a, c, t, g, unknown or other
  misc_feature (394)..(394): n is a, c, g, or t
  modified_base (414)..(414): a, c, t, g, unknown or other
  misc_feature (414)..(414): n is a, c, g, or t
  modified_base (442)..(442): a, c, t, g, unknown or other
  misc_feature (442)..(442): n is a, c, g, or t
tcagtcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtctgggggaggcttggtccagccgtgggggtcctgagactctctgtcaagcctctgggttcagcttcagtgtatatggatgagctgggtcccncagacctccgaggggaaggggctggagtgggngaccaaacataaacacaggacggaagtcgacccatactatgcggtactctgngaaggggccattccacctatcnccaagacaaccaacgcaaanaactcaactatattgacaaatcggaccnctagagaagacgagacacggactagtatattcgagtcgacgagagaagtggagaggtcggacgttacgaagggttcgggggaccggacccgtggtacccgaccgtacacg

SEQ ID NO: 299000 - DNA, 589 bp, Homo sapiens
  misc_feature: GZ8MTXP02GKGZR.13.21.B10.1.454.CMB.2.raw
  modified_base (290)..(290): a, c, t, g, unknown or other
  misc_feature (290)..(290): n is a, c, g, or t
  modified_base (510)..(510): a, c, t, g, unknown or other
  misc_feature (510)..(510): n is a, c, g, or t
tcagtcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtctgggggaggcttggtccagccgtggggggtccctgagactctcctgtcaagcctctgggttcagcttcagtgtatattggatgagctggtccncagactccgagggaggggctggagtgggtgaccaacataaacacagaacggaagtcgacccatacatgcggactcgtgtggaacgggccattccgaccagtcctacccaagacgaaaccaacgacccaaagaaccttacaacttaattaactttgaactaaaagttcgggaacccgccgtaggaagacgacggagaccacggcttagtagttatacgtgngtacggagagagtaggagtacggtgacgtacgaaggggttcgggggacccgggtaaccgtggtaccgaccgtacaaccg

SEQ ID NO: 299001 - DNA, 572 bp, Homo sapiens
  misc_feature: GZ8MTXP02IY6D2.13.21.B10.1.454.CMB.2.raw
  modified_base (453)..(453): a, c, t, g, unknown or other
  misc_feature (453)..(453): n is a, c, g, or t
  modified_base (492)..(492): a, c, t, g, unknown or other
  misc_feature (492)..(492): n is a, c, g, or t
tcagtcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtctgggggaggcttggtccagccgtggggggtccctgagactctcctgtcaagcctctgggttcagcttcagtgtatattggatgagctggtccgcagactccgagggaaggggctggagtgggtggaccaaacataaaacacaggaacgaagtgacccaagtactaatgacggactcgtgtgaacgggccgtattccaacatctccaagagaacaaacgcaaagaactacaactaatattgactaaaatcggaaccnctagagagaacgagaactacggactagacgtatttacgngagacgagagagtagagtacgtacggtacgacggtaaggggtacgggggacccgggaccgtcggtaccgaccgtacaacg

SEQ ID NO: 299002 - DNA, 570 bp, Homo sapiens
  misc_feature: GZ8MTXP02JYQXC.13.21.B10.1.454.CMB.2.raw
  modified_base (404)..(404): a, c, t, g, unknown or other
  misc_feature (404)..(404): n is a, c, g, or t
  modified_base (449)..(449): a, c, t, g, unknown or other
  misc_feature (449)..(449): n is a, c, g, or t
  modified_base (474)..(474): a, c, t, g, unknown or other
  misc_feature (474)..(474): n is a, c, g, or t
tcagtcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtcgtgggggaggcttggtccagccgtggggggtccctgagactctcctgtcaagcctctgggttcagcttcagtgtatattggatggagcgtcggtccgccagacctccgaggggaggggctgggagtggggtgaccaacaataaacacgaaggacggaagtcgaacccatactagtgcggactcgtgtggaagggccagtccacatcnccagacgacacgacaagaactcactatattgacaaagtcggaccncgtaggagaggacggaggacacggntagtagtattacgtgacgcgagagagtaggagacgtacggactaggtaaggggttcgggggacccggggtaccgtgggtaccaccggtactaaccg

SEQ ID NO: 299003 - DNA, 639 bp, Homo sapiens
  misc_feature: GZ8MTXP02H45XI.13.21.B10.1.454.CMB.2.raw
  modified_base (502)..(502): a, c, t, g, unknown or other
  misc_feature (502)..(502): n is a, c, g, or t
tcagtcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttaaaaggtgcccagtgtgaggtgcagctggtggagtcgtggaggaggcttgatccagccgtggggggtccctgagactctcctgtgcagcctcgtgggttcaccgtcagtcaccacctacatgacgcgtcgggtccgccgaggcctaccggaggggaacggggctagggaggtcggtccgttctttactttttaagtttagtagttaggttgggtagtacctataccgtccgacacgtacgttccggtgggacgggggtaccacttaccacctacgtcctacccaagacgaactaacttacccgaaagaccacgtacttagtttactaactaatacgaaacncgaccttaggagacgaccgagtacgaaccgtacggtaccgtgttacttacgtgtagacgagtacgacgtaccggggccctaaacggtacttacgacgtgtacgtcggtacgtcggtcgggaccggtaacggacccgg

SEQ ID NO: 299004 - DNA, 551 bp, Homo sapiens
  misc_feature: GZ8MTXP02FTXH1.13.21.B10.1.454.CMB.2.raw
  modified_base (436)..(436): a, c, t, g, unknown or other
  misc_feature (436)..(436): n is a, c, g, or t
tcagtcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtcgtgggggaggcttggtccagcctggggggtccctgagactctcctgtcaagcctctgggttcagcttcagtgtatattggatgagctggtccgccagactccgagggaaggggctggagtgggtggccaacataaacacagacggaagtgacccatactatgcggactctgtggaagggccgattccaccatctccagagacaacgacaaagaactcactatattgacaaatcggaccnctagagagaacgagacacggctagtgtattacgtgtgacgagagatagaagagtcggactacggaagggttcgggggacccggggaaacccgtgggtaccgaccggtacaaaccg

SEQ ID NO: 299005 - DNA, 576 bp, Homo sapiens
  misc_feature: GZ8MTXP02JCDBC.13.21.B10.1.454.CMB.2.raw
  modified_base (405)..(405): a, c, t, g, unknown or other
  misc_feature (405)..(405): n is a, c, g, or t
  modified_base (453)..(453): a, c, t, g, unknown or other
  misc_feature (453)..(453): n is a, c, g, or t
tcagtcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtcgtgggggaggcttggtccaggccgtggggggtccctgagactctcctgtcaagcctctggttcagcttcagtgtatatggatgagagtggtccgcagacctccgaagggaggggctggaggtggggtcggaccaacataaacacgaaggacggaagtcgacccatactatcgacggactcgtgtggaagggccgtattaccaccatcnccagacaacaaccgacaaagactacactatattgactaaatcggaccnctagagagacgagacgacgactagtgtattacgtgtgacgagagagtgaacggtgtacggactaacggaaggggttacccgggggacccgggtaaacccgtggacccgtaccgtacgaacccg

SEQ ID NO: 299006 - DNA, 740 bp, Homo sapiens
  misc_feature: GZ8MTXP02FQR8S.13.21.B10.1.454.CMB.2.raw
  modified_base (621)..(621): a, c, t, g, unknown or other
  misc_feature (621)..(621): n is a, c, g, or t
tcagtcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtcgtgggggaggcgttggtccagccgtgggggtccctgagactctctgtcaacgcctcgtgggttcagtcttcagtgtatagttggatgagcgtgggtccgccagactccggaggggaggggcgtgggaggtggggtcggaccaaacaactaaaacacgaacgaacgaagaaacgtacgaacccccctaatacctaagtcggacggtacttcgtggtacgggaaacggggtccgtaacttaccaacctacttcccgtaaccgaaaggaaaccgaaacccaaaaccggaaccctaaaagtaaaccctacctaaactttaatttaactttacggaaactaaaaacggttccgggaacccgtaccgtaggaacggaaacgggaaccggaacgggaaccgacgggtacttaagttacgttaactttacgnggtacggacggaaagagtaagttagggaacggtaaggtcgggtaccgtaacgggttacgggggttacccggggggaaccccggggtaacccgttcggggtacccctaacccggttaacc

SEQ ID NO: 299007 - DNA, 544 bp, Homo sapiens
  misc_feature: GZ8MTXP02IZQQJ.13.21.B10.1.454.CMB.2.raw
  modified_base (446)..(446): a, c, t, g, unknown or other
  misc_feature (446)..(446): n is a, c, g, or t
  modified_base (468)..(468): a, c, t, g, unknown or other
  misc_feature (468)..(468): n is a, c, g, or t
  modified_base (479)..(479): a, c, t, g, unknown or other
  misc_feature (479)..(479): n is a, c, g, or t
  modified_base (506)..(506): a, c, t, g, unknown or other
  misc_feature (506)..(506): n is a, c, g, or t
  modified_base (528)..(528): a, c, t, g, unknown or other
  misc_feature (528)..(528): n is a, c, g, or t
tcagtcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtcgtgggggaggcttggtccagcctggggggtccctgagactctcctgtcaagcctctgggttcagcttcagtgtatattggatgagctgggtccgccagactccgaggggaaggggctggagtgggtggccaaacagtaaacacaaggaacggaagtgacccatacctatgcggactcgtgtgaagggccgattccacatctccagagacaacgaccaaagtaactcactaatattgacaaaatggaccnctagagacgacgagacacggtntatgtattacngtagcgagagatgagtacgtagctagnggttcgggggaccggtaacccnggtaccacgtacaacg

SEQ ID NO: 299008 - DNA, 604 bp, Homo sapiens
  misc_feature: GZ8MTXP02JCO8G.13.21.B10.1.454.CMB.2.raw
  modified_base (503)..(503): a, c, t, g, unknown or other
  misc_feature (503)..(503): n is a, c, g, or t
tcagtcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtcgtgggggaggcttggtccagccgtgggggtccctgagactctctgtcaagcctctggttcagcttcagtgtatatggatgagcgtggtccgcgagacctccgaggggaggggcgtgggaggtggggtcggaccaacgaataaacacgagaacggaagtacgaccaatactagtgcggtactcgtgtggaacgggcgtacttccgaccactctacccaagacgaacaacgaccaaagacctacactatattgacaaagtcggaccctctagagacgacggacgacgacggactagtacgtattacgngtacgacgagagacgtaggagaggtcgacgtaacggtaagggggttacccgggggacccggggtaaacccgttgggtacccgtaaccggtacctaaacccg

SEQ ID NO: 299009 - DNA, 539 bp, Homo sapiens
  misc_feature: GZ8MTXP02GKSP3.13.21.B10.1.454.CMB.2.raw
  modified_base (292)..(292): a, c, t, g, unknown or other
  misc_feature (292)..(292): n is a, c, g, or t
  modified_base (366)..(366): a, c, t, g, unknown or other
  misc_feature (366)..(366): n is a, c, g, or t
  modified_base (469)..(469): a, c, t, g, unknown or other
  misc_feature (469)..(469): n is a, c, g, or t
tcagtcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtcgtgggggaggcttggtccaggcctggggggtccctgagactctcctgtcaagcctctgggttcagcttcagtgtatattggatgagctgggtccncagactccgagggaaggggctggaggtgggtggccaaacataaacacagacgaagtgaccatacatgcgactcngtgaacgggccattccaccatctccagagacaacgaccaaagaactacactatattgactaaatcggaccgctgagagacgagacaggactagtgtattacgngtgcgagagatagagagtcggctacgaaggttcgggggaccggggtaaccctggaccaccggtacaaccg

SEQ ID NO: 299010 - DNA, 542 bp, Homo sapiens
  misc_feature: GZ8MTXP02JC34T.13.21.B10.1.454.CMB.2.raw
  modified_base (324)..(324): a, c, t, g, unknown or other
  misc_feature (324)..(324): n is a, c, g, or t
  modified_base (331)..(331): a, c, t, g, unknown or other
  misc_feature (331)..(331): n is a, c, g, or t
  modified_base (361)..(361): a, c, t, g, unknown or other
  misc_feature (361)..(361): n is a, c, g, or t
  modified_base (467)..(467): a, c, t, g, unknown or other
  misc_feature (467)..(467): n is a, c, g, or t
tcagtcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtctgggggaggcttggtccagcctgggggtccctgagactctcctgtcaagcctctgggttcagcttcagtgtatatggatgagctgggtccgcagactccgagggaaggggctggagtgggtgccaanataaacnagacggagtgacccatactatgcggactcngtgaagggccattccaccatctcagagacaacgacaagaactcactatatttgactaatcggacccgcctagagacgacggaaggacacggactagtgtattacgngtgacgagagagtagagagtacggactagaaggttcgggggacccgggtaccgtggtaccaccggtactaacccg

SEQ ID NO: 299011 - DNA, 550 bp, Homo sapiens
  misc_feature: GZ8MTXP02JAMSE.13.21.B10.1.454.CMB.2.raw
  modified_base (509)..(509): a, c, t, g, unknown or other
  misc_feature (509)..(509): n is a, c, g, or t
tcagtcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtcgtgggggaggcgttggtccagccgtggggggtccctgagactctcctgtcaagcctctgggttcagcttcagtgtatatggatgagctgggtccgcagactccgagggaggggctggaggtgggtggccaaacgataaaacacgaggacggaagtcgacccagtactagtcgcggactctgtggagggccgattccgactatcctaccagacgacaacgaccaaagaactcactatattagacaatcgaccgctgagagagagacacggctatgtatatgtgacgagagagtgaacgtagtacggctaacgngggttacgggggacccgggaacgtggacctaccgtacaacg

SEQ ID NO: 299012 - DNA, 656 bp, Homo sapiens
  misc_feature: GZ8MTXP02IYUKD.13.21.B10.1.454.CMB.2.raw
  modified_base (293)..(293): a, c, t, g, unknown or other
  misc_feature (293)..(293): n is a, c, g, or t
  modified_base (327)..(327): a, c, t, g, unknown or other
  misc_feature (327)..(327): n is a, c, g, or t
  modified_base (335)..(335): a, c, t, g, unknown or other
  misc_feature (335)..(335): n is a, c, g, or t
  modified_base (526)..(526): a, c, t, g, unknown or other
  misc_feature (526)..(526): n is a, c, g, or t
tcagtcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaacgtggtggagtcgtgggggaggcttggtccagccgtggggggtccctgagactctcctgtcaagcctgtgggttcagcttcagtgtatattggatgagctgggtccncagactcgagggaaggggctggagtggtgacaanataaacanagacgaatcgaccatactagcgacggactcgtggtggaaacggggccgtaattccaccctattcctacccaaagacgaaaccaaaccgccaaaagaacctcaacttaattaatttacgactaaaagtcggaacccgtctaggaacgagggaccgaaagggaccaacgggcttaaagtggttaacttaacgnggtacgacggaaggaagtaagtaggtaacggtaggtacgggtaccgttaacgggtaagggggtttaccgggggggacccccgggggtaaacccgtttggggacccccgtaaccggttaccgtaaaccccg

SEQ ID NO: 299013 - DNA, 586 bp, Homo sapiens
  misc_feature: GZ8MTXP02IUGC1.13.21.B10.1.454.CMB.2.raw
  modified_base (250)..(250): a, c, t, g, unknown or other
  misc_feature (250)..(250): n is a, c, g, or t
  modified_base (464)..(464): a, c, t, g, unknown or other
  misc_feature (464)..(464): n is a, c, g, or t
  modified_base (502)..(502): a, c, t, g, unknown or other
  misc_feature (502)..(502): n is a, c, g, or t
tcagtcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtcgtgggggaggcttggtccagccgtgggggtccctgagactctctgtcagcctntggtcagctcagtgtatatgatgagcgtggtccgccagactccgagggaaggggcgtggaggtgggtcggaccaaacgaataaaaccacgaaggaacggaaagtacgaacccataacctagtgcggactcgtgtggaacgggccgacttccacctactctaccagacgaacaacgaccaaagaactctaactattattagactaaatcggaccnctaggagagacgagacgacggtactagtagtattacgngtgacgagtagacggtcggggaccctacgtaaaccgttacgaccgtcgtaggcggtacgtcggtacggggaccgaacggacccg

SEQ ID NO: 299014 - DNA, 826 bp, Homo sapiens
  misc_feature: GZ8MTXP02H9BOL.13.21.B10.1.454.CMB.2.raw
tcagtcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtcgtggggggaggcgttggtccaggccgtggggggtccctgagactctcctgtcagtcctcgtgggttcagtcttcagtgtatatggatgagcgtcgggtccgccagacctccgaaggggaggggctggaggtggggtcggaccaaaacaagtaaaacgacgaaggaaacgggtaagtacggaaccctaagtaactacgtacggaccgggtaactaccgttagggttacgggaaaccgggggtcccgtaaacttttcccgaaacccttaaccgttacccttaaacccccgaaaggaaacggtaaacccgtaaaaccttttaacccccgaaaaaagggtaaaaccccgtaaaccgggggttagtttaaacgtttaaccgtttaaaccaaaaagttaacggaaaacccggtaaccccggtttaggaacgggtaacggttacgggaaacgggacccggtaaccgggtcccgttaccgttaagttaccgttaggtacgtaaacggtaaaacgaggtacggaacgaacggacggggaacccgggggtacccccgtaaagggttcgggggacccggttaaggggtcgggttaacgggggttttcctttcggtttacggaccggtttacggtccgggg

SEQ ID NO: 299015 - DNA, 559 bp, Homo sapiens
  misc_feature: GZ8MTXP02GZ5OP.13.21.B10.1.454.CMB.2.raw
  modified_base (335)..(335): a, c, t, g, unknown or other
  misc_feature (335)..(335): n is a, c, g, or t
  modified_base (454)..(454): a, c, t, g, unknown or other
  misc_feature (454)..(454): n is a, c, g, or t
  modified_base (474)..(474): a, c, t, g, unknown or other
  misc_feature (474)..(474): n is a, c, g, or t
  modified_base (506)..(506): a, c, t, g, unknown or other
  misc_feature (506)..(506): n is a, c, g, or t
tcagtcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtcgtgggggaggcttggtccagccgtggggggtccctgagactctcctgtcaagcctcgtgggttcagtcttcagtgtatattggatgagctgggtccgccagactccgaggggaaggggctggaggtgggtggccaaanataaacacaggacggaagtcgaccatactatgcggactctggtgaacgggcctagttccaacctatcctccaagacgacaacgccaaagaacctcaactatattcgacaaatcggaccnctagagagacgagacacggntagtgtattacgtgtgacgagagatggaacgnggtcgctagaagggttcgggggacccggggtaacctggaccaccgtacaaccg

SEQ ID NO: 299016 - DNA, 616 bp, Homo sapiens
  misc_feature: GZ8MTXP02GFGBZ.13.21.B10.1.454.CMB.2.raw
  modified_base (334)..(334): a, c, t, g, unknown or other
  misc_feature (334)..(334): n is a, c, g, or t
tcagtcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtcgtgggggaggcttggtccagccgtgggggtccctgagactctcctgtcaagcctcgtggttcagtcttcagtgtatattggatggagcgtggtcccgcagaccgtccgaggggaggggctggaggtgggtgaccaanataaacacagaacggaagtcgacccatactatgcggactcgtgtcggaagggccgagttccaccatcctacgaagacaaccgtaacgacctaaagaactcaacttattaacgttagaacaaagttcggaaaccccgctaggaagaggaaccgggagaccgacgggcttaaagtcggttaacttacgtggagacgtaaggatacgtagacggtagtacggaccttaagggtaacgggttcgggggaccccgggtaaccgtggtacccgaaccggtccaaaccg

SEQ ID NO: 299017 - DNA, 692 bp, Homo sapiens
  misc_feature: GZ8MTXP02HM2UK.13.21.B10.1.454.CMB.2.raw
  modified_base (253)..(253): a, c, t, g, unknown or other
  misc_feature (253)..(253): n is a, c, g, or t
  modified_base (292)..(292): a, c, t, g, unknown or other
  misc_feature (292)..(292): n is a, c, g, or t
  modified_base (312)..(312): a, c, t, g, unknown or other
  misc_feature (312)..(312): n is a, c, g, or t
  modified_base (315)..(315): a, c, t, g, unknown or other
  misc_feature (315)..(315): n is a, c, g, or t
  modified_base (328)..(328): a, c, t, g, unknown or other
  misc_feature (328)..(328): n is a, c, g, or t
  modified_base (337)..(337): a, c, t, g, unknown or other
  misc_feature (337)..(337): n is a, c, g, or t
tcagtcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaacgtggtggagtcgtgggggaggcttggtccagccgtggggggtccctgagactctcctgtcagcctntgggttcagtcttcagtgtatattggatgagctggtccncagactccgagggaggggcnggnggtggtgaccaanataaaccanagacggaatcgaccatactagtcgacggtactcgtgtcgggaacggggtcctaatttcccgaaaccctctcccgtacccgaaagaacgaaacctaaaccggacccaaaaggaacccttacaaaccttaattaactttacggaactaaaagttcggaaccccgtacctagggaacgaacggaacggaacggaccgtaaaccggggcttaagttaggttactttaaccgtgggttaccgacggaagaggagttacggaacggtacggtacggtaccgttaaaacggggtcggggtttacccggggggaccccggggtaaacccgtcgggtaccccggtacccgttaacgaaaccccg

SEQ ID NO: 299018 - DNA, 544 bp, Homo sapiens
  misc_feature: GZ8MTXP02GQDIJ.13.21.B10.1.454.CMB.2.raw
  modified_base (291)..(291): a, c, t, g, unknown or other
  misc_feature (291)..(291): n is a, c, g, or t
  modified_base (328)..(328): a, c, t, g, unknown or other
  misc_feature (328)..(328): n is a, c, g, or t
  modified_base (368)..(368): a, c, t, g, unknown or other
  misc_feature (368)..(368): n is a, c, g, or t
  modified_base (434)..(434): a, c, t, g, unknown or other
  misc_feature (434)..(434): n is a, c, g, or t
tcagtcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtctgggggaggcttggtccagccgtggggggtccctgagactctcctgtcaagcctctgggttcagcttcagtgtatattggatgagctgggtccncagactccgagggaaggggctggagtgggtggccaanataaacacagacggaagtgacccatacatgcggactctgngaagggccgattcaccatctaccagagaacaacgccaaagacctcactatattgacaaatggaccnctgagagacgagacacggctatgtattacgtgtgacgagagtatggaagtaggtcgactacgaagggttcgggggacccgggtaaccgtgggtaccaccggtacaaaccg

SEQ ID NO: 299019 - DNA, 639 bp, Homo sapiens
  misc_feature: GZ8MTXP02GLDXU.13.21.B10.1.454.CMB.2.raw
  modified_base (532)..(532): a, c, t, g, unknown or other
  misc_feature (532)..(532): n is a, c, g, or t
  modified_base (547)..(547): a, c, t, g, unknown or other
  misc_feature (547)..(547): n is a, c, g, or t
tcagtcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtcgtgggggaggcttggtccaggccgtggggggtccctgagactctcctgtcaagcctcgtgggttcagcttcagtgtatattggatgagcgtggtccgccagacgtccgaggggaaggggctgggaggtgggtggaccaaacataaaacgacgaggacggaagtcgaccatactagcgacgactcgtggtggaacgggccagttccaccatcctccaagacgaaaccaaccggccaaaagaaccctacaacgttattaactttcgaactaaaacgttcgggaaccctcgtagaacggaggaccggaaggaccacggtacttaagtcgttaattcgnggtagacgaaggtanacgttgggaagtacgggtaggaccttaacggtaagggggttccgggggaacccgggtaaaccctgggggtaccctaaccgtacctaaacccg

SEQ ID NO: 299020 - DNA, 608 bp, Homo sapiens
  misc_feature: GZ8MTXP02GKPBI.13.21.B10.1.454.CMB.2.raw
  modified_base (296)..(296): a, c, t, g, unknown or other
  misc_feature (296)..(296): n is a, c, g, or t
tcagtcacgtactacacgaccggtgctcgatttagtgtcgtcgcaaagagagaggagccttagccctggactccaaggcctttccacttggtgatcagcactgagcacagaggactcaccatggcattggggctgaacttgggttttccttgttgctattttagaaggtgtccagtgtgaggtgcaacgtggtggagtcgtgggggaggcttggtccagccgtggggggtccctgagactctcctgtcaagcctcgtgggttcagtcttcagtgtatattggatgagcgtggtccnccagactccggagggagggctggagtgggtacgccaaagaataaacacgaaggaacggaagtacgaacccaatactatcggacggtactctggtacggaacgggccgtaattcccaacctacgtcctaccaagaacgaaccaaaccgacccaaagaaaccctcaacttaattacttgaacaaagtcggaccgcgtagagacgaacggagtaccacggactagtgtaatacgtgcgacgagagacgtagagagtcggactacggaacgggttcggggacccgggtaaacctgggtaccaaccggtactaaccg

SEQ ID NO: 299021 - DNA, 810 bp, Homo sapiens
  misc_feature: GZ8MTXP02HP5HY.13.21.B10.1.454.CMB.2.raw
tcagtcacgtactacacgaccggtgctcgatttagtgtcgtcgcaaagagagaggagccttagccctggactccaaggcctttccacttggtgatcagcactgagcacagaggactcaccatggcattggggctgaacttgggtttttccttgttgcttattttagaaggtgtccagtgtgaggtgcaacgtggtggagtcggtgggggagtcgttggtccaggcccggtggggggtccctggacgtactctcctgtcaagtccctgtggttcagtcttcgagtgtatagtggatgagtcgtgggtcccacgagtccgtaccggaaggggaacggggtcctaggggtagggtcggggtacggaaccaaaacgtaaagtaaaaccgacgaagggtaaaccgggaagttcccgaaacccgtatacgtacgtcggaccggtacttccggtagggtacgggaacgggtaccctactttacccgaacccttatacccgttaccgaaacgtaacgaaacctaaaccgttaccgaaaacggaaccgtaacgggttactaactttaaccttaacgaaaacgttacggaaaccgttacccggagtaacgggtaacgttacgggaaccgggtaacccgtaacccggggtaccgttacctttaagttcccgttaaggagtaaaccggaaaagtgaacgacgaacggaaccgggttaacccggggtaaccccgggttagtcccggggggtaaccgtttaagggggtcgggtttaacgggtttaccgtttcggtttaccgtaacggttacccggttccggggg

SEQ ID NO: 299022 - DNA, 672 bp, Homo sapiens
  misc_feature: GZ8MTXP02FJ01K.13.21.B10.1.454.CMB.2.raw
  modified_base (302)..(302): a, c, t, g, unknown or other
  misc_feature (302)..(302): n is a, c, g, or t
  modified_base (378)..(378): a, c, t, g, unknown or other
  misc_feature (378)..(378): n is a, c, g, or t
  modified_base (456)..(456): a, c, t, g, unknown or other
  misc_feature (456)..(456): n is a, c, g, or t
tcagtcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtcgtgggggaggtcgttggtccaggccggtcggggggtccctgagactctctgtacagcctcgtgggttcagtcttcagtgtatagttggatggagtcgtgggtccncagactccggaaggggaggggctggaggtgggtcgaccaacaataaacacgagacagaaagtcgaccccatactangcgacttcgtggtaggaacgggcctacttaccgacctacgtcctacccgaggaacgaaccaaccgaccaaagtaaccnctaacttaattagttacgaactaaaaggttccggaacccgtccgtaggaacgaacggaacggaccgggaaccgtacgggtacttagttagttaactttacgtcggtaggacgtaaggacgtagtacggaaggtacggtcggtaaccgtaacgggtacgggggtttaccggggggacccggggtaaacccgttcgggaacccgtaccggtaaacccg

SEQ ID NO: 299023 - DNA, 616 bp, Homo sapiens
  misc_feature: GZ8MTXP02G2IG5.13.21.B10.1.454.CMB.2.raw
tcagtcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtcgtgggggaggcttggtccagccgtgggggtccctgagactctcctgtcagcctcgtggttcagcttcagtgtatattggatgagctgggtccgccagacctccgaggggaaggggcgtgggaggtgggtggaccaaacaataaaaccacgaaggaacggaagtacggacccaatactagtcggcggactcgtggtggaacgggccgtattccacccgatcctacccgaagacgaaccaacgaccaaacgaacctacaacttaagtactttagaccaaagtcggaccgccgtagagagacgaggacacggctagtgtattacgtgtagcgagagataggaggagtacggacgtaacggaacggggtttacgggggaccccgggggttaaccctcgggtacccgaccggtaccgtaacccg

SEQ ID NO: 299024 - DNA, 565 bp, Homo sapiens
  misc_feature: GZ8MTXP02IG49U.13.21.B10.1.454.CMB.2.raw
  modified_base (254)..(254): a, c, t, g, unknown or other
  misc_feature (254)..(254): n is a, c, g, or t
  modified_base (290)..(290): a, c, t, g, unknown or other
  misc_feature (290)..(290): n is a, c, g, or t
  modified_base (317)..(317): a, c, t, g, unknown or other
  misc_feature (317)..(317): n is a, c, g, or t
  modified_base (323)..(323): a, c, t, g, unknown or other
  misc_feature (323)..(323): n is a, c, g, or t
  modified_base (365)..(365): a, c, t, g, unknown or other
  misc_feature (365)..(365): n is a, c, g, or t
  modified_base (397)..(397): a, c, t, g, unknown or other
  misc_feature (397)..(397): n is a, c, g, or t
  modified_base (435)..(435): a, c, t, g, unknown or other
  misc_feature (435)..(435): n is a, c, g, or t
  modified_base (442)..(442): a, c, t, g, unknown or other
  misc_feature (442)..(442): n is a, c, g, or t
tcagtcacgtactacacgaccggtgctcgatttagtgtcgtcgcaaagagagaggagccttagccctggactcccaaggcctttccacttggtgatcagcactgagcacagaggactcaccatggcattggggctgaactgggttttccttgttgctattttagaaggtgtccagtgtgaggtgcaacgtggtggagtcgtggggggaggcttggtccagccgtgggggtccctgagactctcctgtcagcctntggttcagcttcagtgtatatggatgagctggtccncagactccgagggagggctggagtggngccaanataaacacagaacggaagtcgacccatactatcgcggactcngtggaagggccgattccaccatctcccaaganaccaaacgccaaagaactacaactaatatttagacaancggaccncctagagagacggagaccgacggctatcgtattacgtgtgacgagagactaggagtacgtggtacctacgtaagggttcgggggacccgggtaacccgtggtacccgtaaccgtacaaacccg

SEQ ID NO: 299025 - DNA, 679 bp, Homo sapiens
  misc_feature: GZ8MTXP02FU7KV.13.21.B10.1.454.CMB.2.raw
tcagtcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaacgtggtggagtcgtgggggaggcgttggtccagccgtgggggtccctggagactctcctgtcaagcctcgtggttcagtcttcgagtgtatattggatgagcgtggccgcgacgactccggaggggaggggctgggaggtggggtacgaccaaacaactaaaacgacgaaacggacggaaagtacggaacccaacgttaacctagtacggaccggtacgttcgtaggttcgggaaacgggcccgtaattccgaccctacttacctccgaaagacgaaacccgaaaccgaccgaaaagtaccctaaccgacttaattaattacgaacgtaaagttccgggaccctaccgtaggacggtacgaacgggaagacccgtagggacttagtagtacgttacgtgacggtagagagaggtgaagtacggtgaccgtacggtaacgggggttaccgggggacccggtaccccgttcggtaacccgaccgttaacaacccg

SEQ ID NO: 299026 - DNA, 583 bp, Homo sapiens
  misc_feature: GZ8MTXP02JPPH8.13.21.B10.1.454.CMB.2.raw
  modified_base (287)..(287): a, c, t, g, unknown or other
  misc_feature (287)..(287): n is a, c, g, or t
  modified_base (305)..(305): a, c, t, g, unknown or other
  misc_feature (305)..(305): n is a, c, g, or t
  modified_base (313)..(313): a, c, t, g, unknown or other
  misc_feature (313)..(313): n is a, c, g, or t
  modified_base (318)..(318): a, c, t, g, unknown or other
  misc_feature (318)..(318): n is a, c, g, or t
  modified_base (320)..(320): a, c, t, g, unknown or other
  misc_feature (320)..(320): n is a, c, g, or t
  modified_base (325)..(325): a, c, t, g, unknown or other
  misc_feature (325)..(325): n is a, c, g, or t
tcagtcacgtactacacgaccggtgctcgatttagtgtcgtcgcaaagagagaggagccttagccctggactccaaggcctttccacttggtgatcagcactgagcacagaggactcaccatggcattggggctgaactgggttttcctgttgctattttagaaggtgtccagtgtgaggtgcaactggtggagtctgggggagcttggtccagccgtgggggtccctgagactctcctgtcaagcctctggttcagtcttcagtgtatatggatgagctgggtccncagactccgaggagggcnggagtggngcaananaaacngagacgagtcaccatacatcgacgactctggtggaacgggcacgttcacctatccacagacacaacgaccaacgaactcaactataacgtttcgacaaactacggaccgtaccgtagaggacgaacggaacgggacgtaacggactagttacgtattacgtgtacgacgtaggaacgagaggagtaggtcggtacgtaacggtaaggggttcgggggacccgggggaacccgtcggtacccgaaccgtacgaaacccg

SEQ ID NO: 299027 - DNA, 659 bp, Homo sapiens
  misc_feature: GZ8MTXP02FF3RL.13.21.B10.1.454.CMB.2.raw
  modified_base (270)..(270): a, c, t, g, unknown or other
  misc_feature (270)..(270): n is a, c, g, or t
  modified_base (294)..(294): a, c, t, g, unknown or other
  misc_feature (294)..(294): n is a, c, g, or t
  modified_base (346)..(346): a, c, t, g, unknown or other
  misc_feature (346)..(346): n is a, c, g, or t
  modified_base (582)..(582): a, c, t, g, unknown or other
  misc_feature (582)..(582): n is a, c, g, or t
tcagtcacgtactacacgaccggtgctcgatttagtgtcgtcgcaaagagagaggagccttagccctggactccaaggcctttccacttggtgatcagcactgagcacagaggactcaccatggcattggggctgaacttgggttttccttgttgctattttagaaggtgtccagtgtgaggtgcaactggtggagtcgtgggggagcttggtccagccgtggggggtccctggagactcctctgtcagcctgtggttcagtctcgagtntatatggatgacgtcgtggttccnccgagacgtccggaaggggaggggtcgtcgggaggtcggggacggaccaaanaactaaaacacgtaaggacggaagtaccgacctatacctagcgacggtctcgtgggtcggaacgggtcctacttccgactacgtcaacgaagaacaaccaaaccgtaaccgaaacgtaacctacccaaattattaagtttacaacgttaaaacgccgggtaacccgtacgtaggaacggacggacgggtaagaccgtacggtactaagtacgttactacgtcggagacgagagtanggaaacgtggtacgacttacgggaaggggttccgggggaacccggtaacgtcggttaaccaccggttacaaacccgg

SEQ ID NO: 299028 - DNA, 672 bp, Homo sapiens
  misc_feature: GZ8MTXP02JFIDH.13.21.B10.1.454.CMB.2.raw
  modified_base (385)..(385): a, c, t, g, unknown or other
  misc_feature (385)..(385): n is a, c, g, or t
  modified_base (468)..(468): a, c, t, g, unknown or other
  misc_feature (468)..(468): n is a, c, g, or t
tcagtcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaacgtggtggagtcgtgggggaggcgttggtccagccgtgggggtccctgagactctcctgtcaacgcctcgtggttcagtcttcagtgtatagtgatgagcgtggccgcagactccgagggaggggctagggaggtggtcggaccaaacaataaacgacgaggaaccggagacgaccctaatacgagtgacggtactcgngtgggaacggctacttaccacctactaccacaagaacgaacgaaaccgaccgaaagtaactacctaacgttaacttaagtttnaaacgtaaacgtcggtaacccctcgaggaaaggacgaacgggaacgaaccgacgggtacttagtacgttaacgttacgttagacggtacggaaggacgtaacgtaagggtacgtaagggttacggaaccgttacgggtaacgggggttaccgggggacccccggggtaacccggtcggtacccgtaacccggtacgtaaccccg

SEQ ID NO: 299029 - DNA, 681 bp, Homo sapiens
  misc_feature: GZ8MTXP02IXT1V.13.21.B10.1.454.CMB.2.raw
  modified_base (277)..(277): a, c, t, g, unknown or other
  misc_feature (277)..(277): n is a, c, g, or t
  modified_base (307)..(307): a, c, t, g, unknown or other
  misc_feature (307)..(307): n is a, c, g, or t
  modified_base (387)..(387): a, c, t, g, unknown or other
  misc_feature (387)..(387): n is a, c, g, or t
  modified_base (615)..(615): a, c, t, g, unknown or other
  misc_feature (615)..(615): n is a, c, g, or t
tcagtcacgtactacacgaccggtgctcgatttagtgtcgtcgcaaagagagaggagccttagccctggactccaaggcctttccacttggtgatcagcactgaacacagaggactcaccatggagttttggctgagcttgggttttccttgttgcttaatttaaaggtgcccagtgtgaggtgcagcgtggtggagtcgtgggaggaggtcttgatccgaggccggtgggggtccctagacgtactctcctgtgctcgtcctgtcggtccaccgtnacgtcactaccacatgacgcgtacggtccnccgacgccgtacgaggggaggctgggagtcgtacgttcgtttacttttattagtagtagtgtagtactactaccgccganacggtccgtaccggtgggaccggggtcctattaccgacctacttacaccgaaggaccaatactaaccgaaggaacctacgtctttcgttttacaacgtaaaagcgaactacgtcctagggaacgcggaacccgttagacggacccgacgggttacgttagttaacttgttaggacgtacggaagacggtacggtccggggtaaccctaaacggtaaccggtttaaccncgtttaaggtaacgtaacggggtcgttaccgggggacgggaaaccgaaccgggtaccgtacccggg

SEQ ID NO: 299030 - DNA, 639 bp, Homo sapiens
  misc_feature: GZ8MTXP01D4XX1.39.26.C04.1.454.CMB.2.raw
tcagtcgcactagtcacgaccggtgctcgatttagtctagcgactttgggtttggggagctctgagagaggagcccagccctgggattttcaggtgttttcatttggtgatcaggactgaacagagagaactcaccatggactttgggctgagctgcctttttcttgtggctatgttaaaaggtgtccagtgtgaggtgcagctgttggagtcgtgggggaggcttggtacaggcgggggggtccctgagactctcctgtacagtctctggattcagcttagcacctatgccatgagctgggtccgccaggctccgagggaaggtggcgtggaggtggtctcgactaccaagtaggtggtcgaccgtaggtgggtaggtaatactaaattatttagtgggtacggtaccgttccggtaggaacgggtcccggttacaaccgtactcctaccgaagacgaactaaacttaccaaagaaacctaccttactagttactctacgacaaagtcgaaacacgccgtagacgccggaccggaacggaccgaccggtacccttaagttaacttacgttcggttcgaacgtaaaccttccgtaaccccggttagttcgggttacggtttccgaacccgttaaacccg

SEQ ID NO: 299031 - DNA, 609 bp, Homo sapiens
  misc_feature: GZ8MTXP01CMNPP.39.26.C04.1.454.CMB.2.raw
tcagtcgcactagtcacgaccggtgctcgatttagtctagcgactttgggtttgggggctatgttaaaaggtgtccagtgtgaggtgcagctgttggagtctggggggaggcttggtacaggcggggggggtccctgagactctcctgtacagtctctggattcagctttagcacctatgccatgagctgggtccgcaggctccgagggaaggggctggagtgggtctcatccattagtggtgcagtggtgtaatacatatatgtggactcgtgaagggccgtcacatctcagagacaattccaaagaacactctgtatctgacaaaatgaaacagcctaggacgccccggccgaaggaccaaccggcccttaaattaattaactgtgacgtaaaactcctacccgtacttggtacgtttcgacccaacctaactttgacctccggttacggggccgacgggaacccgtcgtccaccgtcctccgtcacgcctaccaccgacggcccacgtccggtcccttccccgtcggcccacccctcctaacaacgacgccgacctcgttcgggggcacgaacgccggcccgtgggcttcgtccgttcggtaaccg

SEQ ID NO: 299032 - DNA, 577 bp, Homo sapiens
  misc_feature: GZ8MTXP01A8NB7.39.26.C04.1.454.CMB.2.raw
tcagtcgcactagtcacgaccggtgctcgatttagtctagcgactttgggtttggggagctctgagagaggagcccagccctgggattttcaggtgttttcatttggtgatcaggactgaacagagagaactcaccatggactttgggctgagctgcctttttcttgtggctatgttaaaaggtgtccagtgtgaggtgcagctgttggagtcgtgggggaggcttggtacaggcggggggggtccctgagactctcctgtacagtctctggattcagcttagcacctatgccatgagctgggtccgccgaggctccgaggggaggggcgtgggagtgggtctcatccagttacgtggtgcgtagtggtaagtaatcgtatattatgtggactcggtgaacgggtccgttcaccgatctccaagacgacaattacaagaactactctagtatctagactaaatcgaacagcctgacggcgaccggaggaaccacgggacccctagttacttacgtgttcgaccgaaactcccgtacccgtaagttcgggtagtttccgaacccgttaaccttaaccg

SEQ ID NO: 299033 - DNA, 603 bp, Homo sapiens
  misc_feature: GZ8MTXP01DOCIO.39.26.C04.1.454.CMB.2.raw
  modified_base (268)..(268): a, c, t, g, unknown or other
  misc_feature (268)..(268): n is a, c, g, or t
tcagtcgcactagtcacgaccggtgctcgatttagtctagcgactttgggtttgggggctatgttaaaaaggtgtccagtgtgaggtgcagctgttggagtctggggggaggcttggtacagcggggggggtccctgagactctcctgtacagtctctggattcagctttagcacctatgccatgagctgggtccgccaggctccgaggggaaggggctgggagtgggtctcatccattagtggtgccagtggtgtaatacatattangtggactcgtgaagggccgttcacatctccagagacaattccaaagaacactctgtatctgacaaaatgaaacagcctgacgcccgccggaggacaccggcccttaaatattcgtgtcgacgaaactcctaccgattgtacgtttcgacctaacctaactttgacgtccgtacggggaccgacgggaccctcgtccaccgtcctccgtcacgcctaccaccgaacggcccacgtccggtcccttccccgtcgcccacccctcctaccaagacgccgtaccgtcggttcgggggcaccgaacggcccggccgtcgggcttcgtccgttggtaaccg

SEQ ID NO: 299034 - DNA, 551 bp, Homo sapiens
  misc_feature: GZ8MTXP01C5CDQ.39.26.C04.1.454.CMB.2.raw
tcagtcgcactagtcacgaccggtgctcgatttagtctagcgactttgggtttgggggctatgttaaaaaggtgtccagtgtgaggtgcagctgttggagtctgggggaggcttggtacagcggggggggtccctgagactctcctgtacagtctctggattcagctttagcacctatgccatgagctgggtccgccaggctccagggaagggctggagtgggtctcatccattagtggtgccagtggtgtaatacatattatgtggactcgtgaagggccgttcaccatctccagagacaattccaaagaacactctgtatctgacaaatgaacagcctgacgccgccgaggacacggccctaatattctgtgacgaaatctccgattgagtttcgccacctaactttcgactccgtcggggccacgggaaccctcgtcaccgtcctctcacgcctccaccacggcccagtccgtcctccctcgccaccctcctccagcgcgacctcgttcggggcacgcgccggcccgtggcttcgtccgttgtaaccg

SEQ ID NO: 299035 - DNA, 600 bp, Homo sapiens
  misc_feature: GZ8MTXP01CVF7Q.39.26.C04.1.454.CMB.2.raw
  modified_base (347)..(347): a, c, t, g, unknown or other
  misc_feature (347)..(347): n is a, c, g, or t
tcagtcgcactagtcacgaccggtgctcgatttagtctagcgacttgggtttgggggaggcttggtacagcggggggggtccctgagactctcctgtacagtctctggattcagctttagcacctatgccatgagctgggtccgccaggctccgagggaaggggctggagtgggtctcatccattagtggtgcagtggtgtaatacatattatgtggactccgtgaagggccgttcacatctcagagacaattccaagaacactctgtatctgacaaatgaaacagcctgacgcgccgaggacacggcctatacttactgtgacgaaatcctcccgattgagtttcnccccaacctaatttgacctccgtaggggacccaacgggaaccctgggccaccgtctcctcacgccctaccaaccgaacgggccctacgtcccggtccttcccccgtcggcccacccctcctaccaacgacgccacccgtcggtcggggccaacgcggccggccgtcgggctcgccgtcggtacaaggtaccttacgtccacgtacgtcgccgttacgcggaacggccgggcgtcgggacgaacgggcgcgaag

SEQ ID NO: 299036 - DNA, 634 bp, Homo sapiens
  misc_feature: GZ8MTXP01C1YG1.39.26.C04.1.454.CMB.2.raw
  modified_base (280)..(280): a, c, t, g, unknown or other
  misc_feature (280)..(280): n is a, c, g, or t
  modified_base (287)..(287): a, c, t, g, unknown or other
  misc_feature (287)..(287): n is a, c, g, or t
  modified_base (371)..(371): a, c, t, g, unknown or other
  misc_feature (371)..(371): n is a, c, g, or t
tcagtcgcactagtcacgaccggtgctcgatttagtctagcgactttgggtttgggggctatgttaaaaggtgtccagtgtgaggtgcagctgttggagtctgggggaggcttggtacaggcggggggggtccctgagactctcctgtacagtctctggattcagctttagcacctatgccatgagctgggtccgcaggctccgagggaggggctggagtgggtctcatcattagtggtgcagtggtgtaatcatattatgtggactcgtgaggccgttnaccatcncagagacaattccaaagaacactctagtatctgacaaatgaaacagcctgacgcccgccgaggacaccggccctaaatacttcngtagacgaaaactcctcccgacttgtacgtttcgacctacctaacttcgtaaccgtccgtcggggccgaacgggtaacccgtcggtcctacccgtcctccgtccacgaccctacccgaaccgaaaccgggccccaacgttcccggttcccttcccccgttccggccctacccctccctacccgaaacgacgaccgtacccgtcgttcgggggccaccgaacggccgggccccgttgggccgttccggtccgttcgggtaaccg

SEQ ID NO: 299037 - DNA, 241 bp, Homo sapiens
  misc_feature: GZ8MTXP01A10JW.39.26.C04.1.454.CMB.2.raw
  modified_base (239)..(241): a, c, t, g, unknown or other
  misc_feature (239)..(241): n is a, c, g, or t
tcagtcgcactagtcacgaccggtgctcgatttagtctagcgactttgggtttggtctagcgactttgggtttggggccagggaaccctggtcaccgtctcctcagcctccaccaagggcccatcggtcttccccctggcaccctcctccaagagcacctctggggcacagcggccctgggctgcctggtcaaggactacttccactagtgcgactgagcggctggcaaggcgcatagnnn

SEQ ID NO: 299038 - DNA, 679 bp, Homo sapiens
  misc_feature: GZ8MTXP01CTMZ0.39.26.C04.1.454.CMB.2.raw
  modified_base (284)..(284): a, c, t, g, unknown or other
  misc_feature (284)..(284): n is a, c, g, or t
  modified_base (290)..(290): a, c, t, g, unknown or other
  misc_feature (290)..(290): n is a, c, g, or t
  modified_base (295)..(295): a, c, t, g, unknown or other
  misc_feature (295)..(295): n is a, c, g, or t
tcagtcgcactagtcacgaccggtgctcgatttagtctagcgactttgggtttgggggctatgttaaaaaggtgtccagtgtgaggtgcagctgttggagtctgggggaggcttggtacagcggggggggtccctgagactctcctgtacagtctctggattcagctttagcacctatgccatgagctgggtccgccaggctccgagggaaggggctggagtgggtctcatccattagtggtgccagtggtggtaatacatattatgtggactcgtgaggcgtnacatcncaganacatcaagacatctgtatctgacaaatgaacagcctgagcccgaccgaggacaccggccccaaagttacttaacgtgtacgtaccgaaaactccgtaccccgtacgttcgtacgggttttacgaccctaacctaacgtttcgaacccgttcccggtcgggggacccaacgggggtaaccccttcgggttacccaacccggttcccttccggtaccacggtccccttacccgaaacccgaaccggggcccctaacgttcccgggttcccctttccccccgtcgggcccctccccttaaccctacccgaaacgcgcccgtacccgtcggttacgggggccaccgaacgccgggcccgttggggccttcgtcccgttgggtaacccg

SEQ ID NO: 299039 - DNA, 669 bp, Homo sapiens
  misc_feature: GZ8MTXP01B0A5S.39.26.C04.1.454.CMB.2.raw
  modified_base (277)..(277): a, c, t, g, unknown or other
  misc_feature (277)..(277): n is a, c, g, or t
  modified_base (289)..(289): a, c, t, g, unknown or other
  misc_feature (289)..(289): n is a, c, g, or t
  modified_base (297)..(297): a, c, t, g, unknown or other
  misc_feature (297)..(297): n is a, c, g, or t
  modified_base (313)..(313): a, c, t, g, unknown or other
  misc_feature (313)..(313): n is a, c, g, or t
tcagtcgcactagtcacgaccggtgctcgatttagtctagcgactttgggtttgggggctatgttaaaaaggtgtccagtgtgaggtgcagctgttggagtctggggggaggcttggtacaggcggggggggtccctgagactctcctgtacagtctctggattcagctttagcacctatgccatgagctgggtccgccaggctccgagggaaggggctggagtgggtctcatccattagtggtgccagtggtggtaatacatattatgtgactcgngaggccgtcacntctcaganacaataccaaagaacnctctgtatctgacaaatgaacagcctgacgcccgaccgaggaccaccggcccttaaatattctgtgacgtaaactccgtacccgtattggtacgtttcgaccctaacctaacgtttcgaccgtcccggtcggggacccgaacggggtaacccctcggtaccacccggttccctcccgtcgacgtcccctacccgaacccgaaccgggcccctacgtcccggttcccttcccccgtacggtcccctaccccgtccctacccaaacggaccgttcccgtacccgtccgggttcgggggcccacggaaccgggcccgggtccccggtcggggccgttccggtcccgttcgggtaacccg

SEQ ID NO: 299040 - DNA, 571 bp, Homo sapiens
  misc_feature: GZ8MTXP01ATHVD.39.26.C04.1.454.CMB.2.raw
  modified_base (444)..(444): a, c, t, g, unknown or other
  misc_feature (444)..(444): n is a, c, g, or t
  modified_base (514)..(514): a, c, t, g, unknown or other
  misc_feature (514)..(514): n is a, c, g, or t
  modified_base (554)..(554): a, c, t, g, unknown or other
  misc_feature (554)..(554): n is a, c, g, or t
tcagtcgcactagtcacgaccggtgctcgatttagtctagcgactttgggtttggggagctctgagagaggagcccagccctgggattttcaggtgttttcatttggtgatcaggactgaacagagagaactcaccatggactttgggctgagctgcctttttcttgtggctatgttaaaaggtgtccagtgtgaggtgcagctgttggagtcgtgggggagcttggtacgaggcgggggggtccctgagactctcctgtacagtctctggattcagtcttagcacctatgccatgagcgtgggtcccgccgaggctccgaggggaggggctgggagtgggtctcatccagttacgtggtgccgagtggtaaggtaataacatattatgtggactcggtagacgggtccgttcacgatcctcagagacattccaaagacactcnggtaactctagacaaatcgaacagcctggacgccgaccggaggaaccacggttaccctattacgttaccngttacgccgaaatcccgtaccccgaagtttcgaggtttcncccttaaccgttaaccg

SEQ ID NO: 299041 - DNA, 591 bp, Homo sapiens
  misc_feature: GZ8MTXP01BJCMJ.39.26.C04.1.454.CMB.2.raw
  modified_base (513)..(513): a, c, t, g, unknown or other
  misc_feature (513)..(513): n is a, c, g, or t
tcagtcgcactagtcacgaccggtgctcgatttagtctagcgactttgggtttgggggctatgttaaaaggtgtccagtgtgaggtgcagctgttggagtctgggggaggcttggtacaggcggggggggtccctgagactctcctgtacagtctctggattcagctttagcacctatgccatgagctgggtccgccaggctccagggaaggggctggagtgggtctcatccattagtggtgccagtggtgtaatacatattatgtggactcgtgaagggccgtcaccatctccagagacaattccaaagaacactctgtatctgacaaatgaaacagcctgacgccgaccgaggaccacggccctaaatacttctgtgacgaaatcctacccgacttgtagtttcgacctacctaactttgactccgtcggggaccacgggaaccctcgtccaccgtcctccgtcacgccctaccaccgaacggcccactccggtccttcccccgtcgcccncccctccctcccaacgacgccgtaccgtcgttcgggggcacgaacgccggccgtcgggcttcggtccgttggtaaccg

SEQ ID NO: 299042 - DNA, 535 bp, Homo sapiens
  misc_feature: GZ8MTXP01AS0LS.39.26.C04.1.454.CMB.2.raw
  modified_base (370)..(370): a, c, t, g, unknown or other
  misc_feature (370)..(370): n is a, c, g, or t
  modified_base (487)..(487): a, c, t, g, unknown or other
  misc_feature (487)..(487): n is a, c, g, or t
tcagtcgcactagtcacgaccggtgctcgatttagtctagcgactttgggtttggggctatgttaaaaggtgtccagtgtgaggtgcagctgttggagtctgggggaggcttggtacagcgggggggtccctgagactctcctgtacagtctctggattcagctttagcacctatgccatgagctgggtccgccaggctccagggaaggggctggagtgggtctcatccattagtggtgccagtggtggtaatacatattatgtggactcgtgaagggcgttcaccatctcagagacaattccaaagaacactctgtatctgacaaatgaacagcctgagccgccgaggacacggccctaaatattaacngtgacgaaatctcccgattgagtttgcacacttgactcgtgggcacggacctggtcacgtctcgtcacgcctccacgaacggccatccggtcctcccctcgccaccctcctcacgcnccgacctcgcggggcacgaacgcgccgtggcttcgccgttggtaaccg

SEQ ID NO: 299043 - DNA, 597 bp, Homo sapiens
  misc_feature: GZ8MTXP01AH241.39.26.C04.1.454.CMB.2.raw
  modified_base (195)..(195): a, c, t, g, unknown or other
  misc_feature (195)..(195): n is a, c, g, or t
  modified_base (517)..(517): a, c, t, g, unknown or other
  misc_feature (517)..(517): n is a, c, g, or t
  modified_base (525)..(525): a, c, t, g, unknown or other
  misc_feature (525)..(525): n is a, c, g, or t
tcagtcgcactagtcacgaccggtgctcgatttagtctagcgactttgggtttgggggctatgttaaaaggtgtccagtgtgaggtgcagctgttggagtctgggggaggcttggtacagcggggggggtccctgagactctcctgtacagtctctggattcagcttttagcacctatgccatgagctgggtccnccaggctccagggaagggctggagtgggtctcatccattagtggtgccagtggtgtaatacatattatgtggactcgtgaaggccgttcacatctccagagacaattccaagaacactctgtatctgacaaatgaacagcctgacgccgccgaggacacggccctaatataactgtgacgaaatcctaccgacttgagtttcgacctaaccgtaactttcgaccttaccgtcggggaccgtacgggaacccgttcgggtacacccgttctacccgtcacgccctcccaaccgaacgggccccacgtccggtccttcccccgnggtccccncccgtccctcccaaacgcgccgtaccgtcgttcggggcacgaacgccgccgtcggcttcgccgttgtaaccg

SEQ ID NO: 299044 - DNA, 758 bp, Homo sapiens
  misc_feature: GZ8MTXP01C080A.39.26.C04.1.454.CMB.2.raw
  modified_base (285)..(285): a, c, t, g, unknown or other
  misc_feature (285)..(285): n is a, c, g, or t
  modified_base (291)..(291): a, c, t, g, unknown or other
  misc_feature (291)..(291): n is a, c, g, or t
  modified_base (296)..(296): a, c, t, g, unknown or other
  misc_feature (296)..(296): n is a, c, g, or t
  modified_base (298)..(298): a, c, t, g, unknown or other
  misc_feature (298)..(298): n is a, c, g, or t
  modified_base (307)..(307): a, c, t, g, unknown or other
  misc_feature (307)..(307): n is a, c, g, or t
tcagtcgcactagtcacgaccggtgctcgatttagtctagcgactttgggtttgggggctatgttaaaaggtgtccagtgtgaggtgcagctgttggagtctggggggaggcttggtacaggcggggggggtccctgagactctcctgtacagtctctggattcagctttagcacctatgccatgagctgggtccgcaggctccgaagggaggggctgggagtgggtctcatccattagtggtgcagtggtgtaatacatattatgtggactcgtgaaggccgtnacatcncagananaatacaaanaacactctgtatctgacaaaatgaaacagcctgacgcccgaccggagacaccggcccttaaattaacttcgtgtacgaaacgaaaatccgtaccccgtaattaggtacggttttcaccctaaccgtaaactttcggaacccgtaccgggttacgggggacccaaaccgggggtaaaccccttacgggtccctaaacccggttcccttaccggtaccaaccggtacccctaccccgaaacccggtaaaccggggccccctaacgttaccccggggttccccttcccccccggttaccgggacccctaacccccgttaacccctaacccggaaacgggtaacccgaccccgtaacccggtaccggggttaccgggggacccaacccgggtaaccgggtcccgggtcccgggttcgggtcccgttaccgggtaacccggttaacgggtaacccg

SEQ ID NO: 299045 - DNA, 618 bp, Homo sapiens
  misc_feature: GZ8MTXP01AWR72.39.26.C04.1.454.CMB.2.raw
  modified_base (303)..(303): a, c, t, g, unknown or other
  misc_feature (303)..(303): n is a, c, g, or t
tcagtcgcactagtcacgaccggtgctcgatttagtctagcgactttgggtttggggagctctgagagaggagcccagccctgggattttcaggtgttttcatttggtgatcaggactgaacagagagaactcaccatggactttgggctgagcgtgccttttctgtggctatgttaaagtgtccagtgtgaggtgcagctgttggagtcgtgggggagcttggtacaggcgggggggtccctgagactctcctgtacagtctctggattcagcttagcacctatgccatgacgctgggtccnccaggctccgagggagggctgggagtgggtctcgatccagttagtggtgccgtagtggtaaggtaatcgatattatgtggactccgtaggaagggtcccgttcaccgtatcctcgaaggactaacaaacttcccaaaagaaacctacttaccgtagggttaactccgttaagaacctaaagtacgaaacgacgtaccgtagggaccgccggaccggaacggaacccgtaccggttaccttaattacgttacgtggttacgacgttaactccgtacccgtaacgttcggtacggttaccaacccgttaacgtaacg

SEQ ID NO: 299046 - DNA, 711 bp, Homo sapiens
  misc_feature: GZ8MTXP01A1CAH.39.26.C04.1.454.CMB.2.raw
tcagtcgcactagtcacgaccggtgctcgatttagtctagcgactttgggtttggggagctctgagagaggagcccagccctgggattttcaggtgttttcatttggtgatcaggactgaacagagagaactcaccatggactttgggctgagctgtcctttttcttgtggctatagttaaaaggtgtccagtgtgaggtgcagctggttggagtcgtgggggagtcgttggtacgagggccggggggtccctggagactctcctgtactagtctcgtggtattcagtcttagctacctatcgcctagtgacgtcgtcgggtcccgccgaggccgtaccggaagggggacgggggtcgtagggacggtcgggtctcgtactccgtaagttacggtggtcgtaccgtaggtaggtaaagttaaactaacgtaagtttaagttagtggtacggtaccgtacgggtagggaacccggggtcccgttaccaaccgtaattcccgtaccgaaaggtacaaaccttaaacttacccgaaaacgtaaacctacttacgttaggtaacttaccgtagaacctaaagtcgaaacctacgtcccgtaggaaccggtccgaccgggaggaaccctaccggttaccttaagttacgttacgtgttaacgacttaacttcccgtaccggttaattcggtacgttaccgcccttaacgttaaccg

SEQ ID NO: 299047 - DNA, 623 bp, Homo sapiens
  misc_feature: GZ8MTXP01AKCJV.39.26.C04.1.454.CMB.2.raw
  modified_base (195)..(195): a, c, t, g, unknown or other
  misc_feature (195)..(195): n is a, c, g, or t
  modified_base (265)..(265): a, c, t, g, unknown or other
  misc_feature (265)..(265): n is a, c, g, or t
  modified_base (275)..(275): a, c, t, g, unknown or other
  misc_feature (275)..(275): n is a, c, g, or t
  modified_base (289)..(289): a, c, t, g, unknown or other
  misc_feature (289)..(289): n is a, c, g, or t
  modified_base (294)..(294): a, c, t, g, unknown or other
  misc_feature (294)..(294): n is a, c, g, or t
  modified_base (376)..(376): a, c, t, g, unknown or other
  misc_feature (376)..(376): n is a, c, g, or t
tcagtcgcactagtcacgaccggtgctcgatttagtctagcgactttgggtttgggggctatgttaaaaggtgtccagtgtgaggtgcagctgttggagtctgggggaggcttggtacaggcggggggggtccctgagactctcctgtacagtctctggattcagctttagcacctatgccatgagctgggtccnccaggctccgagggaaggggctggagtgggtctcatccattagtggtgccagtggtgtaatacatattangtggactcgngaggcgtcacatcncaganacaattccaaagaacactctgtatctgacaaaatcgaaacagcctgacgccgaccgaggaccacggccctaaagttacttcngtgacgtaaatcctacccggatttgtaggtttcgaccctaacctaactttcgaccttaccggtcggggacccgaacgggtaaccccgtcgggtacctacccgttcctccgtacacgtcctaccccgaaccgaaccgggccctacgttcccggtcccttccccgtcggccctacccctcctccgaacgacgccaccgtcggacgggggcacgcggccggccgtgggccgttcgtccgttcggtaaccg

SEQ ID NO: 299048 - DNA, 628 bp, Homo sapiens
  misc_feature: GZ8MTXP01DOJU4.39.26.C04.1.454.CMB.2.raw
  modified_base (291)..(291): a, c, t, g, unknown or other
  misc_feature (291)..(291): n is a, c, g, or t
  modified_base (294)..(294): a, c, t, g, unknown or other
  misc_feature (294)..(294): n is a, c, g, or t
  modified_base (299)..(299): a, c, t, g, unknown or other
  misc_feature (299)..(299): n is a, c, g, or t
tcagtcgcactagtcacgaccggtgctcgatttagtctagcgactttgggtttgggggctatgttaaaaaggtgtccagtgtgaggtgcagctgttggagtctgggggaggcttggtacaggcggggggggtccctgagactctcctgtacagtctctggattcagctttagcacctatgccatgttagctgggtccgccaggctccgaggggagggctggagtgggtctcatcattagtggtgccagtggtagtaatacatattatgtgactcgaggaacggccgtcacntcncaganacaataccaaagaacatctagtatctagacaaaatcgaaacacgcctggacgacccgaccggtaacggaccaccggtcccttaaattacttaacgtgtacgacgtaaactccgtaccgtagttgtacgtttcgacctactaacttcgacctaccggtcggggaccgacgggtaaccctcggtacctaccgtccctccgtacacgtccctaccgaaccgtaaccggcctacgttcccggttcccttccccgtgccctaccccttccaccgaacgcgaccgaccgtcggcgggcacgcggccggccgtcggcgttcgtccgttggtaaccg

SEQ ID NO: 299049 - DNA, 774 bp, Homo sapiens
  misc_feature: GZ8MTXP01AY18Q.39.26.C04.1.454.CMB.2.raw
tcagtcgcactagtcacgaccggtgctcgatttagtctagcgactttgggtttgggggctatgttaaaaggtgtccagtgtgaggtgcagctgttggagtctgggggaggcttggtacaggcggggggggtccctgagactctcctgtacagtctctggattcagctttagcacctatgccatgagcgtgggtccgcaggctccgagggaagggctgggagtgggtctcatcctagttagtggtgccgagtggtggtaatacattattatggtggactccggtaggaacgggccggttcaccatcctaccagagactaattccaaagaacacttctagtatctagacaaagtgaaacacgcctgacgcccgacgagaccacggaccctaataattctgtacgactaaactcctaccgtattcggtacgtttcgaccctaacctaacgtttcgacccttaccgggtacgggggacccctaacgggggtaacccctacgggttacccgaccccgtttcccgttaccccggtacctaacccgggttcccccttaaaccccggaaaccccggttaaaccccggggccccttaaaccggttttacccccgggttccccgtttcccccccgtaaccgggtccccctaaacccccgttccccgtaacccgaaacggtaccgcccgtaaacccggtccggggttacgggggcccttacccggaagggtccccgggtccccgggttgggcccgttcgggttaacccgttcgggtaaaccccgg

SEQ ID NO: 299050 - DNA, 699 bp, Homo sapiens
  misc_feature: GZ8MTXP01CMI1A.39.26.C04.1.454.CMB.2.raw
  modified_base (201)..(201): a, c, t, g, unknown or other
  misc_feature (201)..(201): n is a, c, g, or t
  modified_base (528)..(528): a, c, t, g, unknown or other
  misc_feature (528)..(528): n is a, c, g, or t
  modified_base (557)..(557): a, c, t, g, unknown or other
  misc_feature (557)..(557): n is a, c, g, or t
tcagtcgcactagtcacgaccggtgctcgatttagtctagcgactttgggtttggggagctctgagagaggagcccagccctgggattttcaggtgttttcatttggtgatcaggactgaacagagagaactcaccatggactttgggctgagctgtcctttttcttgtggctatagttaaaaggtgtccagtgtgaggtncagctgttggagtcgtgggggaggcgttgggtacgagggcggggggggtccctggagacctctcctgtacagtctcgtggattcagtcttagctacctatcgccatgacgcgtcgggtcccgccgaggcctaccggagggggaagggggtccgtagggacggtcgggtctacgacttccgtaagtttacggtggtcgaccgtaggttgggtaagttaaactaactagtttaattagttggtacggtaccgttccgggtagggtaaccggggtccgttacaaccgtactcctacccgaagacgtaaactaacgttaccaaaagtaccncgttacttaggtactcgtacgaactaaancgaaacgtgacccgtagacggacccgaccggacggaacctaacccggcctttaaattacgtttaccgtggttacgttacgttaaccttcccgtacccgttaagttcggttacgggtttccaaccccgttaacgttttaaccg

SEQ ID NO: 299051 - DNA, 796 bp, Homo sapiens
  misc_feature: GZ8MTXP01C6DXC.39.26.C04.1.454.CMB.2.raw
  modified_base (752)..(752): a, c, t, g, unknown or other
  misc_feature (752)..(752): n is a, c, g, or t
tcagtcgcactagtcacgaccggtgctcgatttagtctagcgactttgggtttggggagctctgagagaggagcccagccctgggattttcaggtgttttcatttggtgatcaggactgaacagagagaactcaccatggactttgggctgagctgtcctttttcttgtggctatgttaaaaggtgtccagtgtgaggtgcagctggttggagtcggtgggggaggtcgttgggtacgagggccggggggggtccctggacgactctcctgtacagtctcgtggattcagtcttagcacctatgccatgagcgtcgggtcccgccgagggcctaccggaagggggaacgggggcgtaggggtaggtcgggggttcctacacgttccgtagtttagggtgggtcggaccgtagggttgggtaagggttaaaattaacgtaatttaaagtttagttgggtacgggtaccgttacccggggtagggaaaccgggggtcccggtttaacccaacccgtaagttccccgtacccgaaaggaaccgtaaacctaaacgtttaccccgaaaagtaaaccctaccctttaccgttaggttaaacttcccgttaaggaaacccttaaaagtaccggaaaaccgtacggtccccgtaagggtaacggaccccgggacccggaacgggaaaccccgtacccgggttacccttaaagttaacgtttacgcgttaacgacgttaaaaccttcccgtaacccggtntttacgggtacggttttaccaaccccgttaaaccgtttaaccgg

SEQ ID NO: 299052 - DNA, 638 bp, Homo sapiens
  misc_feature: GZ8MTXP01EP4WX.39.26.C04.1.454.CMB.2.raw
  modified_base (343)..(343): a, c, t, g, unknown or other
  misc_feature (343)..(343): n is a, c, g, or t
  modified_base (364)..(364): a, c, t, g, unknown or other
  misc_feature (364)..(364): n is a, c, g, or t
  modified_base (420)..(420): a, c, t, g, unknown or other
  misc_feature (420)..(420): n is a, c, g, or t
tcagtcgcactagtcacgaccggtgctcgatttagtctagcgactttgggtttgggggctatgttaaaaggtgtccagtgtgaggtgcagctgttggagtctggggggaggcttggtacaggcggggggggtccctgagactctcctgtacagtctctggattcagctttagcacctatgccatgagctgggtccgccaggctccgaggggaaggggctggagtgggtctcatccattagtggtgcagtggtggtaatacatattatgtggactccggtggaagggccgttcaccatctcagagacaattccaaagacacttctgtatctgactaaatgaacngcctgacgcccgccgaggacnccggccctaaattattctgtcgacgtaaactcctaccgtactttggtacggtttcnccctaactaacgtttcgaccgttccggtacggggaccgacggggaacccgtcggtccgtaccgtcctaccgtcacgccctacccgaccgaaccgggcccctacgttcccggttcccttcccccgtcggccctcccctccctaccgaaacgccgccgtaccgtcggttcgggggccacgcggccggcccgtcgggccgttcggtcccgttgggtaaccg

SEQ ID NO: 299053 - DNA, 725 bp, Homo sapiens
  misc_feature: GZ8MTXP01BFA52.39.26.C04.1.454.CMB.2.raw
  modified_base (199)..(199): a, c, t, g, unknown or other
  misc_feature (199)..(199): n is a, c, g, or t
  modified_base (238)..(238): a, c, t, g, unknown or other
  misc_feature (238)..(238): n is a, c, g, or t
  modified_base (257)..(257): a, c, t, g, unknown or other
  misc_feature (257)..(257): n is a, c, g, or t
  modified_base (265)..(265): a, c, t, g, unknown or other
  misc_feature (265)..(265): n is a, c, g, or t
  modified_base (288)..(288): a, c, t, g, unknown or other
  misc_feature (288)..(288): n is a, c, g, or t
  modified_base (300)..(300): a, c, t, g, unknown or other
  misc_feature (300)..(300): n is a, c, g, or t
  modified_base (315)..(315): a, c, t, g, unknown or other
  misc_feature (315)..(315): n is a, c, g, or t
  modified_base (340)..(340): a, c, t, g, unknown or other
  misc_feature (340)..(340): n is a, c, g, or t
tcagtcgcactagtcacgaccggtgctcgatttagtctagcgactttgggtttgggggctatgttaaaaaggtgtccagtgtgaggtgcagctgttggagtctggggggaggcttggtacaggcgggggggggtccctgagactctcctgtacagtctctggattcagtctttagcacctatgccatgagctgggtccncaggctccgagggagggctggagtggtctcatcattagnggtgcagtggtagtaatanatattagngtggactcggtaggaaggccgtnactatctcaganactaatcaaagtacnctctgtatctagaacaaagtgaacncgcctaggaccgcccggtaccggaggaaccctaccggtacccttaaattactttcgtgtacgaaccgtaaactcccgtaccgtagttggtacggtttcgacctacgtaacgtttcgaccgttaccggtcgggggaccgtaacgggtacccgtcgtaccgtaccgttcccttccgtaccgtaccgacccctacccgaaccgaaccgggtcccctacgttccccgggttccccttacccccggtccggtacccctacccctaaccctaacccgaacgaaccgcccgtaaccggttccgggttaccgggggcccttaaccgggaacccgggcccggggtccccggtccggggtccgttcccggtaacccggtttcggggtaaacccgg

SEQ ID NO: 299054 - DNA, 648 bp, Homo sapiens
  misc_feature: GZ8MTXP01DIB94.39.26.C04.1.454.CMB.2.raw
  modified_base (534)..(534): a, c, t, g, unknown or other
  misc_feature (534)..(534): n is a, c, g, or t
  modified_base (630)..(630): a, c, t, g, unknown or other
  misc_feature (630)..(630): n is a, c, g, or t
tcagtcgcactagtcacgaccggtgctcgatttagtctagcgactttgggtttggggagctctgagagaggagcccagccctgggattttcaggtgttttcatttggtgatcaggactgaacagagagaactcaccatggactttgggctgagctgtcctttttcttgtggctatgttaaaaggtgtccagtgtgaggtgcagctgttggaggtcgtggggggaggtcgttgggtacgaggggccggggggggtccctggagactctcctgtacagttctcgtggattcagtcttagcacctatcgccatgagcgtcgggtccgccaggcctaccggaagggggaggggtcgtgggtaggtcgggtctcgactcctagttacggtggtcgacgtaggtggtaaggtaaatctaattagttagtggtcggtacgtcgggtaggaacgggtcccgttacacctatcctaccgaagacgaactaacttaccaaagaactacttcgttaggttaactcgtaagaactaaagtgaaacncgacccgtgaccgccggaccggaggaaccacggttccctaagttactacgtgttacgacgttaaactcccgtaccgtaatttcgggacggtttacncccgttaacgtttaaccg

SEQ ID NO: 299055 - DNA, 628 bp, Homo sapiens
  misc_feature: GZ8MTXP01CHEQY.39.26.C04.1.454.CMB.2.raw
  modified_base (293)..(293): a, c, t, g, unknown or other
  misc_feature (293)..(293): n is a, c, g, or t
  modified_base (298)..(298): a, c, t, g, unknown or other
  misc_feature (298)..(298): n is a, c, g, or t
  modified_base (335)..(335): a, c, t, g, unknown or other
  misc_feature (335)..(335): n is a, c, g, or t
  modified_base (339)..(339): a, c, t, g, unknown or other
  misc_feature (339)..(339): n is a, c, g, or t
  modified_base (374)..(374): a, c, t, g, unknown or other
  misc_feature (374)..(374): n is a, c, g, or t
  modified_base (582)..(582): a, c, t, g, unknown or other
  misc_feature (582)..(582): n is a, c, g, or t
tcagtcgcactagtcacgaccggtgctcgatttagtctagcgactttgggtttgggggctatgttaaaaaggtgtccagtgtgaggtggagctgttggagtctggggggaggcttggtacaggcggggggggtccctgagactctcctgtacagtctctggattcagctttagcacctatgccatgagctgggtccgccaggctccgaggggaaggggctggagtgggtctcatccattagtggtgccagtggtgtaatacatattatgtggactcgtgaggccgtcacatcncaganacaatcaaagacactctagtatcagacaaatagaacncgcngacgccgacccgaggacgaccgtacctaataactntgtcgaactaactccgtaccgtagttgtacgttcgacctaacttaacgttcgaccgtccgggtcgggaaccgtacgggtaccgtcggtacctaccgttcctccctacggccgtccctaccgaaccggaccggtccctaccgtcccggttcccctccccgtcgacccctaccctcccaaccgaacgcgcccgttacgtcgggcgggacncggccggcccggtccgtcggtcctcggccgtaacggaaccgtaacg

SEQ ID NO: 299056 - DNA, 673 bp, Homo sapiens
  misc_feature: GZ8MTXP01BQLLV.39.26.C04.1.454.CMB.2.raw
tcagtcgcactagtcacgaccggtgctcgatttagtctagcgactttgggtttggggagctctgagagaggagcccagccctgggattttcaggtgttttcatttggtgatcaggactgaacagagagaactcaccatggactttgggctgagctgcctttttcttgtggctatgttaaaaggtgtccagtgtgaggtgcagctgttggagtcgtgggggaggcttggtacgaggcggggggtccctgagactctcctgtacagtctctggattcagtcttagcacctatcgccatgagcgtgggtcccgccgaggcctacccgagggggaacgggggcgtggggaggttggggtcctcgactccgtagtttacggtgggtcgcccgtaggttggtaaggttaaataactagttatttagtggtacggtacgtccgggtaggaaccggggtccgttaccacctcgtcctacccgaagacgaactaacttaccgaaagtaacctacttccgtaggttactcgtagaacctaaagtacgaaccacggtacctacggtacgcccggacccggacggtaaccaccggttacccttaattacgttaccgtggttacgaccgttaaacgttcccctaccggtcttagggtaccgtttacgccccttaacgtttaacccg

SEQ ID NO: 299057 - DNA, 604 bp, Homo sapiens
  misc_feature: GZ8MTXP01BIH27.39.26.C04.1.454.CMB.2.raw
tcagtcgcactagtcacgaccggtgctcgatttagtctagcgactttgggtttggggagctctgagagaggagcccagccctgggattttcaggtgttttcatttggtgatcaggactgaacagagagaactcaccatggactttgggctgagctgtcctttttcttgtggctatgttaaaaggtgtccagtgtgaggtgcagctgttggagtcgtgggggagcgttggtacgagggcggggggggtccctggagactctcctgtacagtctctggattcagtcttagctacctatgccatgagcgtgggtcccgccgaggctccgagggggaagggctgggagtgggtctcatcctagtttagtggtgcctaggtcgtaggtaaatcattattatgtggactcgtaggaaggcgtatcacatctacgagacgaactaactacaaagtaacctacttacgtagttaacgtctaacgaacaaagtacgaaactacggtccgtaggacgggaccgaccgggaacggaaccgttacccggtacttagtaacttacgttgttcgaactaacgtccgtccgtacgtggttacgtccgaacccgttaacg

SEQ ID NO: 299058 - DNA, 644 bp, Homo sapiens
  misc_feature: GZ8MTXP01CL4IJ.39.26.C04.1.454.CMB.2.raw
  modified_base (549)..(549): a, c, t, g, unknown or other
  misc_feature (549)..(549): n is a, c, g, or t
tcagtcgcactagtcacgaccggtgctcgatttagtctagcgactttgggtttgggggctatgttaaaaaggtgtccagtgtgaggtgcagctgttggagtctgggggaggcttggtacagcgggggggggtccctgagactctcctgtacagtctctggattcagctttagcacctatgccatgagctgggtccgccaggctccgagggaaggggctgggagtgggtctcatccattagtggtgccagtggtaggtaatacattattatggtggactccggtgaacgggccgttcaccatctccagagacaattccaaagacactctgtatctgacaaatgaacacgcctggacgcccgaccgaggaccacggccctaaattattcgtgtgacgtaaactcctcccgtattcgtaggtttcgacctacctaactttcgacttccggtcggggccgaacgggtacccgttgtccgacccgttcctccgtccacgccctacccaccgaaccgggcccctacgtcccggttcccttcccccgtcggtcccncccctccctacccgacgaccgcccgtaacccgtcggttcgggggccacgccgggccggtcccggcgggggtcttcgggtcccgttcgggtaaccg

SEQ ID NO: 299059 - DNA, 612 bp, Homo sapiens
  misc_feature: GZ8MTXP01BLIGY.39.26.C04.1.454.CMB.2.raw
  modified_base (293)..(293): a, c, t, g, unknown or other
  misc_feature (293)..(293): n is a, c, g, or t
  modified_base (311)..(311): a, c, t, g, unknown or other
  misc_feature (311)..(311): n is a, c, g, or t
  modified_base (369)..(369): a, c, t, g, unknown or other
  misc_feature (369)..(369): n is a, c, g, or t
  modified_base (478)..(478): a, c, t, g, unknown or other
  misc_feature (478)..(478): n is a, c, g, or t
tcagtcgcactagtcacgaccggtgctcgatttagtctagcgactttgggtttgggggctatgttaaaaaggtgtccagtgtgaggtgcagctgttggagtctgggggaggcttggtacaacgggggggggtccctgagactctcctgtacagtctctggattcagctttagcacctatgccatgagctgggtccgccaggctccgagggaagggctggagtgggtctcatccattagtggtgccaggtggtggtaatacatattatgtggactccgtgaaggcgtcacatcncagagacattccaagacnctctgtatctgacaaatgaacagcctgagcgcccgaggacacggccctataacttacngtcgacgtaaactcctcccggtacttggaacggtttcgccctaacctactttcgacctccggtcggggaccgtacgggtaaccccgtcggtccctaccgtcctcccgcncgccctcccaccgaacgggccccacgtccggtcccttccccctcggccctccccgtccctaaccaacgacgccaccgtcggtcgggggccacgccgccgggtcccgcgggtctcggccgtcggttaacgaacgg

SEQ ID NO: 299060 - DNA, 899 bp, Homo sapiens
  misc_feature: GZ8MTXP01BSK6I.39.26.C04.1.454.CMB.2.raw
tcagtcgcactagtcacgaccggtgctcgatttagtctagcgactttgggtttggggagctctgagagaggagcccagccctgggattttcaggtgttttcatttggtgatcaggactgaacagagagaactcaccatggactttgggctgagctgtcctttttcttgtggctatagttaaaaggtgtccagtgtgaggtgcagctggttggaggtcgtggggggaggtcgttgggtacgaggggccggggggggtccctggagtactctccgtgtacagtctcgtggtattcagtcttagcacctatgccatggacgtcgtcgggtcccgaccgaggcctaccggaagggggacgggggtcgtggggtacggttcggggtctaccgtacgttacccgtagtttacgggtcgggtcggtacccggtaaggtttagggggttaaagggtttaaaacttaacttaaagttttaaacgttttaaggttacgggtttaacgggggtaaccccgtttaccccgggggttaaggggtaaacccggggggttcccccggtttaaaccccaacccgtaactttacccccgtaacccggaaaacgggtaacggttaaaacccttaaaaccggtttaaaccccaaaaacgtaaacccttaacctttacccgttaagggggtttaaacccttacccggttaagtaaacccgaaaaattacccgaaaccgtacggaccccgttaggggaaaccggccccgggaaccccggaaacggggaaccccggtaacccggttacccctttaaaaggttactttacccgtaaggttacgttaaacccgttaaacgttccccgttacccggtaagttttcgggtacgggttttaccgaaccccttaaaacgtttcccgg

SEQ ID NO: 299061 - DNA, 782 bp, Homo sapiens
  misc_feature: GZ8MTXP01E257R.39.26.C04.1.454.CMB.2.raw
tcagtcgcactagtcacgaccggtgctcgatttagtctagcgactttgggtttgggggctatgttaaaaggtgtccagtgtgaggtgcagctgttggagtctgggggaggcttggtacagcggggggggtccctgagactctcctgtacagtctctggattcagctttagcacctatgccatgagctgggtccgccaggctccgagggaaggggctggagtgggtctcatccattagtggtgccagtggtgtaatacattattatgtggactccgtgaagggccgttcaccatctccagagacaattccaaagaacactctgtatctgacaaatcgaacagcctgacgccgccggaggactaccggccctaagtacttaacgtgtacgacgtaaacttccgtaccccggtatttcggtacggttttacgaccctaacctaaccgtttacggtaacccgttcccggttacggggggaccgtaaccgggggtaaacccccgttcggggttaccccgtaacccggttccccgttccccgttaccggaccgtacccccttaccccgaaaccccggtaaaacccgggggcccccttaacgttccccggggttacccctttcccccccgttaccgggacccctaaccccctttaaccctaaacccgaaacggaccggaccctacccggttaacccgggttccggggggggacccaacccgggaaccgggtccccgggcccccgggttcggggcccggtttccggcccgttccggggttaaaccccggg

SEQ ID NO: 299062 - DNA, 628 bp, Homo sapiens
  misc_feature: GZ8MTXP01D1NKA.39.26.C04.1.454.CMB.2.raw
  modified_base (294)..(294): a, c, t, g, unknown or other
  misc_feature (294)..(294): n is a, c, g, or t
  modified_base (305)..(305): a, c, t, g, unknown or other
  misc_feature (305)..(305): n is a, c, g, or t
  modified_base (331)..(331): a, c, t, g, unknown or other
  misc_feature (331)..(331): n is a, c, g, or t
tcagtcgcactagtcacgaccggtgctcgatttagtctagcgactttgggttttgggggctatgttaaaaggtgtccagtgtgaggtgcagctgttggagtctgggggaggcttggtacagcgggggggtccctgagactctcctgtacagtctctggattcagctttagcacctatgccatgagctgggtccgccaggctccgaggggaaggggctggagtgggtctcatccattagtggtgccagtggtagtaatacatattatgtgactcgagaggcgtcacatctcaganacaatccaaanacactctgtatctgacaaatgaaacngcctaggacgccgaccggaggaaccacggtacccttaaattactttaacgtgtacgaactaaactccttaccccggagtttcggtacgtttcgaccctaactaactttcgtacgttcccgtcgggtaccaacgggtacccttcgtacctaccgtcctccgtcacgtccctaccgaccgaacgggccctacgttccggtcccttccccgtcggccctacccctcctaccaaacgccgcgtaccgtcggttcggggccacgccggccgtccgtcgggcttcggtccgttcgggtaaccg

SEQ ID NO: 299063 - DNA, 242 bp, Homo sapiens
  misc_feature: GZ8MTXP01AHSH4.39.26.C04.1.454.CMB.2.raw
  modified_base (239)..(242): a, c, t, g, unknown or other
  misc_feature (239)..(242): n is a, c, g, or t
tcagtcgcactagtcacgaccggtgctcgatttagtctagcgactttgggtttggtctagcgactttgggtttggggccagggaaccctggtcaccgtctcctcagcctccaccaagggcccatcggtcttccccctggcaccctcctccaagagcacctctggggcacagcggccctgggctgcctggtcaaggactacttccactagtgcgactgagcggctggcaaggcgcatagnnnn

SEQ ID NO: 299064 - DNA, 596 bp, Homo sapiens
  misc_feature: GZ8MTXP01AFR18.39.26.C04.1.454.CMB.2.raw
  modified_base (196)..(196): a, c, t, g, unknown or other
  misc_feature (196)..(196): n is a, c, g, or t
  modified_base (342)..(342): a, c, t, g, unknown or other
  misc_feature (342)..(342): n is a, c, g, or t
tcagtcgcactagtcacgaccggtgctcgatttagtctagcgactttgggtttgggggctatgttaaaaggtgtccagtgtgaggtgcagctgttggagtctggggggaggcttggtacaggcggggggggtccctgagactctcctgtacagtctctggattcagctttagcacctatgccatgagctgggtccnccaggcctccgagggaaggggctgggagtgggtctcatccattagtggtgccagtggtggtaatacatattatgtggactcgtgaagggccgttcacatctcagagacaattccaaagaacactctgtatctgacaaaatgaaacngcctgagccgccgaggacacggcctaatattctgtgacgaaatctcccgattgtagtttgccacctaactttgactccgtacggggccgaacgggaccctcggtccacccgttctacccgtcacgccctaccgaaccgaacggccctacgtcccggtcccttcccccgtcggccctacccctccctaccaacgacgccacccgtcgacggggccacgcggccggtcccgtcggggccttcggcccgttggtccg

SEQ ID NO: 299065 - DNA, 693 bp, Homo sapiens
  misc_feature: GZ8MTXP01A10EO.39.26.C04.1.454.CMB.2.raw
tcagtcgcactagtcacgaccggtgctcgatttagtctagcgactttgggtttggggagctctgagagaggagcccagccctgggattttcaggtgttttcatttggtgatcaggactgaacagagagaactcaccatggactttgggctgagctgtcctttttcttgtggctatgttaaaaggtgtccagtgtgaggtgcagctgtggagtcgtgggggagtcttggtacgagggcggggggggtccctggagactctcctgtacagtctcgtggattcagtcttagctaacctagtgcctatgacgtcgtcgggtccgcgacgcgtccggaagggggaagggtcgtagggtaggtcggtctcaactccgtagttaggtcggtgccgtagtcgggttaaaggttaatcgtaattacgttagtggtcgtaaccgtcggtacgggtaacggggtcccgtttacgaaccctacttaccgacccgtaagaacggtaaacctaaacttaccaaaacgaaccttacgttacttacgggttaactaccggtagaaaccctaaaagttccgaaaaacgtccgtccgtacgaccggtacgacccggaaggaaccgacccgggttacctacttaagttccgtgttacgttagttaacctccgtaccgtaacgttggtcgtttccaaccttaacccgttaacg

SEQ ID NO: 299066 - DNA, 250 bp, Homo sapiens
  misc_feature: GZ8MTXP01AO7Y5.39.26.C04.1.454.CMB.2.raw
  modified_base (244)..(250): a, c, t, g, unknown or other
  misc_feature (244)..(250): n is a, c, g, or t
tcagtcgcactagtcacgaccggtgctcgatttagtctagcgactttgggtttggtctagcgactttgggtttggggccagggaaccctggtcaccgtctcctcagcctccaccaagggcccatcggtcttccccctggccaccctcctccaagagcacctctgggggcacagcggcccctgggctgccctggtcaaggactacttccactagtgcgactgagcgggctggcaaggcgcatagnnnnnnn

SEQ ID NO: 299067 - DNA, 555 bp, Homo sapiens
  misc_feature: GZ8MTXP02IWM9I.39.26.C04.1.454.CMB.2.raw
tcagtcgcactagtcacgaccggtgctcgatttagtctagcgactttgggtttggggctatgttaaaaggtgtccagtgtgaggtgcagctgttggagtctggggaggcttggtacaggcggggggtccctgagactctcctgtacagtctctggattcagctttagcacctatgccatgagctgggtccgccaggctccagggaagggctggagtgggtctcatccattagtggtgccagtggtggtaatacatattatgtggactcgtgaaggccgtcacatctccagagacaattccaaagaacactctgtatctgcaaatgaaacagcctgagccgccgaggacacggccctatattactgtgacgaaatcctcccgacttgagtttcgccaccaactttgactccgtcgggccacgggaaccctggtcaccgtctcctcagcctccaccaacggcccagtccggtcttccccctcggccacccctcctccaacgacgccacctcgtcgggggccaacgcgccggccctcggggcctcgcccgtggtaccg

SEQ ID NO: 299068 - DNA, 540 bp, Homo sapiens
  misc_feature: GZ8MTXP02IQY7U.39.26.C04.1.454.CMB.2.raw
tcagtcgcactagtcacgaccggtgctcgatttagtctagcgactttgggtttgggggctatgttaaaaggtgtccagtgtgaggtgcagctgttggagtctgggggaggcttggtacagcgggggggtccctgagactctcctgtacagtctctggattcagctttagcacctatgccatgagctgggtccgccaggctccagggaaggggctggagtgggtctcatccattagtggtgccagtggtggtaatacatattatgtggactccgtgaagggccggttcaccatctccagagacaattccaaagaacactctgtatctgcaaatgaacagcctgagcgccgagacacggccctatattctgtgcgaaatctcccgatttgagtttgccacaacttgactctcggggcagggaaccctgtcaccgtctcctcacgccctcacccaacggcccatcgtcttcccctcgcaccctcctccaagacgccacctcgtcgggggcacgaagccggccctcgggctcgcctcggtaccg

SEQ ID NO: 299069 - DNA, 690 bp, Homo sapiens
  misc_feature: GZ8MTXP02I6TMG.39.26.C04.1.454.CMB.2.raw
tcagtcgcactagtcacgaccggtgctcgatttagtctagcgactttgggtttgggggctatgttaaaaggtgtccagtgtgaggtggagctgttggagtctgggggaggcttggtacagcgggggggtccctgagactctcctgtacagtctctggattcagctttagcacctatgccatgagctgggtccgccaggctccagggaagggctggagtgggtctcatccattagtggtgccagtggtggtaatacatattatgtggactccgtgaagggccggttcaccatctccagagacaattccaaagaacactctgtatctgacaaatgaacacgcctgacgccgacccggaggaccaccggtcctatacttacgtgtcgacgaaactccctaccgtacttggtacggtttcgaccctaaccttaacgtttcgaccttccggtacgggggacccgaacggggtaaccccgtgggtaccctacccggttccttcccgtacgaccgtcccctacccgaacccggaaaccggggcccctacgttcccgggttcccctttccccccgcgggtacccctaacccccttcccgttaacccgaaaacgccgaccctaacccgttcggggtccgggggaccaaccgacggcccggcccggtcggggcctcggcccgtttgggaccgtaaaccgg

SEQ ID NO: 299070 - DNA, 592 bp, Homo sapiens
  misc_feature: GZ8MTXP02JDPV9.39.26.C04.1.454.CMB.2.raw
  modified_base (341)..(341): a, c, t, g, unknown or other
  misc_feature (341)..(341): n is a, c, g, or t
tcagtcgcactagtcacgaccggtgctcgatttagtctagcgactttgggtttgggggctatgttaaaaggtgtccagtgtgaggtgcagctgttggagtctgggggaggcttggtacagcggggggggtccctgagactctcctgtacagtctctggattcagctttagcacctatgccatgagctgggtccgccaggctccagggaaggggctggagtgggtctcatccattagtggtgccagtggtggtaatacatattatgtggactccgtgaagggccggttcaccatctccagagacaatttccaaagaacactctgtatctgacaaatgaaacngcctgagccgccgaggacacggccctatattactgtgacgaaatcctacccgacttgagtttgccctacctaactttcgactccgtcggggccgacggggaaccctggtcaccgtctccgtcacgccctccaccgaacgggcccacgtccggtccttcccccgtcggccctacccctccctacccgaaacgacgaccaccgtcgtcgggggcaccgaacggccggcccgtcgggctcggccgtcggtaccg

SEQ ID NO: 299071 - DNA, 556 bp, Homo sapiens
  misc_feature: GZ8MTXP02F3XME.39.26.C04.1.454.CMB.2.raw
tcagtcgcactagtcacgaccggtgctcgatttagtctagcgactttgggtttgggggctatgttaaaaggtgtccagtgtgaggtgcagctgttggagtctgggggaggcttggtacagcgggggggtccctgagactctcctgtacagtctctggattcagctttagcacctatgccatgagctgggtccgccaggctccagggaaggggctggagtgggtctcatccattagtggtgccagtggtggtaatacatattatgtggactccgtgaagggccggttcaccatctccagagacaattccaaagaacactctgtatctgcaaatgaaacagcctgagccgccgaggacacggccctatattactgtgacgaaatcctacccgacttgagtttgccaccaacttgactcctcgggccagggaaccctggtcaccgtctcctcacgcctccaccaacggcccactccggtccttccccctcggccacccctcctccaacgacgcacctcgtcggggcacgaacgcggcccgtcgggctcgccgtggtacg

SEQ ID NO: 299072 - DNA, 242 bp, Homo sapiens
  misc_feature: GZ8MTXP02GKUQ3.39.26.C04.1.454.CMB.2.raw
  modified_base (240)..(242): a, c, t, g, unknown or other
  misc_feature (240)..(242): n is a, c, g, or t
tcagtcgcactagtcacgaccggtgctcgatttagtctagcgactttgggtttggtctagcgactttgggtttggggccagggaaccctggtcaccgtctcctcagcctccaccaagggcccatcggtcttccccctggcaccctcctccaagagcacctctggggcacagcggccctgggctgcctggtcaaggactacttccactagtgcgactgagcgggctggcaaggcgcatagnnn

SEQ ID NO: 299073 - DNA, 564 bp, Homo sapiens
  misc_feature: GZ8MTXP02HR73H.39.26.C04.1.454.CMB.2.raw
tcagtcgcactagtcacgaccggtgctcgatttagtctagcgactttgggtttgggggctatgttaaaaggtgtccagtgtgaggtgcagctgttggagtctgggggaggcttggtacagcgggggggtccctgagactctcctgtacagtctctggattcagctttagcacctatgccatgagctgggtccgccaggctccagggaaggggctggagtgggtctcatccattagtggtgccagtggtggtaatacatattatgtggactccgtgaagggccggttcaccatctccagagacaattccaaagaacactctgtatctgcaaaatgaaacagcctgagccgccgaggacacggcctatattactgtagcgaaaatcctcccgacttgagtttgccaccaacttgactccgtggggccagggaaccctcggtcaccgtctcctcacgcctccaccaacgggcccatccggtccttcccccgtggtccaccctcctacccgaacgacgcaccgtcgtcgggggcacgaacggccggccgtcgggctcgcctggtaccg

SEQ ID NO: 299074 - DNA, 574 bp, Homo sapiens
  misc_feature: GZ8MTXP02IFTG6.39.26.C04.1.454.CMB.2.raw
  modified_base (348)..(348): a, c, t, g, unknown or other
  misc_feature (348)..(348): n is a, c, g, or t
  modified_base (439)..(439): a, c, t, g, unknown or other
  misc_feature (439)..(439): n is a, c, g, or t
  modified_base (521)..(521): a, c, t, g, unknown or other
  misc_feature (521)..(521): n is a, c, g, or t
  modified_base (526)..(526): a, c, t, g, unknown or other
  misc_feature (526)..(526): n is a, c, g, or t
  modified_base (532)..(532): a, c, t, g, unknown or other
  misc_feature (532)..(532): n is a, c, g, or t
tcagtcgcactagtcacgaccggtgctcgatttagtctagcgactttgggtttgggggctatgttaaaaggtgtccagtgtgaggtgcagctgttggagtctgggggaggcttggtacaggcggggggggtccctgagactctcctgtacagtctctggattcagctttagcacctatgccatgagctgggtccgccaggctccaggggaaggggctggagtgggtctcatccattagtggtgcagtggtggtaatacatattatgtggactcgtgaagggccgttcaccatctccagagacaatttccaaagaacactctagtatctgcaaaatgaaacagcctganccgccgaggacacggtccctatattaccgtgtagaccgaaaattcctaccccggatttcgtaaggtttgaccctaacctaacggtttttanaaccgttccgtcgggggaccacggggaaacccctggtcaccgtctcctcacgccctcaccaacggccatcggtccttccccncgccncctccncacgacgcactcgcggcgacgcgcgccgcgcgcgcgtcgtcg

SEQ ID NO: 299075 - DNA, 735 bp, Homo sapiens
  misc_feature: GZ8MTXP02IDX8H.39.26.C04.1.454.CMB.2.raw
tcagtcgcactagtcacgaccggtgctcgatttagtctagcgactttgggtttggggagctctgagagaggagcccagccctgggattttcaggtgttttcatttggtgatcaggactgaacagagagaactcaccatggactttgggctgagctgtcctttttcttgtggctatgttaaaaggtgtccagtgtgaggtgcagctgttggagtcgtgggggaggcttggtacgaggcgggggggtccctggagactctcctgtacagtctcgtggattcagtctttagcacctatgccatgacgtcgtcgggtcccgccgaggcctccggaggggaacggggctggggaggttgggtctcgactcctagtttacggtggtcgccgtaggttggtaggttaaatactaattaattacgttggtagggtaaccttccggtagggaaacggggtcccggttaccaacccgtactccctacccgaggaacgtaactaaacttacccgaaaagtaaacctaaccgttcttacgttaacttaccgtacgtaacctaaaagttacgaaaaccacggtacccgtaggaaccggcccggacccggaaacgggaacccgacccgggtaccccttaaagttaacgttaacgttcggttacgtaacccgtaaaacgttccccgttaccccggtaacgttttacgggtaaccggtttttccgaaccccttaaacccgtttaaacccgg

SEQ ID NO: 299076 - DNA, 564 bp, Homo sapiens
  misc_feature: GZ8MTXP02GQ1LF.39.26.C04.1.454.CMB.2.raw
  modified_base (372)..(372): a, c, t, g, unknown or other
  misc_feature (372)..(372): n is a, c, g, or t
tcagtcgcactagtcacgaccggtgctcgatttagtctagcgactttgggtttgggggctatgttaaaaggtgtccagtgtgaggtgcagctgttggagtctgggggaggcttggtacagcggggggggtccctgagactctcctgtacagtctctggattcagctttagcacctatgccatgagctgggtccgccaggctccgagggaaggggctgggagtgggtctcatccattagtggtgccagtggtggtaatacatattatgtggactcgtgaagggccgttcaccatctccagagacaattccaaagaacactctgtatctgacaaatgaacagcctgagcccgccgagacacggccctatattcngtgacgaaatcctacccgattgtagttcgaccctacctaacttgacctcgtcggggccgaacgggaaccctgcaccgtctcctcacgcctccaccgaacggcccagtccggtcctcccccgcgccaccctcctaccaacgcgccaccgtcgtcggggcacgaacgccggccgtcgggctcgccgtcggtacg

SEQ ID NO: 299077 - DNA, 615 bp, Homo sapiens
  misc_feature: GZ8MTXP02HDIV9.39.26.C04.1.454.CMB.2.raw
  modified_base (500)..(500): a, c, t, g, unknown or other
  misc_feature (500)..(500): n is a, c, g, or t
tcagtcgcactagtcacgaccggtgctcgatttagtctagcgactttgggtttggggagctctgagagaggagcccagccctgggattttcaggtgttttcatttggtgatcaggactgaacagagagaactcaccatggactttgggctgagctgcctttttcttgtggctatgttaaaaggtgtccagtgtgaggtgcagctgttggagtcgtgggggaggcttggtacgaggcgggggggtccctgagactctcctgtacagtctctggattcagctttagcacctatcgccatgagcgtcgggtccgccgaggcctccggaggggaaggggcgtgggaggtgggtctcatcctattaggtggtgccgaggtggtaggtaatacattattagtgtggacgtccggtaggaacggggtccgttacgacctacgtcctccgaagacgaacaacttaccaaagaacctactcttagtacttctagacaaaatacgaaacngtaccgtaggacgccggaccgaacggaccgaccggcccttaatacttacgtcgtacgaacgtaaactcccgtacccgtacgttcggtacggtttcgacccttaaaccgttaaccg

SEQ ID NO: 299078 - DNA, 666 bp, Homo sapiens
  misc_feature: GZ8MTXP02FJ0KX.39.26.C04.1.454.CMB.2.raw
  modified_base (305)..(305): a, c, t, g, unknown or other
  misc_feature (305)..(305): n is a, c, g, or t
  modified_base (320)..(320): a, c, t, g, unknown or other
  misc_feature (320)..(320): n is a, c, g, or t
tcagtcgcactagtcacgaccggtgctcgatttagtctagcgactttgggtttgggggctatgttaaaaggtgtccagtgtgaggtgcagctgttggagtctgggggaggcttggtacagcggggggggtccctgagactctcctgtacagtctctggattcagctttagcacctatgccatgagcgtgggtccgcaggctccgagggaagggctggagtgggtctcatcctattaggtggtgcctaggttgggtaggtaatacattattatgtggactcgtggaagggccgtcacatctcaganacaatacaaagaacnctctgtatctagacaaatagaaacagcctggagcccgaccgaacggaccaccggacccttaattactttacgtgtacggaacgtaaaactcctacccgtactttaggtacggtttcgaccctaaccctaaacgtttcgaccgttccggtcgggggtacccgaaacggggtaacccgtcgggtacccgtacccggtcctcccttccaccgtaccctacccgaaccgaaccgggaccctacgtccggttcccttcccccgtcggccctacccctccctaccaacggactaccaccgtcggcggggaccaccgaacggccggccgtcgggcgtcgccgtacggtaaccg

SEQ ID NO: 299079 - DNA, 569 bp, Homo sapiens
  misc_feature: GZ8MTXP02JRHYH.39.26.C04.1.454.CMB.2.raw
  modified_base (452)..(452): a, c, t, g, unknown or other
  misc_feature (452)..(452): n is a, c, g, or t
  modified_base (474)..(474): a, c, t, g, unknown or other
  misc_feature (474)..(474): n is a, c, g, or t
  modified_base (477)..(477): a, c, t, g, unknown or other
  misc_feature (477)..(477): n is a, c, g, or t
tcagtcgcactagtcacgaccggtgctcgatttagtctagcgactttgggtttggggagctctgagagaggagcccagccctgggattttcaggtgttttcatttggtgatcaggactgaacagagagaactcaccatggactttgggctgagctgccttttcttgtggctatgttaaaaggtgtccagtgtgaggtgcagctgttggagtcgtgggggaggcttgggtacgaggcgggggggtcctgagactctcctgtacagtctctggattcagctttagcacctatgccatgagctgggccgccaggctcgaggggacgggctgggagtgggtctcgatccgtattagtggtgcagtgggtagtaatcgtaatattacgtgtggactccgtggaaagggtcccgttacaccgatctcccagacgactaacttccaaagtaacaccttntgtaacttccagtacctaaaanaanaacacgacgacgacgacgacgacgacgacgacctactactacgtacgtacgtacgactaacgtcgtacgtacgtacgtacgtacctactacg

SEQ ID NO: 299080 - DNA, 576 bp, Homo sapiens
  misc_feature: GZ8MTXP02HWT7S.39.26.C04.1.454.CMB.2.raw
tcagtcgcactagtcacgaccggtgctcgatttagtctagcgactttgggtttgggggctatgttaaaaggtgtccagtgtgaggtgcagctgttggagtctgggggaggcttggtacagcggggggggtccctgagactctcctgtacagtctctggattcagctttagcacctatgccatgagctgggtccgccaggctccagggaagggggctggagtgggtctcatccattagtggtgccagtggtggtaatacatattatgtggactccgtgaagggccggttcaccatctccagagacaattcccaaagaacactctgtatctgcaaatgaacagcctgagccgccgagacacggccctatattctgtgacgaaatctcccgattgagtttgccacctaacttgactccgtcggggccacgggaaccctggtccaccgtctcctcagccctccaccaacggcccacgtccgtcctccccctcggccacccctcctaccaacgacgccgaccctccgtcgggggaccaccgaacggccggcccgttcggggccgttcggccgtcggtaccg

SEQ ID NO: 299081 - DNA, 623 bp, Homo sapiens
  misc_feature: GZ8MTXP02IRU8R.39.26.C04.1.454.CMB.2.raw
tcagtcgcactagtcacgaccggtgctcgatttagtctagcgactttgggtttggggagctctgagagaggagcccagccctgggattttcaggtgttttcatttggtgatcaggactgaacagagagaactcaccatggactttgggctgagctgcctttttctgtggctatgttaaaaggtgtccagtgtgaggtgcagctgttggagtcgtgggggaggcttggtacagggccgggggggtccctggagactctcctgtacagtctctggattcagtctttagcacctatgccatgagcgtgggtcccgccgaggcctaccgaggggaaggggctgggaggttgggtctcatccattacgtggtcgccgaggtggtaggtaaatcattatagtgtgactcggtagacgggcgttcacatctccgaagacgtaacaacgttacccaaagaacctacttactacgtaactctagactaaaatcggaaaccaggtccctaggacgaccggaccggtaaacgggaccgtaccggacccttaaagttaacgttaccgtggtacgaccgtaaaactcccgttaccccgtagtttcggtaacgggtttcgaccctaaccgtttaacg

SEQ ID NO: 299082 - DNA, 793 bp, Homo sapiens
  misc_feature: GZ8MTXP02JJQZ1.39.26.C04.1.454.CMB.2.raw
  modified_base (369)..(369): a, c, t, g, unknown or other
  misc_feature (369)..(369): n is a, c, g, or t
tcagtcgcactagtcacgaccggtgctcgatttagtctagcgactttgggtttgggggctatgttaaaaggtgtccagtgtgaggtgcagctgttggagtctgggggaggcttggtacagcgggggggtccctgagactctcctgtacagtctctggattcagctttagcacctatgccatgagctgggtccgccaggctccagggaaggggctggagtgggtctcatccattagtggtgccagtggtggtaatacatattatgtggactcgtgaggccgtcacatctcagagacaatccaagaacactctgtatctgacaaatgaacagcctagagcccgccgaagacaccggcctaattacttacgngtagacgtaaatccgtaccccgtaatttcggtaacggtttcgaccctaaccctaaacgtttcgaaacccgttcccggttacgggggacccgtaaaccgggggtaaaccccgtcggggttacccctaacccgggttcccttaccccgttacccgaaccggtcccccttaacccccggtaaacccggtaaacccgggggaccccctaaccggttccccgggggtttaccccctttcccccccgggtacgggtaccccctaaccccccggttaaccctaaaccccgtaaacggaaccgtaccccgtaaacccgtttacccggggtccggggggtacccaaaacccggtaaccggggacccccggggttaccccggtaccggggggtcccttacccgggggtaccccgtttcggggttaaaccccggg

SEQ ID NO: 299083 - DNA, 677 bp, Homo sapiens
  misc_feature: GZ8MTXP02H84TK.39.26.C04.1.454.CMB.2.raw
  modified_base (234)..(234): a, c, t, g, unknown or other
  misc_feature (234)..(234): n is a, c, g, or t
tcagtcgcactagtcacgaccggtgctcgatttagtctagcgacttgggtttgggggaggcttggtacagcgggggggtccctgagactctcctgtacagtctctggattcagcttttagcacctatgccatgagctgggtccgccaggctccagggaaggggctggagtgggtctcatccattagtggtgccagtggtgtaatacatattatgtgactcgtgaagggccgttnaccatctcagagacaattccaaagaacactctgtatctgacaaatgaacagcctgagcgcgagacacggccctatattactgtgacgaaatccaccgactttggaggtttcgccccaacctaactttgaccttcgtgggggcccacgggggaaccccttgggtacccacccgttcctcccgtcaccgccctcccaacccgaaacggggccccctaacgtcccggttccctttccccccgtcggacccctacccccttccctacccgaaacggaccgacccgaacccgttccggtcgggggaccaaccgacggcccgggtccccgtggggccttcggcccgttcgggtaccaaacgggtacctttaccgttaccctaacgttacggtacgaccgtaccgttaggaacgggtccggggcgtacgggaccgaacgggccgacgaag

SEQ ID NO: 299084 - DNA, 550 bp, Homo sapiens
  misc_feature: GZ8MTXP02H44EJ.39.26.C04.1.454.CMB.2.raw
  modified_base (367)..(367): a, c, t, g, unknown or other
  misc_feature (367)..(367): n is a, c, g, or t
  modified_base (370)..(370): a, c, t, g, unknown or other
  misc_feature (370)..(370): n is a, c, g, or t
tcagtcgcactagtcacgaccggtgctcgatttagtctagcgactttgggtttgggggctatgttaaaaggtgtccagtgtgaggtgcagctgttggagtctgggggaggcttggtacagcgggggggtccctgagactctcctgtacagtctctggattcagcttttagcacctatgccatgagctgggtcgccaggctccagggaagggctggagtgggtctcatccattagtggtgccagtggtggtaatacatatatgtggactcgtgaagggcgttcacatctccagagacaattccaaagaacactctgtatctgacaaatgaaacagcctgagccgccgaggacacggccctattattcngtncgaaatcctcccgattgagttgccactaacttcgactcctcggggcacgggaaccctggtcaccgtctcctcacgccctccaccaacggcccagtccggtccttcccccgtcggccaccctcctccaacgacgccacctcgtacggggcacgaacgcgccgtcggctcgccgtcggtacg

SEQ ID NO: 299085 - DNA, 549 bp, Homo sapiens
  misc_feature: GZ8MTXP02ILH1T.39.26.C04.1.454.CMB.2.raw
  modified_base (284)..(284): a, c, t, g, unknown or other
  misc_feature (284)..(284): n is a, c, g, or t
  modified_base (288)..(288): a, c, t, g, unknown or other
  misc_feature (288)..(288): n is a, c, g, or t
  modified_base (295)..(295): a, c, t, g, unknown or other
  misc_feature (295)..(295): n is a, c, g, or t
tcagtcgcactagtcacgaccggtgctcgatttagtctagcgactttgggtttgggggctatgttaaaaggtgtccagtgtgaggtgcagctgttggagtctgggggaggcttggtacagcggggggggtccctgagactctcctgtacagtctctggattcagctttagcacctatgccatgagctgggtccgccaggctccagggaaggggctgggagtgggtctcatccattagtggtgccagtggtggtaatacatattatgtggactcgtgaggccgtnacanctcaganacattccaagaacactctgtatctgacaaatgaaacagctgagccgccgaggcacggcctatattctgtgacgaaatcctacccgatttgagtttcgccacctaacttgactccgtcgggccgacgggacctggtcaccgtcctcctcacgcctccaccacggcccactccgtccttcccctcgccaccctcctccaacgacgaccaccgtcgtcggggcacgaacgccggcccgtcggctcgccgtcggtacg

SEQ ID NO: 299086 - DNA, 824 bp, Homo sapiens
  misc_feature: GZ8MTXP02H7TQZ.39.26.C04.1.454.CMB.2.raw
tcagtcgcactagtcacgaccggtgctcgatttagtctagcgactttgggtttggggagctctgagagaggagcccagccctgggattttcaggtgttttcatttggtgatcaggactgaacagagagaactcaccatggactttgggctgagctgtcctttttcttgtggctatgttaaaaggtgtccagtgtgaggtgcagctggttggagtcggtgggggaggcgttggtacgagggccggggggggtccctggagactctcctgtacagtctctggattcagtctttagcctacctatcgccagtgacggcgttcggggtcccgccgacggcccgtaccggaagggggaacggggtcgtggggaggttcgggtctccgtactccgtaagttaggtgggtcgaccgtaggggttgggttaaggttaaacttacgtaagtttaaattacggttaggttacgggtaacccggttacccgggtaaggggtaaaccccggggggttcccgtttaccaaacccgttacgtacccgtaacccgaaagggaacctaaaccgtaaacttaaccccaaaagtaaacctacgttaccttaggtaaccttccgtaagaacctaaaagtcgaaaacctacggacccgtagaaaccggccggaaaccccggaacgggaaccgtaaaccccggttaccctttaaaagttaacgtttacccggttaggtaaaccggtaacccgttaaaaccgttcccccgttaaccccggtttaaacggtttacgggtttaccgggttttacccgtaaacccttaaaaccccggttttaaacccgg

SEQ ID NO: 299087 - DNA, 672 bp, Homo sapiens
  misc_feature: GZ8MTXP02IZVUP.39.26.C04.1.454.CMB.2.raw
tcagtcgcactagtcacgaccggtgctcgatttagtctagcgactttgggtttggggagctctgagagaggagcccagccctgggattttcaggttgttttcatttggtgatcaggactgaacagagagaactcaccatggactttgggctgagctgtcctttttcttgtggctatagttaaaaggtgtccagtgtgaggtgcagctgttggagtcgtgggggagtcgttggtacgagggcggggggggtccctggagactctcctgtacagtctcgtggattcagtctttagccacctatcgaccatgagcgtcgggtccgcgaggcctaccggaggggaaggggctagggaggtgggtctcgactccgtattaggtggtgaccgtaggttggtaggttaaatactattaagttagtgtcgggtaaccttccgggtaggtaaacggggtcccgtttacaacccgtattcccgtacccgaagacgaaactaacttaacccaaaagaacctaactcttagtaactctacgaacaaaagtcgaaacagtacccaggcgaccgtacccggaagaccgtacccggtacccttaaatacgtttaacgtcgttaaggtactaaaacttcccgtaccccgtaagtttcggtaacggtttccaaccctaacctttaaccg

SEQ ID NO: 299088 - DNA, 580 bp, Homo sapiens
  misc_feature: GZ8MTXP02GHOD7.39.26.C04.1.454.CMB.2.raw
  modified_base (369)..(369): a, c, t, g, unknown or other
  misc_feature (369)..(369): n is a, c, g, or t
tcagtcgcactagtcacgaccggtgctcgatttagtctagcgactttgggtttgggggctatgttaaaaggtgtccagtgtgaggtgcagctgttggagtctgggggaggcttggtacagcgggggggtccctgagactctcctgtacagtctctggattcagctttagcacctatgccatgagctgggtccgccaggctccagggaaggggctggagtgggtctcatccattagtggtgccagtggtggtaatacatattatgtggactccgtgaagggccgttcaccatctccagagacaattccaaagacactctgtatctgacaaatgaaacagcctgagccgccgagacacggccctatattcngtgcgaaatcctacccgattgtagtttcgcctacctaactttcgacctccgtcggggccgacgggaaccctcggtcaccgtcctcctcacgccctcccaccgaaccgggcccactccggtccttcccccgtcggacccaccctcctccaacgacgcctacctccgtacggggccacgaacgccggcccgtcggccgtcgccgtcggtaccg

SEQ ID NO: 299089 - DNA, 662 bp, Homo sapiens
  misc_feature: GZ8MTXP02G40IG.39.26.C04.1.454.CMB.2.raw
tcagtcgcactagtcacgaccggtgctcgatttagtctagcgactttgggtttggggagctctgagagaggagcccagccctgggattttcaggtgttttcatttggtgatcaggactgaacagagagaactcaccatggactttgggctgagctgtcctttttcttgtggctatagttaaaaggtgtccagtgtgaggtgcagctgttggagtcgtgggggagtcgttggtacgagggccggggggtcctgagactctcctgtacagtctctggattcagtcttagcacctatcgccatgacgtcgtcgggtcccgccgaggccgtaccggaggggaacggggtcgtagggaggtcgggtctacactcctagttaggtggtcgaccgtaggttcgggtagtaaatacgtaattattagtgtacgactcggtaggaacggggtccgttacactactctaccgagacgaactaactaccaaagaacctactctagtactcgtagaacctaaagtacgaaacctcgacccgtaggacgaccggaccggaacggaacccgtacccggtacccttaaagttaacgttaccgtagtaccgaacgtaaaacctcccggtaacccgtaagtttacggtacggtttcccacccttaaaccgtttaaaccg

SEQ ID NO: 299090 - DNA, 806 bp, Homo sapiens
  misc_feature: GZ8MTXP02GPG78.39.26.C04.1.454.CMB.2.raw
  modified_base (269)..(269): a, c, t, g, unknown or other
  misc_feature (269)..(269): n is a, c, g, or t
  modified_base (283)..(283): a, c, t, g, unknown or other
  misc_feature (283)..(283): n is a, c, g, or t
tcagtcgcactagtcacgaccggtgctcgatttagtctagcgactttgggtttggggagctctgagagaggagcccagccctgggattttcaggtgttttcatttggtgatcaggactgaacagagagaactcaccatggactttgggctgagctgtcctttttcttgtggctatagttaaaaggtgtccagtgtgaggtgcagctgttggagtcgtgggggaggtcttggtacgagggcgggggggtccctggagactctcctgtacngtctcgtggtatcngtctttacgctacctatcgccatgacgtcgtcgggtcccgccggacggccgtaccggaagggggaacggggccgtaggggtacggttcggggttccttacgacgttaccgtaagtttaccgggtcgggtacgtaccgtagggtttacgggtaggttaaactacgtaattagtttaagttggtacggtacgttacgggtacgggtaaccggggtcccggtttaccaaccgtacgttacccgacccgaaggaaacgtaacttaaacgttaacccaaaacggtaaaccctaaacctttccgttaagttaccgttacgtacggaaaccttaaagtaaccgtaaaacgccggtaaccgtacggggaaccggacccgggaacccgggtaaacggacccgtaacccccgggttaccttaagtttaaaccgttacggtacgttaccggaaaaccgttaaccgttaacccgtaccccggttaagtttacgggttaccgtttaacccggacccttaaaccgttttaaacccgg

SEQ ID NO: 299091 - DNA, 680 bp, Homo sapiens
  misc_feature: GZ8MTXP02HFSNI.39.26.C04.1.454.CMB.2.raw
tcagtcgcactagtcacgaccggtgctcgatttagtctagcgactttgggtttggggagctctgagagaggagcccagccctgggattttcaggtgttttcatttggtgatcaggactgaacagagagaactcaccatggactttgggctgagctgtcctttttcttgtggctataggttaaaaggtgtccagtggtgaggtgcagcttggttggagtcgtgggggaggcgttggtacgagggcgggggggtcctgacgactctcctgtacagtctcgtggattcagtcttagcacctatgccatgagcgtcgggtccgccgaggcccgtaccggaaggggaaggggcgtaggggaggttcgggtctaccgtatccgtagttaggtggtcgcgtaggtggtaggtaatacgtattatacgtgtaggtctacggtggaaccgggttccgtacaccatctacccgagacgtaaacaacttacccaaagaaacctacttacgtagtaactcttaagactaaaagtcaaaacgcgtacccgtaggaccgccgggacccgaacggaaccgacccggttacccttaaattaacgttacgtacggtacgtaaccggtaaaaccttcccgtacccgttaaaacggttcggtaacggggtttaccaaccccgttaaaacctttaaccgg

SEQ ID NO: 299092 - DNA, 548 bp, Homo sapiens
  misc_feature: GZ8MTXP02FHHLW.39.26.C04.1.454.CMB.2.raw
  modified_base (351)..(351): a, c, t, g, unknown or other
  misc_feature (351)..(351): n is a, c, g, or t
  modified_base (406)..(406): a, c, t, g, unknown or other
  misc_feature (406)..(406): n is a, c, g, or t
  modified_base (442)..(442): a, c, t, g, unknown or other
  misc_feature (442)..(442): n is a, c, g, or t
tcagtcgcactagtcacgaccggtgctcgatttagtctagcgactttgggtttggggagctctgagagaggagcccagccctgggattttcaggtgttttcatttggtgatcaggactgaacagagagaactcaccatggactttgggctgagctgcctttttcttgtggctatgttaaaaggtgtccagtgtgaggtgcagctgttggagtctgggggaggcttggtacaggcgggggggtccctgagactctcctgtacagtctctggattcagtctttagcacctatgccatgagctgggtccgccaggctccgaggggaggggctggagtgggtctcatccattagnggtgcagtggtgtaatcatattatgtgactccgtagaacgggccgttcaccatcnccagacgaacaattccaaaagaacactctagtatcngaacaaatcgaaacacgcctgacgcgaccgagaccaccggccctaagtattactgtacgaccgaaaatccgtacccgtattcggtacgtttcgaccaccttaaacg

SEQ ID NO: 299093 - DNA, 589 bp, Homo sapiens
  misc_feature: GZ8MTXP02FFAF6.39.26.C04.1.454.CMB.2.raw
  modified_base (264)..(264): a, c, t, g, unknown or other
  misc_feature (264)..(264): n is a, c, g, or t
  modified_base (300)..(300): a, c, t, g, unknown or other
  misc_feature (300)..(300): n is a, c, g, or t
  modified_base (372)..(372): a, c, t, g, unknown or other
  misc_feature (372)..(372): n is a, c, g, or t
tcagtcgcactagtcacgaccggtgctcgatttagtctagcgactttgggtttgggggctatgttaaaaggtgtccagtgtgaggtgcagctgttggagtctgggggaggcttggtacagcggggggggtccctgagactctcctgtacagtctctggattcagctttagcacctatgccatgagctgggtccgccaggctccgagggaagggctggagtgggtctcatccattagtggtgccagtggtggtaatacatattangtggactccgtgaagggccgttcaccatctccaganacaattccaagaacactctgtatctgcaaatgaaacagcctgacgccgccgaggacacggccctatattacngtagacgtaaatctcccgaacttgtaggtttcgcccacctaactttcgacctccgtcgggggccacggggaaccctcggtccaccgtctcctcacgcctaccaccacgggcccacgtccggtccttcccccgcgcccacccctccctaccaacgacgccacccgtcgtcgggggacaccgaacggccggcccgtcgggcctcggccgtcggtaaccg

SEQ ID NO: 299094 - DNA, 244 bp, Homo sapiens
  misc_feature: GZ8MTXP02GIU7J.39.26.C04.1.454.CMB.2.raw
  modified_base (242)..(244): a, c, t, g, unknown or other
  misc_feature (242)..(244): n is a, c, g, or t
tcagtcgcactagtcacgaccggtgctcgatttagtctagcgactttgggtttggtctagcgactttgggtttggggccagggaaccctggtcaccgtctcctcagcctccaccaagggcccatcggtcttcccccctggcaccctcctccaagagcacctctgggggcacagcggccctgggctgcctggtcaaggactacttccactagtgcgactgagcgggctggcaaggcgcatagnnn

SEQ ID NO: 299095 - DNA, 728 bp, Homo sapiens
  misc_feature: GZ8MTXP02GD03R.39.26.C04.1.454.CMB.2.raw
  modified_base (264)..(264): a, c, t, g, unknown or other
  misc_feature (264)..(264): n is a, c, g, or t
  modified_base (295)..(295): a, c, t, g, unknown or other
  misc_feature (295)..(295): n is a, c, g, or t
  modified_base (371)..(371): a, c, t, g, unknown or other
  misc_feature (371)..(371): n is a, c, g, or t
tcagtcgcactagtcacgaccggtgctcgatttagtctagcgactttgggtttgggggctatgttaaaaggtgtccagtgtgaggtgcagctgttggagtctgggggaggcttggtacagcggggggggtccctgagactctcctgtacagtctctggattcagctttagcacctatgccatgagctgggtccgccaggctccgagggaaggggctggagtgggtctcatccattagtggtgcagtggtggtaatacatattangtgactcgtgaaggccgtcaccatctcaganacaattccaaagaacactctgtatctgacaaatgaaacagcctagacgcgaccgagacacggccctaattattacngtagacgtaaactccgtacccgaatttgtacgtttcgaccctaacctaaactttcgtaacccgttccgtacgggggacccgaacggggtaaacccctgggtacccgtaacccggtcccttcccgttacctaacgcccccttacccgaaaccgtaaaacccggggcccctaaacgttccccggggtttacccttacccccccgttcgggaccccgtaacccccttccccggtaaccctaaaacggtaaccggaccctaaacccgttccgggtaccgggggaccaaaccgaacgggttccccgggacccccggttgggggaccccttacgggtacccccgtggggtttaaaaccccggg

SEQ ID NO: 299096 - DNA, 614 bp, Homo sapiens
  misc_feature: GZ8MTXP02HQKVC.39.26.C04.1.454.CMB.2.raw
  modified_base (277)..(277): a, c, t, g, unknown or other
  misc_feature (277)..(277): n is a, c, g, or t
tcagtcgcactagtcacgaccggtgctcgatttagtctagcgactttgggtttgggggctatgttaaaaggtgtccagtgtgaggtgcagctgttggagtctgggggaggcttggtacaggcgggggggtccctgagactctcctgtacagtctctggattcagctttagcacctatgccatgagctgggtccgccaggctccaaggggaagggctggagtgggtctcatccattagtggtgccaggtggtggtaatacatattatgtggactccgngaacgggccgttcaccatctcagagacaattcccaaagaacactctgtactctgacaaaatcgaaacagcctggagcccgccgagacacggccctaatattctgtgacgaaaatcctaccccgtatttgtagtttcgacctaacctaactttcgaaccttccgtacggggaccgacgggaaaccccgtggtaccaccgtccttccgtcacgtccctacccgaaccgtaacggcccacgtccggttcccttcccccgtcggccctacccctccctaccaacgacgacctaccgtcgtcggggcacgaacggccgccgtcggcgtcgccgtacgtaccg

SEQ ID NO: 299097 - DNA, 756 bp, Homo sapiens
  misc_feature: GZ8MTXP02HZDO9.39.26.C04.1.454.CMB.2.raw
tcagtcgcactagtcacgaccggtgctcgatttagtctagcgactttgggtttgggggctatgttaaaaggtgtccagtgtgaggtgcagctgttggagtctgggggaggcttggtacaggcggggggggtccctgagactctcctgtacagtctctggattcagctttagcacctatgccatgagctgggtccgccaggctccgaggggaagggctggagtgggtctcatccattagtggtgcaggtggtaggtaatactatattatgtggactcggtgaacgggccgttcaccatctaccagagacaattaccaaagaaccactctagtactctagacaaatgaacacgcctgacgccccgaccggaaggaccgaccggtcccttaagttactttaccgtgtacgaccgtaaaacttcccgtacccgtaatttcgggtacgttttccgaccctaaccgttaaccgttttcggaacccgttcccgggtacgggggaccccgtaaacggggtacccccgttagggttacccgtaacccgttcccttacccgttaccgacccggtcccccttaccccggaaacccggtaacccgggtacccccgttaaccgttccccggttcccccttacccccggtccggtaccccctacccccgttaccctaaccgaaccggtacctacccgtacccgtccggggtccggggaccacccgaacggcccggtcccggtcggccgttccggtccgttacggtaaccg

SEQ ID NO: 299098 - DNA, 681 bp, Homo sapiens
  misc_feature: GZ8MTXP02F6LLK.39.26.C04.1.454.CMB.2.raw
tcagtcgcactagtcacgaccggtgctcgatttagtctagcgactttgggtttggggagctctgagagaggagcccagccctgggattttcaggtgttttcatttggtgatcaggactgaacagagagaactcaccatggactttgggctgagctgcctttttcttgtggctatgttaaaaggtgtccagtgtgaggtgcagctgttggagtcgtgggggaggcttggtacgagggccggggggtccctggagtactctcctgtacagtctctggattcagtcttagcacctatcgccatgagcgtcgggtccgccaggcctccggaggggaagggcgtgggaggtgggtctcgatcctagttacggtggtcgccgtaggtggtaggttaatcgtaattattagtgtcggtacgttccggtagggaaaccggggtccgtttacccaacccgtacgttccgtacccgaaggaaccgtaaacctaaacgtttaacccgaaaacgtaaaccctaacgttaccgtaggtttaaactccgtagaaacctaaaagtacgaaacgacgtaccgtaggaccgaccggaccggaacgtaccgaccggtaccctaaagttacgttactcggtacgtaacgtaaactcccgtaccgtacttacggaacgtttccgaccctaaccgttaaccg

SEQ ID NO: 299099 - DNA, 669 bp, Homo sapiens
  misc_feature: GZ8MTXP02IAV7W.39.26.C04.1.454.CMB.2.raw
  modified_base (243)..(243): a, c, t, g, unknown or other
  misc_feature (243)..(243): n is a, c, g, or t
  modified_base (390)..(390): a, c, t, g, unknown or other
  misc_feature (390)..(390): n is a, c, g, or t
tcagtcgcactagtcacgaccggtgctcgatttagtctagcgactttgggtttgggggctatgttaaaaggtgtccagtgtgaggtgcagctgttggagtctgggggaggcttggtacaggcgggggggtccctgagactctcctgtacagtctctggattcagtctttagcacctatgccatgagctgggtccgccaggctccgaggggaagggctggagtgggtctcatccattagtggtncagtggtgtaatacatatatgtggactcgtgaagggccgttacaccatctccagagacaattccaaagaacactctagtatctagacaaaatgaaacagtacctgacgcccgacccgaggacctacggcccttaagtaactttacgngtagaaccgtaaacttccctacccggtatttcgtacggtttacgaccctaacctaacgtttacgaccttccggtacggggacccgaacgggtaacccgtacggtacctaccgttcctacccgtacgaccgtcccaacccgaacccgaaccgggacccgtacgttcccggttcccttcccccgtaccgcccgtaaccccttcccgtaccgaacgaccgacctaccgtccgtccgggtacacgaaccggtccggccgtcggccgtcggtccgtacggtacg

SEQ ID NO: 299100 - DNA, 658 bp, Homo sapiens
  misc_feature: GZ8MTXP02HBNUP.39.26.C04.1.454.CMB.2.raw
  modified_base (268)..(268): a, c, t, g, unknown or other
  misc_feature (268)..(268): n is a, c, g, or t
tcagtcgcactagtcacgaccggtgctcgatttagtctagcgactttgggtttggggagctctgagagaggagcccagccctgggattttcaggtgttttcatttggtgatcaggactgaacagagagaactcaccatggactttgggctgagctgtcctttttcttgtggctatgttaaaaggtgtccagtgtgaggtgcagctgttggagtcgtgggggagtcgttggtacgagggccgggggggtcctggagactctcctgtacngtctcgtggattcagtcttagcacctatcgccatgagcgtcgggtcccgccgacggccgtaccggaaggggaacggggcgtaggggtaggtcggggttcctacgtacgtaccgtagttacggtggtacgcgtaggtggtagtaaactgtattattagtgtacgtacgtccggtagggaacgggtcccgttacaacctacgtccgtacccgagaacgtaacctaaacgttacccgaaaagtaaactacttacgttagtacttcgacgaactaaaagtcgaaactacgccgtaggaccgaccgacggaacgtacccaccggtacctaagtacgttacgtgtacgaacgtaactccgtacgtacgttcgtacgtttccaaccctaacgttacg

SEQ ID NO: 299101 - DNA, 634 bp, Homo sapiens
  misc_feature: GZ8MTXP02H8D7E.39.26.C04.1.454.CMB.2.raw
  modified_base (374)..(374): a, c, t, g, unknown or other
  misc_feature (374)..(374): n is a, c, g, or t
tcagtcgcactagtcacgaccggtgctcgatttagtctagcgactttgggtttgggggctatgttaaaaggtgtccagtgtgaggtgcagctgttggagtctgggggaggcttggtacagcgggggggtccctgagactctcctgtacagtctctggattcagctttagcacctatgccatgagctgggtccgccaggctccgaggggaagggggctggagtgggtctcatccattagtggtgccagtggtggtaatacatattatgtggactccgtgaagggccggttcaccatctccagagacaattccaaagaacactctgtatctgacaaatgaaacagcctgagccgccgagacacggcctatattacngtgacgtaaatcctacccgactttgtaggtttcgccctacctaacgtttcgaacgttcccgtcgggggaccgtaacggggtaaccccgtggtcccgtaccggttcccttaccctccgacgccccttccaacccgaacggggccccagttcccggtccctttcccccgtcggccctacccctccctacccaagacgtccaccgtcggcgggggtccaccgaacggccggcccgtcggggtctccggtccgtcgggtaaccg

SEQ ID NO: 299102 - DNA, 597 bp, Homo sapiens
  misc_feature: GZ8MTXP02GBFH9.39.26.C04.1.454.CMB.2.raw
  modified_base (292)..(292): a, c, t, g, unknown or other
  misc_feature (292)..(292): n is a, c, g, or t
  modified_base (309)..(309): a, c, t, g, unknown or other
  misc_feature (309)..(309): n is a, c, g, or t
tcagtcgcactagtcacgaccggtgctcgatttagtctagcgactttgggtttgggggctatgttaaaaggtgtccagtgtgaggtgcagctgttggagtctgggggaggcttggtacagcggggggggtccctgagactctcctgtacagtctctggattcagctttagcacctatgccatgagctgggtccgccaggctccgagggaaggggctgggagtgggtctcatccattagtggtgcagtggtgtaatacatattatgtgactcgtgaggcgtcacatctcaganacatcaagaacactctntatctgacaaatgaacagcctgagccgaccgaggacaccggcctattacttactgtcgacgaaactccgtaccgactttggtagtttcgcccaacctaactttcgaaccttccggtcggggtaccgaacggggaccctcggtaccaccgttcctcctcacgccctacccgaaccgaaccgggcccacgtccggtccttcccccgtcgccctaccccttccaccacgacgccaaccgtcggacggggccacgccggtcggcccgtcgggcctcggccgtacggtaaccg

SEQ ID NO: 299103 - DNA, 631 bp, Homo sapiens
  misc_feature: GZ8MTXP02JLRDM.39.26.C04.1.454.CMB.2.raw
  modified_base (342)..(342): a, c, t, g, unknown or other
  misc_feature (342)..(342): n is a, c, g, or t
  modified_base (501)..(501): a, c, t, g, unknown or other
  misc_feature (501)..(501): n is a, c, g, or t
tcagtcgcactagtcacgaccggtgctcgatttagtctagcgactttgggtttggggagctctgagagaggagcccagccctgggattttcaggtgttttcatttggtgatcaggactgaacagagagaactcaccatggactttgggctgagctgcctttttcttgtggctatgttaaaaggtgtccagtgtgaggtgcagctgttggagtcgtgggggagcttggtacaggcgggggggtcctgagactctcctgtacagtctctggattcgagtctttagccacctatcgccatgagctgggtccgccaggctccgaggggagggctgggagtgggtcncatccattaggtggtgccaggtggtaggtaatcgattattatgtggtaccttccggtagggtaaacggggtcccgttacaacccgtattcctacccgaagacgaactaaacgttaccaaagaacctactctagtactccgtagaccaaaatcgaaaacngaccctaggaccgcgcccggtaaggaccgaccggtaccctattaacttacgtagtacgtaacgtaaaaccttccgttaaccccggtaacgttttcggacgggttttaccacccctaacctttaaacccgg

SEQ ID NO: 299104 - DNA, 648 bp, Homo sapiens
  misc_feature: GZ8MTXP02JE7B1.39.26.C04.1.454.CMB.2.raw
  modified_base (278)..(278): a, c, t, g, unknown or other
  misc_feature (278)..(278): n is a, c, g, or t
  modified_base (539)..(539): a, c, t, g, unknown or other
  misc_feature (539)..(539): n is a, c, g, or t
  modified_base (548)..(548): a, c, t, g, unknown or other
  misc_feature (548)..(548): n is a, c, g, or t
tcagtcgcactagtcacgaccggtgctcgatttagtctagcgactttgggtttgggggctattttaaaaggtgtccagtgtgaggtgcagctgttggagtctggggggaggcttggtacagccgggggggtccctgagactctcctgtgcagcctctggattcaccttcagcagctatgccatgacctgggtccgccaggctccgagggaagggctggagtgggtctcgtctattagtggaagtggtgcttatacaaactcgcagcctcgtgaggccntcacatctccagacgactattccaaagagccactctgtactctgaccaaaatcgaaacagtcctggaaggtcggaccccggtaagggaccacgggtacccttaattacgttattggtgacgtaaaagtggggtaggggggagtgggggtcttacgtcgtggtcgttttgactagtcggggtcgagggcgccgtggccaccgttcgtcctcgacgtccctaccgaccgtaacgggccctacgtccgggtacccttcccccgngggtccccncccgttcgcccgttccgacgggtacgacccgtacccgttaccggaacgaccgaacccacggaacgggccccggtcccggtcggggtcctacggtacccgg

SEQ ID NO: 299105 - DNA, 666 bp, Homo sapiens
  misc_feature: GZ8MTXP02IU21Z.39.26.C04.1.454.CMB.2.raw
tcagtcgcactagtcacgaccggtgctcgatttagtctagcgactttgggtttggggagctctgagagaggagcccagccctgggattttcaggtgttttcatttggtgatcaggactgaacagagagaactcaccatggactttgggctgagctgtcctttttctgtggctatgttaaaaggtgtccagtgtgaggtgcagctggttggagtcgtgggggaggtcgttggtacgagggccggggggggtccctggacgactcctcctgtactagtctcgtggattcagtctttagcctacctatcgccatgagcgtcggtcccgcgacggcgtccggaggggaacggggcgtagggtaggtcgggtctcgtactccgtaatttacgggtggtcgtccgtagggttaggttaggttaaactacgtattaaagttagttggtagggtaccgttacccgggtagggtaaaccggggtcccgttaccaccctaacgtcctaccgaagacgaactaactaccaaagaccactctagtactcgtacgactaaacgtagaacacgtaccgtagacggccgacgaacggaccaccggtaccttacgtacgttactcggtactacgtaaactccgtaccgtacgttcgtacgtttacgaccgtaactttaaccg

SEQ ID NO: 299106 - DNA, 680 bp, Homo sapiens
  misc_feature: GZ8MTXP02GPJUT.39.26.C04.1.454.CMB.2.raw
  modified_base (357)..(357): a, c, t, g, unknown or other
  misc_feature (357)..(357): n is a, c, g, or t
  modified_base (418)..(418): a, c, t, g, unknown or other
  misc_feature (418)..(418): n is a, c, g, or t
tcagtcgcactagtcacgaccggtgctcgatttagtctagcgactttgggtttgggggctatgttaaaaaggtgtccagtgtgaggtgcagctgttggagtctgggggaggcttggtacaggcgggggggtccctgagactctcctgtacagtctctggattcagtctttagcacctatgccatgagctgggtccgcaggctccgagggaagggctgggagtgggtctcatcctattaggtggtcgccgtaagggttgggtaggttaaactactattattagtggtcggaacttccggtaggaacggggtccggttcacctatcctaccgagacgaactaattaccaaagaacactntagtatctgacaaatgaaacagctagacgcccgacgaagcgaccggtccctattacttcgngtacgtacgtaaactccgtacccgagttagtacgttcgacctaccgtaacttcgacgtccgtcgggaccgaacgggtaaccctcgtaccgtccgtcctcctccgtacgcccgtaccgaaccgaccggccctacgtccggtcccttccccgtaccgccctaccccgtcctacccgaacgaccgaccgtaccgtccggtacgggggacctacggaaccggtcccgggtacccgtcgggtaccgtcggtcccgtacggtaaccgg

SEQ ID NO: 299107 - DNA, 596 bp, Homo sapiens
  misc_feature: GZ8MTXP02I2GIX.39.26.C04.1.454.CMB.2.raw
  modified_base (354)..(354): a, c, t, g, unknown or other
  misc_feature (354)..(354): n is a, c, g, or t
  modified_base (438)..(438): a, c, t, g, unknown or other
  misc_feature (438)..(438): n is a, c, g, or t
  modified_base (479)..(479): a, c, t, g, unknown or other
  misc_feature (479)..(479): n is a, c, g, or t
tcagtcgcactagtcacgaccggtgctcgatttagtctagcgactttgggtttggggagctctgagagaggagcccagccctgggattttcaggtgttttcatttggtgatcaggactgaacagagagaactcaccatggactttgggctgagctgtcctttttcttgtggctatgttaaaaggtgtccagtgtgaggtgcagctgttggagtcgtgggggaggcttggtacgagggcggggggggtccctggagactctcctgtacagtctctggattcagtctttagctacctatcgccatgagcgtcgggtcccgcacggctccgaggggaggggctgggaggtcgggtcncactccattacggtggtcgccgaggtggtaggttaatactattattatggtgtactcgggtaggaacggggtccgttcaccctntctcagacaacacttaccaaagacactactgtattctaganaaactagaacgtagcctagacgaccgaccggaaggaccgaccgggtacccttaagttaactacgtgtacggaactaactccgtacccgtagttcgtacgttcgtaccaacctttacg

SEQ ID NO: 299108 - DNA, 579 bp, Homo sapiens
  misc_feature: GZ8MTXP02GQP5Q.39.26.C04.1.454.CMB.2.raw
  modified_base (299)..(299): a, c, t, g, unknown or other
  misc_feature (299)..(299): n is a, c, g, or t
  modified_base (386)..(386): a, c, t, g, unknown or other
  misc_feature (386)..(386): n is a, c, g, or t
  modified_base (412)..(412): a, c, t, g, unknown or other
  misc_feature (412)..(412): n is a, c, g, or t
tcagtcgcactagtcacgaccggtgctcgatttagtctagcgactttgggtttgggggctatgttaaaaggtgtccagtgtgaggtgcagctgttggagtctgggggaggcttggtacagcgggggggtccctgagactctcctgtacagtctctggattcagctttagcacctatgccatgagctgggtccgccaggctccagggaaggggctggagtgggtctcatccattagtggtgccagtggtggtaatacatattatgtggactcgtgaagggccggttcaccatctccaganacaaattccaaagaacactctgtatctgcaaaatgaaacagcctgagccgccgaggacacggccctatattactgtgcgaaaatccncccgattgagtttgccacaaactttnactcgtcggggccaacgggaacccgtgtccaaccgtcctcctcacgcctacccaacccaaacggacccgacgtccgtccgttccccctccgtccacccctaccctacccaacgacgacacctccgtcggggcgacaacgccggcccgtcggcgtcgtccgtcgtacg

SEQ ID NO: 299109 - DNA, 851 bp, Homo sapiens
  misc_feature: GZ8MTXP02FJ0X2.39.26.C04.1.454.CMB.2.raw
tcagtcgcactagtcacgaccggtgctcgatttagtctagcgactttgggtttggggagctctgagagaggagcccagccctgggattttcaggtgttttcatttggtgatcaggactgaacagagagaactcaccatggactttgggctgagctgtcctttttcttgtggctatagttaaaaggtgtccagtgtgaggtgcagctggttggagtcggtgggggaggtcgttgggtacgaggggccggggggggtccctggacgtactctccgtagtacagttctcgtggtattcgagtctttacgccaacctatcgccagtgagcgtcgggccgcgacggctccggaaggggagggcgtgggtaggtcggtctacgactaccgtagttacggtggtcgacgtaggttggtacgtaatcgtaagttattacgtggtcggtaccgtacgggtagggtaaccgggttcccgttacccaaccgtctacctaccgaagacgaaaccttaaacttacccggaaaaacttaccctaaaccgttcgtaacgtttaacccgttacgtacggtaaaaccttaaaacgtaccggaaaaccgtccgggttacccgttaaacgggggcccgaaacccccgggggtaaccgggaaaacccggggaaaacccccggttaccccggggttaaaaccccttttaaagttttaaaaccgggttttaacccggttagggtttaaaacggtaaaccggttttaaaaaccccgtccccccgggtttaaaacccgtttaacggtttttacccgggggtaaaaacgggtttttccccgaaaaccccctttaaaacccggtttttaaacccggg

SEQ ID NO: 299110 - DNA, 628 bp, Homo sapiens
  misc_feature: GZ8MTXP02GYHU0.39.26.C04.1.454.CMB.2.raw
  modified_base (382)..(382): a, c, t, g, unknown or other
  misc_feature (382)..(382): n is a, c, g, or t
  modified_base (401)..(401): a, c, t, g, unknown or other
  misc_feature (401)..(401): n is a, c, g, or t
  modified_base (423)..(423): a, c, t, g, unknown or other
  misc_feature (423)..(423): n is a, c, g, or t
tcagtcgcactagtcacgaccggtgctcgatttagtctagcgactttgggtttggggagctctgagagaggagcccagccctgggattttcaggtgttttcatttggtgatcaggactgaacagagagaactcaccatggactttgggctgagctgtcctttttcttgtggctatagttaaaaggtgtccagtgtgaggtgcagctgttggagtcgtgggggagtcttggtacgagggccgggggggtccctgagtactctcctgtacagtctctggattcgagtcttaagcacctatgccatgacgcgtcgggtccgccacggcctaccggaggggaaggggtctagggtaggtcgggtctccatccgtagttagtggtanccgaagttggtaggtaaantaatattagtgtaggtactcgnggaacggtcccgttacaccgatctacccagtacgactaaactcgaaaacactatccgtatactagacgtaaacaaactacgaacacgtacgaggaccgaccggacggaacaaccgacccgtaactaacttacgttacgtcgtaacgtaacgaaacttcccgttaccggtaacgttacgggtaccttaccacccctaacgttaacg

SEQ ID NO: 299111 - DNA, 997 bp, Homo sapiens
  misc_feature: GZ8MTXP02FJP3D.39.26.C04.1.454.CMB.2.raw
  modified_base (197)..(197): a, c, t, g, unknown or other
  misc_feature (197)..(197): n is a, c, g, or t
tcagtcgcactagtcacgaccggtgctcgatttagtctagcgactttgggtttgggggctatgttaaaaaggtgtccagtgtgaggtgcagctgttggagtctggggggaggcttggtacaggcggggggggtccctgagactctcctgtacagtctctggattcagctttagcacctatgccatgagctgggtccnccaggctccgagggaagggctggagtgggtctcatcctagttagtggtgccaggttggtaggtaaatactatattatgtggactccggtggaacgggtccggttacaccgatcctaccagacgaacaactttaccaaagaacctactctgtactcgtagaaccaaaagtgaaaccgacgtaccgtaggacgaccccggacccggaaacgggaccgacccggtaccctttaacgttaacttttaccgtcggggtaacgaaccggttaaaaccttccccgtttacccccggtttaaagttttaccgggttaacgggtttttacccggtaaaccccccttaaaacccgtttaaaccgtttttaccggggaacccctttccccggggttaaccggggggacccccgtaaacccgggggttaacccccgttaccggggttaccccaacccccggtttccccttaaccccgtacccggtaacccctacccccccggttaaaccccgaaaccccgggtaaaccccggggttacccccgttaccgtttaccccccgggggtttccccccttacccccccggggtaccggtaccccccccttaaccccccttacccccggttaacccccggtaaaacccggggaaacccggttaccccccgtaccccggggttccccggggggtaaacggggggcccccttaaaaccccggggaacccgggggtcccccccgggggtttaacccccggggttcgggggccccgtttaaccccgggggtcccccgtttaacgggggttaaaaccccccgg

SEQ ID NO: 299112 - DNA, 779 bp, Homo sapiens
  misc_feature: GZ8MTXP02IL5IB.39.26.C04.1.454.CMB.2.raw
  modified_base (669)..(669): a, c, t, g, unknown or other
  misc_feature (669)..(669): n is a, c, g, or t
tcagtcgcactagtcacgaccggtgctcgatttagtctagcgactttgggtttggggagctctgagagaggagcccagccctgggattttcaggtgttttcatttggtgatcaggactgaacagagagaactcaccatggactttgggctgagctgcctttttctgtggctatgttaaaaggtgtccagtgtgaggtgcagctggttggagtcgtgggggagcgttggtacgagggtccgggggggtccctggacgacttcctcctgtactagtctcgtggattcgagttctttagcctacctagtcgacctagtcggacgtccggttccggggtccccgacccgacgggtccccgttacccgggaagggggtaaacgggggtcggttacggggtacgggttcggggttacccttaccgtaccgttacccgttaagtttaaccggggttcggggtccgtacccggtagggttcggggttaaggttaaaccttagttatttaaagtttagttacggttacgggtacgttaccgggtacggggtaaaccgggggtcccggtttaaccaccgtaacttcccgttaacggaaacgtaacggtaaactaaccgttaacccgaaagtaaccctacttccggttattaacgtcgtagaaccctaaagtccgaaacncggtcctaggacggacgacccggagacccgtaccggtccttaaagtacttaacgcgttaacacgtaaacttccgaccctagttacggtacggtttccaccttactaaccg

SEQ ID NO: 299113 - DNA, 681 bp, Homo sapiens
  misc_feature: GZ8MTXP02F1ZQQ.39.26.C04.1.454.CMB.2.raw
  modified_base (240)..(240): a, c, t, g, unknown or other
  misc_feature (240)..(240): n is a, c, g, or t
  modified_base (268)..(268): a, c, t, g, unknown or other
  misc_feature (268)..(268): n is a, c, g, or t
tcagtcgcactagtcacgaccggtgctcgatttagtctagcgactttgggtttgggggctatgttaaaaggtgtccagtgtgaggtgcagctgttggagtctgggggaggcttggtacaggcggggggggtccctgagactctcctgtacagtctctggattcagctttagcacctatgccatgagctgggtccgccaggctccgagggagggctggagtggtctcatccattagtggtnccagttggtaggtaatacagttattacnggtggactccggtaggaacgggccggttacacccatcctacgagtaagacaattaccaaacgaacacttctgtaatcgtagactaaaatcggaaacagccctagacgccccgtaccgaggacctacggacccttataacttcgagtgacgtaaattcctacccgtattgtagttcgacctacctaacgttgtactccgtcggggaccgacgggtaacccgtacggtacctaccgttacctccgttaccgacgtccctaccccgaacccgaaacccgggtccccgtaacgttcccggttcccttcccccgtaccggtccctacccctaccctacccgaagaccgaccgtaccgtccgtacgggggaccaaccgcggcccggtcccgtcgggccgttcggcccgttaggtacccg

SEQ ID NO: 299114 - DNA, 776 bp, Homo sapiens
  misc_feature: GZ8MTXP02HA6E6.39.26.C04.1.454.CMB.2.raw
  modified_base (261)..(261): a, c, t, g, unknown or other
  misc_feature (261)..(261): n is a, c, g, or t
  modified_base (268)..(268): a, c, t, g, unknown or other
  misc_feature (268)..(268): n is a, c, g, or t
  modified_base (346)..(346): a, c, t, g, unknown or other
  misc_feature (346)..(346): n is a, c, g, or t
tcagtcgcactagtcacgaccggtgctcgatttagtctagcgactttgggtttgggggctatgttaaaaggtgtccagtgtgaggtgcagctgttggagtctggggggaggcttggtacaggcggggggggtccctgagactctcctgtacagtctctggattcagctttagcacctatgccatgagctgggtccgccaggctccgaggggaaggggctgggagtgggtctcatccattagtggtgccagtggtgtaatanatattangtgactcgtgaaggccgttcacatctccagagacaatttccaaagaacactctgtatctgacaaatgaacagcctganccgccgaggacacggcctagtattaccgtgtcgacgtaaatcctacccgactttgtacgggttttcgaccctaacccgtaaaccttttacggtaacccgttaccggttaccgggggacccgtaaaccgggggtaaacccccgttacggggttacccgtaaaccccgggttcccttacccccgttacccgtaccggtacccccttaccccgaaaccccggtaaaacccgggggccccctaaacgttcccggggtttccccctttacccccccgtcgggtccccgtaaccccccttacccttacccccgaaacggaccgaccccgtaaaccccgttcccgtaccgggggaacccgtaaccggaaccggaccccggggtcccccggttacgggggacccgtttccggaccccggttacggggttaaaccccgg

SEQ ID NO: 299115 - DNA, 509 bp, Homo sapiens
  misc_feature: GZ8MTXP01CA3XW.13.5.A05.1.454.CMB.2.raw
  modified_base (234)..(234): a, c, t, g, unknown or other
  misc_feature (234)..(234): n is a, c, g, or t
  modified_base (355)..(355): a, c, t, g, unknown or other
  misc_feature (355)..(355): n is a, c, g, or t
  modified_base (448)..(448): a, c, t, g, unknown or other
  misc_feature (448)..(448): n is a, c, g, or t
  modified_base (460)..(460): a, c, t, g, unknown or other
  misc_feature (460)..(460): n is a, c, g, or t
  modified_base (489)..(489): a, c, t, g, unknown or other
  misc_feature (489)..(489): n is a, c, g, or t
tcagtcacgtactacacgaccggtgctcgatttagatagatagacaggggctgggcctcaggaggcagcatcggaggtgcctcagccatggcatggatccctctcttcctcggcgtccttgcttactgcacagaatccatggcctcctatgagttgactcagccaccctccatgtccgtgtccccccggacagacagcctacatcacctgctctggagatgtattgactaacgngtatggttcctggtatcagcagaaggcaggccagccccctgtcctactcatctttcaaaataccaggcgccctcgtggggtccctgagcgattctccccggctccgcctctgggaaacacngtcactctgaccatcagcgggacccagcctattgatgaggctgtctacttctgtcaggggcgtggacacgagcgtgcgtgtcggcggaggccngtctgccgttcngggtcagcccgaggctcgcccctggtccncgttctccgttcccgtcccc

SEQ ID NO: 299116 - DNA, 530 bp, Homo sapiens
  misc_feature: GZ8MTXP01CBLN1.13.5.A05.1.454.CMB.2.raw
  modified_base (306)..(306): a, c, t, g, unknown or other
  misc_feature (306)..(306): n is a, c, g, or t
  modified_base (353)..(353): a, c, t, g, unknown or other
  misc_feature (353)..(353): n is a, c, g, or t
  modified_base (355)..(355): a, c, t, g, unknown or other
  misc_feature (355)..(355): n is a, c, g, or t
tcagtcacgtactacacgaccggtgctcgatttagatagatagacaggggctgggcctcaggaggcagcatcggaggtgcctcagccatggcatggatccctctcttcctcggcgtccttgcttactgcacagaatccatggcctcctatgagttgactcagccacctccatgtccgtgtcccccggacagacagcctacatcacctgctctggagatgtattgactaacgagtatggttcctggtatcagcagaaggcaggccagccccctgtcctactcatctttacaaaatccaggcgccctntcgggggtccctgagcgattccgtccccggctccgctcgtggaaacncngtcactctgaccatcagcggaccagcctattgatgaggctgtctacttctgtcaggggcgtggggacaacgagcgtgcgtggttcggcggagggcccaggtcgtggttaccgtcgttaggtcgacgcccgaaggccttcgcccccgtggtccacgttcctccgttccccgtcccc

SEQ ID NO: 299117 - DNA, 504 bp, Homo sapiens
  misc_feature: GZ8MTXP01B21TM.13.5.A05.1.454.CMB.2.raw
  modified_base (368)..(368): a, c, t, g, unknown or other
  misc_feature (368)..(368): n is a, c, g, or t
  modified_base (474)..(474): a, c, t, g, unknown or other
  misc_feature (474)..(474): n is a, c, g, or t
tcagtcacgtactacacgaccggtgctcgatttagatagatagacaggggacacaagctcagctgtaactgtgccttgactgatcaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctctgcatagaaatggatatactatttggattggtatctgcagaggccagggcagtccccacaactctgatctaattggggttctaagtccgggcctccggggtccctaacgnggttcagtgcagtggatcaggcacagtatttacactagaaaatcgagcagagtggaggctggaggatggttggggtttactatgcatgctaagcttcttcaacctntgcggtactttcggccctgggaacctaagg

SEQ ID NO: 299118 - DNA, 518 bp, Homo sapiens
  misc_feature: GZ8MTXP01DYA6Z.13.5.A05.1.454.CMB.2.raw
  modified_base (190)..(190): a, c, t, g, unknown or other
  misc_feature (190)..(190): n is a, c, g, or t
  modified_base (217)..(217): a, c, t, g, unknown or other
  misc_feature (217)..(217): n is a, c, g, or t
  modified_base (357)..(357): a, c, t, g, unknown or other
  misc_feature (357)..(357): n is a, c, g, or t
  modified_base (499)..(499): a, c, t, g, unknown or other
  misc_feature (499)..(499): n is a, c, g, or t
tcagtcacgtactacacgaccggtgctcgatttagatagatagacaggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagcctacatcacctgctctgganatgtattgactaacgagtatggttctggtatcagcagaaggcaggccagccccctgtcctactcatctttacaaaataccaggccgccctcgtgggggtccctgagcgattcctccccggctccgcctctgggaaacacngtcactctgaccatcagcgggaccagcctatgatgaggctgtctacttctgtcagggggcgtggggacaacgagcgtgcgttggtcggcgggagggccaggtctgacgtcttaggtcagcccgaggctcgcccctcggtccncgttcctcgttcccctccc

SEQ ID NO: 299119 - DNA, 525 bp, Homo sapiens
  misc_feature: GZ8MTXP01A2LB8.13.5.A05.1.454.CMB.2.raw
tcagtcacgtactacacgaccggtgctcgatttagatagatagacaggggacacaagctcagctgtaactgtgccttgactgatcaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagacgcctctgcatagaaatgatataactatttggattgtatctgcagagccagggcacgtccccacactctgatctaagttgggttctagtccgggcctcccggggtcctaagaggttcagtggcagtgatcgaggcacagtatttacatagaaatcgagcagagtggaggctggaggtgtgggtttaggggtttattcgtggtcagtgcaaagtccttacgttacaccctgtcgtccggtacgtttccgggacccgttgggaaccgtaaaggg

SEQ ID NO: 299120 - DNA, 530 bp, Homo sapiens
  misc_feature: GZ8MTXP01AYO0J.13.5.A05.1.454.CMB.2.raw
  modified_base (369)..(369): a, c, t, g, unknown or other
  misc_feature (369)..(369): n is a, c, g, or t
  modified_base (425)..(425): a, c, t, g, unknown or other
  misc_feature (425)..(425): n is a, c, g, or t
tcagtcacgtactacacgaccggtgctcgatttagatagatagacaggggacacaagctcagctgtaactgtgccttgactgatcaggactcctcagttcaccttctcacaatgaggctccctgctcagctcctggggctgctaatgctctgggtctccggatccagtgggaatattgtgatgactcagtctccactctacctcgcccgtcacccctggacgacgccggcctccatcctcctgcaggtccagtcagacgcctctgcatagaaatgataataacttatttgatttggtatctgcagcgcaggcacgtccccacactctgatctaagttcgggtctagtccgggcctccgggtacctaagngtcagtgcagtggatcgagcacagtattacatagaaatcgagcgagaggtggacgngtggtaaggtgttgggtttagggtttatcgtgcagtgacaaagtcttacgacttaaccgtcgtggtccgttacgttccgggaccgttaacgggaaccgtaaaggg

SEQ ID NO: 299121 - DNA, 563 bp, Homo sapiens
  misc_feature: GZ8MTXP01A76VG.13.5.A05.1.454.CMB.2.raw
  modified_base (461)..(461): a, c, t, g, unknown or other
  misc_feature (461)..(461): n is a, c, g, or t
  modified_base (487)..(487): a, c, t, g, unknown or other
  misc_feature (487)..(487): n is a, c, g, or t
tcagtcacgtactacacgaccggtgctcgatttagatagatagacaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagcctacatcacctgctctggagatgtattgactaacgagtatggttcctggtatcagcagaaggcaggccacgccccctgtccctactcatctttacaaaactaccgaggccggtccctcgtcgggggtcccctggacgcgattccgtccccggcctccgcctcgtacgggaaaccacgaacgtccactcctacgacccatcgacggccgggacccagcctattgatgaggtctgtctacttctgtcgaggggcgtgggacaacgngcgtgcgtcggtcggcggacggccgngtcgtcgttcgttcgttacggtcgacgccgacggccgtccgccccgtcgtcctcgttccgtccgttccccgtcccg

SEQ ID NO: 299122 - DNA, 578 bp, Homo sapiens
  misc_feature: GZ8MTXP01CVRHN.13.5.A05.1.454.CMB.2.raw
  modified_base (191)..(191): a, c, t, g, unknown or other
  misc_feature (191)..(191): n is a, c, g, or t
  modified_base (370)..(370): a, c, t, g, unknown or other
  misc_feature (370)..(370): n is a, c, g, or t
  modified_base (456)..(456): a, c, t, g, unknown or other
  misc_feature (456)..(456): n is a, c, g, or t
tcagtcacgtactacacgaccggtgctcgatttagatagatagacaggggctgggcctcaggaggcagcatcggaggtgcctcagccatggcatggatccctctcttcctcggcgtccttgcttactgcacagaatccatggcctcctatgagttgactcagccaccctccatgtccgtgtccccccgganagacagcctacatcacctgctctggagatgtattgaactaacgagtatggttcctggtatcagcagaaggcaggccagccccctgtcctactcatctttacaaaactccaggcgccctcgtcggggtccctgacgcgacttccgtcccccggcctccgcctcgtacggggaaaccacgngtccactctacgacccatcgacgccgggacccaggcctattgatggacggtctgtcttacttctgtcgaggggcgtgggacaacgngcgtgcgtggtcggcggtacgggcctaggtctcggccgttcgttacggtccgacggaccccgaagggccctcccggcccccgttcgggtcctaccgttccgttcccggttcccccgtccccg

SEQ ID NO: 299123 - DNA, 546 bp, Homo sapiens
  misc_feature: GZ8MTXP01BC40Y.13.5.A05.1.454.CMB.2.raw
  modified_base (359)..(359): a, c, t, g, unknown or other
  misc_feature (359)..(359): n is a, c, g, or t
tcagtcacgtactacacgaccggtgctcgatttagatagatagacaggggctgggcctcaggaggcagcatcggaggtgcctcagccatggcatggatccctctcttcctcggcgtccttgcttactgcacagaatccatggcctcctatgagttgactcagccaccctccatgtccgtgtccccccggacagacagcctacatcacctgctctggagatgtattgactaacgagtatggttcctggtatcagcagaaggcaggccagccccctgtcctactcatctttacaaaatccaggcggccctcgtcgggggtccctgagcgattcctccccggctccgcctctgggaaacacngtcactctgaccatcagcggaccagcctatgatgaggtctgtctacttctgtcagggggtcgtggggacaacgagcgtgcgtcggttcgggcgggagggacctaggtcgtcggaccggttcttacgggtcacgccccgaggccgtccggcccccttcgggtccacgttccgtccgttccccgtcccc

SEQ ID NO: 299124 - DNA, 569 bp, Homo sapiens
  misc_feature: GZ8MTXP01B5MU3.13.5.A05.1.454.CMB.2.raw
  modified_base (375)..(375): a, c, t, g, unknown or other
  misc_feature (375)..(375): n is a, c, g, or t
tcagtcacgtactacacgaccggtgctcgatttagatagatagacaggggacacaagctcagctgtaactgtgccttgactgatcaggactcctcagttcaccttctcacaatgaggctccctgctcagctcctggggctgctaatgctctgggtctccggatccagtgggaatattgtgatgactcagtctccactctacctcgcccgtcacccctggagacgccggcctccatcctcctgcaggtccagtcagacgcctcctgcatagaaatggaatataactatttggatttggtatctgcagaggccagggcacgtccccaacactctgatctaagttgggtctagtccgggcctccggggtacctaacgnggtcagtgcagtgatcgagcacagtatttacactagaaatcgaagcgaagagtggaggcgtaggaggtagttgggtttaggggtttattacgtggtacttagtgacgtaaacgtccttaccgttaccttaacccgttcgtacggtcccggttacccgtttccgggacccgttaacggggaaacccgtaaagggg

SEQ ID NO: 299125 - DNA, 557 bp, Homo sapiens
  misc_feature: GZ8MTXP01CHBWM.13.5.A05.1.454.CMB.2.raw
  modified_base (191)..(191): a, c, t, g, unknown or other
  misc_feature (191)..(191): n is a, c, g, or t
  modified_base (501)..(501): a, c, t, g, unknown or other
  misc_feature (501)..(501): n is a, c, g, or t
tcagtcacgtactacacgaccggtgctcgatttagatagatagacaggggctgggcctcaggaggcagcatcggaggtgcctcagccatggcatggatccctctcttcctcggcgtccttgcttactgcacagaatccatggcctcctatgagttgactcagccaccctcatgtccgtcgtccccccgganagacagcctacatcacctgctcgtggagatgtattgactaagagtatggttctggtatcagcagaaggcaggcccacgccccctgtcctactcatctttacaaaataccaggccgccctcgtcgggtccctgacgcgattccgtccccggctccgcctcgtggggaaaccacgtaagtccactctcgacccatcacggcgggacccagcctatgatgaggtctgtctacttctgtcgagggggcgtagggacaacgagcgtgcgtggttccggcgggacggccgagtccgtggaccgttcgttaggtccncggttccccgagggccctccgccccctggtcccacttccttcccgttcccctcccc

SEQ ID NO: 299126 - DNA, 543 bp, Homo sapiens
  misc_feature: GZ8MTXP01B7NM4.13.5.A05.1.454.CMB.2.raw
  modified_base (188)..(188): a, c, t, g, unknown or other
  misc_feature (188)..(188): n is a, c, g, or t
  modified_base (368)..(368): a, c, t, g, unknown or other
  misc_feature (368)..(368): n is a, c, g, or t
  modified_base (431)..(431): a, c, t, g, unknown or other
  misc_feature (431)..(431): n is a, c, g, or t
  modified_base (454)..(454): a, c, t, g, unknown or other
  misc_feature (454)..(454): n is a, c, g, or t
  modified_base (472)..(472): a, c, t, g, unknown or other
  misc_feature (472)..(472): n is a, c, g, or t
  modified_base (483)..(483): a, c, t, g, unknown or other
  misc_feature (483)..(483): n is a, c, g, or t
  modified_base (526)..(526): a, c, t, g, unknown or other
  misc_feature (526)..(526): n is a, c, g, or t
tcagtcacgtactacacgaccggtgctcgatttagatagatagacaggggctgggcctcaggaggcagcatcggaggtgcctcagccatggcatggatccctctcttcctcggcgtccttgcttactgcacagaatccatggcctcctatgagttgactcagccacctcatgtccgtgtcccccgganagacagcctacatcacctgctctggagatgtattgactaagagtatggtctggtatcagcagaagcaggcccagccccctgtcctactcatctttacaaaactccgaggccggccctcgtcgggggtccctggacgtcgactttccgtcccccggctccgcccgtcgtacgggaaacacngtccaactctagacccatcacggccggacccaggtcctattgatgaggctgtctcttctgtcngggggcgttaggggaaccaacgngcgtgcttgggtccgggngggacggaccnggtctggaccgtgttaggcagcccgaggcctcgccccgtgtcncttctccgttccctccc

SEQ ID NO: 299127 - DNA, 545 bp, Homo sapiens
  misc_feature: GZ8MTXP01AQFO9.13.5.A05.1.454.CMB.2.raw
  modified_base (193)..(193): a, c, t, g, unknown or other
  misc_feature (193)..(193): n is a, c, g, or t
  modified_base (363)..(363): a, c, t, g, unknown or other
  misc_feature (363)..(363): n is a, c, g, or t
  modified_base (441)..(441): a, c, t, g, unknown or other
  misc_feature (441)..(441): n is a, c, g, or t
tcagtcacgtactacacgaccggtgctcgatttagatagatagacaggggctggtcctcaggaggcagcatcggaggtgcctcagccatggcatggatccctctcttcctcggcgtccttgcttactgcacagaatccatggcctcctatgagttgactcagcccaccctccatcgtccgtgtccccccgganagacagcctacatccacctgctctggagatgtattgactaacgagtatggttcctggtatcagcagaaggcagggcccagccccctgtcctactcatctttacaaatccaggccgccctcgtcgggggtccctgacgcgattccgccccggctccgcctctgggaaaccncaagtcactctgaccatcagccggacccagcctatgatgaggctgtctacttctgtcgaggggcgtagggacaacggngcgtgcgtggtcgggcggacggccgtagtcgtcggttaccgtgttacggccacgccgacggcctcccgccccgtcgtcctccgttccgtcccgttccccgtccc

SEQ ID NO: 299128 - DNA, 668 bp, Homo sapiens
  misc_feature: GZ8MTXP01EO7RH.13.5.A05.1.454.CMB.2.raw
  modified_base (170)..(170): a, c, t, g, unknown or other
  misc_feature (170)..(170): n is a, c, g, or t
tcagtcacgtactacacgaccggtgctcgatttagatagatagacaggggctgggcctcaggaggcagcatcggaggtgcctcagccatggcatggatccctctcttcctcggcgtccttgcttactgcacaggatccgtggcctcctatgagctgactcagccaccctnagtgtccgtgtccccaggacagacagccagcatcacctgctctaggaaaataaagttggacaagaataaatatacttcctggtatcagcagaagtcaggccagtcccctgtgctggtcatctaatcaaagatgaccaaagccggaccctcgacgggtactccccccgtaggagtccgtattcctacgttcgggcctacccaaaccgttcgtacggggaaaccctcgacgacccctacttcctacgaacctataccgaacgggaccggggaccccgaaggggaccttagttacgggaattacgggaagggtccttaggtaacctttaatttaaccgtggttaccggaagggtccgggtagggaccgtaggacccaaggccaaacgttcgggacccccgttacgttacgttcgttaccggttacgggttaaccgttacggggaacccgtaacggtaacccgtaccggttaaccgttaacggtaacccgaacccgaacccg

SEQ ID NO: 299129 - DNA, 564 bp, Homo sapiens
  misc_feature: GZ8MTXP01BPMUF.13.5.A05.1.454.CMB.2.raw
  modified_base (371)..(371): a, c, t, g, unknown or other
  misc_feature (371)..(371): n is a, c, g, or t
tcagtcacgtactacacgaccggtgctcgatttagatagatagacaggggacacaagctcagctgtaactgtgccttgactgatcaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagacgcctcctgcatagaatggatataactatttggatttggtatctgcagaggccagggcacgtccccacactctgatctaagttggggttctagtccgggccctccggggtcctaacgnggttcagtgcagtggatcgaggcacagtatttacactagaaatcgagcgagaggtaggaggtctaggtagggtagttgggtttagggggtttactttacgtggtacagttcgacgtaaagccttaccgttaccaacccgttcgtacgtccgggttaccgtttccgggccccgttaaggggaacccgtaaaggg

SEQ ID NO: 299130 - DNA, 559 bp, Homo sapiens
  misc_feature: GZ8MTXP01D2HPA.13.5.A05.1.454.CMB.2.raw
  modified_base (189)..(189): a, c, t, g, unknown or other
  misc_feature (189)..(189): n is a, c, g, or t
  modified_base (372)..(372): a, c, t, g, unknown or other
  misc_feature (372)..(372): n is a, c, g, or t
  modified_base (451)..(451): a, c, t, g, unknown or other
  misc_feature (451)..(451): n is a, c, g, or t
  modified_base (468)..(468): a, c, t, g, unknown or other
  misc_feature (468)..(468): n is a, c, g, or t
tcagtcacgtactacacgaccggtgctcgatttagatagatagacaggggctgggcctcaggaggcagcatcggaggtgcctcagccatggcatggatccctctcttcctcggcgtccttgcttactgcacagaatccatggcctcctatgagttgactcagccaccctcatgtccgtgtcccccgganagacagcctacatcacctgctctggagatgtattgactaacgagtatggttctggtatcagcagaaggcaggccacgccccctgtccctactcacttctttaacaaaactaccgaggccggtccctcgtcgggggtccctgacgcgacttccgccccggcctccgcctcgtcggaaaaccacngtccacgtctcgaccatcgacggccgggacccagcctatgagtgaggtctgtctactctgtcgaggggcgtgggacagngcgtgcgttggtcgggnggacggacctggtccgtggacccgttgttacggcacgacccgaggttccctccgcccccgtggtcctaccttcctccgttcccctaacccg

SEQ ID NO: 299131 - DNA, 632 bp, Homo sapiens
  misc_feature: GZ8MTXP01CV0AB.13.5.A05.1.454.CMB.2.raw
  modified_base (575)..(575): a, c, t, g, unknown or other
  misc_feature (575)..(575): n is a, c, g, or t
tcagtcacgtactacacgaccggtgctcgatttagatagatagacaggggctgggcctcaggaggcagcatcggaggtgcctcagccatggcatggatccctctcttcctcggcgtccttgcttactgcacagaatccatggcctcctatgagttgactcagccaccctccatgtccgtcgtcccccggacagacagcctacatcacctgctctggagatgtattgactaacgagtatgttctggtatcagcagaaggcaggccacgccccctgtcctactcattcttacaaaactccgaggccgccctcgtcggggtccctgacgcgtacttccgtcccccggcctccgccgtcgtacgggaaaaccacgtaagtccacctcgtacgaacctacgtaccgacggcccgggaacccaggtacccttaagttcgaaagtcggtacgggtcttggttaccttacgttcgtggttaccgaggggggtccggttaggggaaacctaacgcggtcgtgtcgttcgggtccgggacgggtacgggacctggttcgtcggttaaccgttcgttacggtaccncgacccgacggcctcccgccccgttcggtctccgttccgttccggttccccgtcccg

SEQ ID NO: 299132 - DNA, 602 bp, Homo sapiens
  misc_feature: GZ8MTXP01D2L4E.13.5.A05.1.454.CMB.2.raw
  modified_base (471)..(471): a, c, t, g, unknown or other
  misc_feature (471)..(471): n is a, c, g, or t
  modified_base (502)..(502): a, c, t, g, unknown or other
  misc_feature (502)..(502): n is a, c, g, or t
  modified_base (574)..(574): a, c, t, g, unknown or other
  misc_feature (574)..(574): n is a, c, g, or t
tcagtcacgtactacacgaccggtgctcgatttagatagatagacaggggctgggcctcaggaggcagcatcggaggtgcctcagccatggcatggatccctctcttcctcggcgtccttgcttactgcacagaatccatggcctcctatgagttgactcagccacccctcatcgtccgtgtcccccggacagacagcctacatcacctgctctggagatgtattgactaacgagtatggttcctggtatcagcagaaggcaggccagccccctgtcctactcattctttacaaaactaccgaggccggcctcgtcggggtccctgacgcgtattccgtccccggcctccggcctcgtcggggaaaaccactcgttaccaccttcctcgacccatcgacggcccgggaacccaggtcctattgagtgaggtcttcgtcttacgttcttgcgagggggcggtgggacaacgngcgtgtcgtggttcgggcggacggggtaccnggtaacgtcgttaccgttcgttacggccacgttaccccgagggttccctcccggcccccgttaagggtcccncccgttccgttccgttcccccgttcccc

SEQ ID NO: 299133 - DNA, 642 bp, Homo sapiens
  misc_feature: GZ8MTXP01BHHEU.13.5.A05.1.454.CMB.2.raw
  modified_base (193)..(193): a, c, t, g, unknown or other
  misc_feature (193)..(193): n is a, c, g, or t
tcagtcacgtactacacgaccggtgctcgatttagatagatagacaggggctgggcctcaggaggcagcatcggaggtgcctcagccatggcatggatccctctcttcctcggcgtccttgcttactgcacagaatccatggcctcctatgagttgactcacgccaccctccatcgtccgtcgtcccccgganagacagcctacatccactagctcgtggagatgtattgaactaacgagtattggtcctggtatcagcagaagcgagccacgccccctgtcctactctactctttacaaaacttacccgaggccgtacccgtccgtcggggttccgtcgacggacgtcgtccttcccccggccgtcgtcccgcgttacggaaacgaactcgactacctctcgtacactcgacggaccggcccgagcctacgttagtagtagtacggtcttacgtcttacttccgttgttcgaacgggggcgggttcgggaacgaacgagtcggtcgtcggttcggttccggggtacgggaccggggacgtacgtcggtgttaccccggttagttacggttcgtaacgcccgttaacgggccctccggtccccgtccggtcccgcttcccgttcccgttccccggttccccg

SEQ ID NO: 299134 - DNA, 570 bp, Homo sapiens
  misc_feature: GZ8MTXP01AF45U.13.5.A05.1.454.CMB.2.raw
  modified_base (381)..(381): a, c, t, g, unknown or other
  misc_feature (381)..(381): n is a, c, g, or t
  modified_base (450)..(450): a, c, t, g, unknown or other
  misc_feature (450)..(450): n is a, c, g, or t
  modified_base (452)..(452): a, c, t, g, unknown or other
  misc_feature (452)..(452): n is a, c, g, or t
tcagtcacgtactacacgaccggtgctcgatttagatagatagacaggggacacaagctcagctgtaactgtgccttgactgatcaggactcctcagttcaccttctcacaatgaggctccctgctcagctcctggggctgctaatgctctgggtctccggatccagtgggaatattgtgatgactcagtctccactctacctcgcccgtcacccctggagacgccggcctccatctcctgcaggtccagtcagacgcctcctgcataagaaatggaataataacttatttggattggtatctgcagaggcagggcacgtccccacaactctgactctaagttggggttctaagtccggggccgtccggggtacctaacgngggttcagtgcagtggatcgaggcaactagtaactttacaacttagaaaatcgagcgagaggtggaggngnggaggtgttggttaggggtttattacgtgcttatgactaacgtccttacgttaaccaaccgttcgtcggtccgggttaccgtttccggggaccccgttaaggggaacccgtaaaaggg

SEQ ID NO: 299135 - DNA, 597 bp, Homo sapiens
  misc_feature: GZ8MTXP01CNEI9.13.5.A05.1.454.CMB.2.raw
  modified_base (487)..(487): a, c, t, g, unknown or other
  misc_feature (487)..(487): n is a, c, g, or t
  modified_base (523)..(523): a, c, t, g, unknown or other
  misc_feature (523)..(523): n is a, c, g, or t
tcagtcacgtactacacgaccggtgctcgatttagatagatagacaggggacacaagctcagctgtaactgtgccttgactgatcaggactcctcagttcaccttctcacaatgaggctccctgctcagctcctggggctgctaatgctctgggtctccggatccagtgggaatattgtgatgactcagtctccactctacctgcccgtcacccctggagacgcccggcctccatcctcctgcaggtccagtcagacgcctcctgacaataagaaatggaattaataaacttagtttggatttggtatctgcaggacggccagggcacgtccccaactacctctgacttcgttaaggtttcggggttctaacggtcccggggtcccgttacccgggggtaccctaaggtaggttcaggtcgcgtaggtgatcgaggacactagttacttacaacgtaagtaaaatcgaagcgaagaggtaggacggngtaggaggtagtttgggtttagggttattagtcgtnagtgacgtaagcttacgacttaccgtcgtcggtccggttccgttaccgggacccgttaagggaacccgtaaggg

SEQ ID NO: 299136 - DNA, 633 bp, Homo sapiens
  misc_feature: GZ8MTXP01DPLLP.13.5.A05.1.454.CMB.2.raw
  modified_base (222)..(222): a, c, t, g, unknown or other
  misc_feature (222)..(222): n is a, c, g, or t
  modified_base (477)..(477): a, c, t, g, unknown or other
  misc_feature (477)..(477): n is a, c, g, or t
tcagtcacgtactacacgaccggtgctcgatttagatagatagacaggggctgggcctcaggaggcagcatcggaggtgcctcagccatggcatggatccctctcttcctcggcgtccttgcttactgcacagaatccatggcctcctatgagttgactcagccacccctccattcgtccgtcgtcccccggacagacagcctacatccacctgctctgganatgtatgactaacgagtattggttcctggtatcagcagaaggcaggcccacgccccctgtcctactctattcctttacaaaactccgacggccggtcccgtcgtcggggtccctgacgtcgtattccgtccccggcctccgcctcgtacgggaaaaccacgcgtcactctacgacccatcgacggccgggacccagcctatgataggagtctcgtctacttcgtcgtcggacggggtcggtagggaaaccaacgngtcggtgtcggttcgggtcgggacgggtacgggaccgtaggtccgtacggttaccggttcggttacggtaccggaccggaccccggacggttcccgtcccgggtcccccgtccggttacccgtccgttcccgttccccgttcccccttaacccccg

SEQ ID NO: 299137 - DNA, 542 bp, Homo sapiens
  misc_feature: GZ8MTXP01B7J9D.13.5.A05.1.454.CMB.2.raw
  modified_base (189)..(189): a, c, t, g, unknown or other
  misc_feature (189)..(189): n is a, c, g, or t
  modified_base (216)..(216): a, c, t, g, unknown or other
  misc_feature (216)..(216): n is a, c, g, or t
  modified_base (361)..(361): a, c, t, g, unknown or other
  misc_feature (361)..(361): n is a, c, g, or t
  modified_base (470)..(470): a, c, t, g, unknown or other
  misc_feature (470)..(470): n is a, c, g, or t
tcagtcacgtactacacgaccggtgctcgatttagatagatagacaggggctgggcctcaggaggcagcatcggaggtgcctcagccatggcatggatccctctcttcctcggcgtccttgcttactgcacagaatccatggcctcctatgagttgactcagccacctccatgtccgtgtcccccgganagacagcctacatcacctgctctgganatgtattgactaacgagtatggttcctggtatcagcagaaggcaggccagccccctgtcctactcatctttacaaaactccaggccggccctcgtcggggtcctgacgcgattcctccccggctccgcctcgtcgggaaacacgngtccactctcgaccatcacggccgggacccagcctattcgagtgaggctgtctacttctgtcgacggggcggtagggacacgagcgtgcgttggtccggtggacggccngtcgtcgaccgtcttcggtacacgcccgaggcctcgccccgtcggtccacgttccgtccgttccccgtcccc

SEQ ID NO: 299138 - DNA, 574 bp, Homo sapiens
  misc_feature: GZ8MTXP01EAJ4A.13.5.A05.1.454.CMB.2.raw
  modified_base (494)..(494): a, c, t, g, unknown or other
  misc_feature (494)..(494): n is a, c, g, or t
tcagtcacgtactacacgaccggtgctcgatttagatagatagacaggggacacaagctcagctgtaactgtgccttgactgatcaggactcctcagttcaccttctcacaatgaggctccctgctcagctcctggggctgctaatgctctgggtctccggatccagtgggaatattgtgatgactcagtctccactctacctgcccgtcaccccgtggagacgccggcctccatctcctgcaggtccagtcagacgcctcctgacataagaaatggaatataaacttagtttggatttggtatcgtgcaggacggcagggccacgtccccaacactctgactctaaagttgggttctaagtccgggcccgtccggggtaccctaagtggttcagtggcaggtggatcgaggcacgtagtactttacaatagaaaatcgagtcgaaggagtggagcgtaggtaggtagttgggtttaggggtttatacgtggtnagttcggactaaacggtccttacgttaccttaccgtcgtacggtccgtacgtttccggccgtaacgggaaccgtaaaggg

SEQ ID NO: 299139 - DNA, 676 bp, Homo sapiens
  misc_feature: GZ8MTXP01C8Y1C.13.5.A05.1.454.CMB.2.raw
  modified_base (590)..(590): a, c, t, g, unknown or other
  misc_feature (590)..(590): n is a, c, g, or t
tcagtcacgtactacacgaccggtgctcgatttagatagatagacaggggacacaagctcagctgtaactgtgccttgactgatcaggactcctcagttcaccttctcacaatgaggctccctgctcagctccgtggggctgctaatgctcgtgggtctccggatccagtgggaatattgtgatgactcagtctccactctacctcgcccgtcaccccgtggacgacgcccggcctccatcctcctgcaggtccagtcagacgcctctagacaataagaaataggattaataacttagtttaggtagtttaggtatcgtagcgaaggacggccgagggaccaccgtacccccaaacctaaccgtctagtacttacgttaaggtttacggggtttctaaacggtcccggggtacccgttaccccggggtaccctaaacggtacgggttacgaggttcggacgtaggtggacttacgacggactaacgtaagttaactttaacaagtaagtaaaacttcgaaggaacgaggtaggtagggaagtgtagggtaaaggtagtttgggtttacggggtttaatcgttaaggtacngttacgagtaaacgtaccttaccttaacgttaccctcgttacggtccgttaccggttccggttaccgtaacgggaaccgtaaaggg

SEQ ID NO: 299140 - DNA, 553 bp, Homo sapiens
  misc_feature: GZ8MTXP01CSFOK.13.5.A05.1.454.CMB.2.raw
  modified_base (192)..(192): a, c, t, g, unknown or other
  misc_feature (192)..(192): n is a, c, g, or t
  modified_base (363)..(363): a, c, t, g, unknown or other
  misc_feature (363)..(363): n is a, c, g, or t
  modified_base (448)..(448): a, c, t, g, unknown or other
  misc_feature (448)..(448): n is a, c, g, or t
tcagtcacgtactacacgaccggtgctcgatttagatagatagacaggggctgggcctcaggaggcagcatcggaggtgcctcagccatggcatggatccctctcttcctcggcgtccttgcttactgcacagaatccatggcctcctatgagttgactcagccaccctccatcgtccgtcgtcccccgganagacagcctacatcacctgctcgtggagtatgtattgaactaacgagtatggttctggtatcagcagaggcagccacgcccctgtcctactcatcttacaaactccgaggcgccctcggtcgggcctgacgtcgtacttccgccccggcctccgctcgtagggaaaccacngtcactctcgaccatcgacgtccgggaccagcctatcgagtggacggtctcgtcttacttcgtgtcgaggggcgtacggacacgngcgtgcgtcggtcggcggacggcctggtcgtcgttaccgtcgttacggtcgacgacccgacggcctcccgccccgtcgtcctccgttccgtccgttccccgtccc

SEQ ID NO: 299141 - DNA, 711 bp, Homo sapiens
  misc_feature: GZ8MTXP01BS8Y7.13.5.A05.1.454.CMB.2.raw
  modified_base (191)..(191): a, c, t, g, unknown or other
  misc_feature (191)..(191): n is a, c, g, or t
  modified_base (266)..(266): a, c, t, g, unknown or other
  misc_feature (266)..(266): n is a, c, g, or t
  modified_base (400)..(400): a, c, t, g, unknown or other
  misc_feature (400)..(400): n is a, c, g, or t
tcagtcacgtactacacgaccggtgctcgatttagatagatagacaggggctgggcctcaggaggcagcatcggaggtgcctcagccatggcatggatcactctcttcctcggcgtccttgcttactgcacagaatccatggcctctatgagttgactcagccacctcatcgtccgtgtaccccccggaanagacacgacctacactccgacctgctcgtaggatattgtacttagaacgtaagagttagtcggttcgtaggtacncgagacgaaggaaggcgacggcccaccgtccccctgtacctactctacttacttaacaaaactcgacggccgtccctcgtcgggtcctagacgtcgtactccccgccggtctcccgtcctcgaacgggaaaccncgtacgtacctactacgtacgaaccacgtaccgacggtaccggaacctacgtaccttagttaggaacgtcggtacgtctacgttccttacgttcgttcggtacggggaacggggtcgggtaacgggaaccgaaacggttcgggccggttaggtaccgggtttcgggtaccgggggaccgggtaacgggtaacccggttaaggttccgttaccggtaccgtttaccgttacgggtccgaacccggcccgttaacggtcccgtccccgtcccccggttcggtacccttaccgttcccgtttcccggtcccccg

SEQ ID NO: 299142 - DNA, 699 bp, Homo sapiens
  misc_feature: GZ8MTXP01CQN8N.13.5.A05.1.454.CMB.2.raw
  modified_base (192)..(192): a, c, t, g, unknown or other
  misc_feature (192)..(192): n is a, c, g, or t
  modified_base (557)..(557): a, c, t, g, unknown or other
  misc_feature (557)..(557): n is a, c, g, or t
  modified_base (596)..(596): a, c, t, g, unknown or other
  misc_feature (596)..(596): n is a, c, g, or t
tcagtcacgtactacacgaccggtgctcgatttagatagatagacaggggctgggcctcaggaggcagcatcggaggtgcctcagccatggcatggatccctctcttcctcggcgtccttgcttactgcacagaatccatggcctcctatgagttgactcacgccaccctcatcgtccgtcgtcccccgganagacacgcctacatccacctgctcgtggatatgtattgaactaacgagttagttcggttctggtactcgagacgaaggacggcgacggcccaccgtcccctcgtcctactctattacctttaacaaacgtccgacggccgtccttcgggtcgggtcctgacgtcgtacgtttccgccccggtcctccggtcctacgaccgggaaaccacgtcggtacctccgtacgtacgaaccctactccggggaaccggtcccggggaaccctacggtaacccgtttagtacggtacgttaggtaacggttcgttcggttaacttccgttcgtacggtacggtcggggggtacggtacggggaacctaaacgnggtcccggtagtcgtacggggtcgggacgggacggtccngggttcctacggttccgttacggttcggtacgaccgcccgttacggttcccgtccgtaccccgtcgtcccgtacgttcccgtttaacccgttccccgtaaccg

SEQ ID NO: 299143 - DNA, 671 bp, Homo sapiens
  misc_feature: GZ8MTXP01DV0Q7.13.5.A05.1.454.CMB.2.raw
  modified_base (194)..(194): a, c, t, g, unknown or other
  misc_feature (194)..(194): n is a, c, g, or t
  modified_base (217)..(217): a, c, t, g, unknown or other
  misc_feature (217)..(217): n is a, c, g, or t
  modified_base (221)..(221): a, c, t, g, unknown or other
  misc_feature (221)..(221): n is a, c, g, or t
  modified_base (233)..(233): a, c, t, g, unknown or other
  misc_feature (233)..(233): n is a, c, g, or t
  modified_base (243)..(243): a, c, t, g, unknown or other
  misc_feature (243)..(243): n is a, c, g, or t
  modified_base (247)..(247): a, c, t, g, unknown or other
  misc_feature (247)..(247): n is a, c, g, or t
  modified_base (285)..(285): a, c, t, g, unknown or other
  misc_feature (285)..(285): n is a, c, g, or t
  modified_base (295)..(295): a, c, t, g, unknown or other
  misc_feature (295)..(295): n is a, c, g, or t
tcagtcacgtactacacgaccggtgctcgatttagatagatagacaggggctgggcctcaggaggcagcatcggaggtgcctcagccatggcatggatccctctcttcctcggccgtccttgcttactgcacagaactccatcggcctcctatgagttgactcacgccaccctcatcgtccgtcgtccccgganagaccagcctacatccactgctngganatgtatgacagntatgtctgancagnagagcgcggccacgcccctgtcctactcattacctaanaaactaccgnggccgtacctcggtcgggtcctggacgtcgtacttccgcccgtcctaccgtcccgtacggacgggtaaaaccctacggcgtacctaccgtacctacggaaaccctcgtacggaccggacccgggtaacctaacgttccgtaaggttaccgaaggttcggacggttcttcggtaccttaccgttgtcggttaacgacggggggtcggacgggaaactacgggcgtacgtgtccggttagggtaccccgggagggttaccgggaccttggtaacctcgggttacgttaccgttacggggtacacccggttaaccgcgggttcccttccccggggcccttaacgtccgccgtttcccgtaaccccgttccctaaccccg

SEQ ID NO: 299144 - DNA, 697 bp, Homo sapiens
  misc_feature: GZ8MTXP01D1AHA.13.5.A05.1.454.CMB.2.raw
  modified_base (192)..(192): a, c, t, g, unknown or other
  misc_feature (192)..(192): n is a, c, g, or t
tcagtcacgtactacacgaccggtgctcgatttagatagatagacagggggctgggcctcaggaggcagcatcggaggtgcctcagccatggcatggatccctctcttcctcggcgtccttgcttactgcacagaatccatggcctctatgagttgactcacgccaccctcatcgtccgtcgtaccccgganagacagcctacataccacctgcctcgaggatatgtattagaactaaacgtagttagttcgggttctaggtactcgaggacgaaggaacggcgtaccggcccgaccgtccccccgtacgttacctactactaactttactttaaacaaaaccgttacccgacgggtcccggtacccgtttcggtacggggtccctaggtacgtccgatttccccggtccgtcccttccgtccgtacgtaccgggaaaccacgtgtctacccttacaccggacctacggaccggaccggtacccgggacctagtaccttaggttagtagtacggtgtcttacgtacttcgtcgtacgtacggtacgggggtaacggtagggtaaacccacggtacgtcggtcgggtacgttcgggtacgggcgggtacgacggtcgtaacgtcgcgttacgttcggacgtccggacgttcgacccgtccgtaccctggtacctccggttacctcccgttcccgtccg

SEQ ID NO: 299145 - DNA, 498 bp, Homo sapiens
  misc_feature: GZ8MTXP02J21B8.13.5.A05.1.454.CMB.2.raw
  modified_base (180)..(180): a, c, t, g, unknown or other
  misc_feature (180)..(180): n is a, c, g, or t
  modified_base (190)..(190): a, c, t, g, unknown or other
  misc_feature (190)..(190): n is a, c, g, or t
  modified_base (217)..(217): a, c, t, g, unknown or other
  misc_feature (217)..(217): n is a, c, g, or t
  modified_base (233)..(233): a, c, t, g, unknown or other
  misc_feature (233)..(233): n is a, c, g, or t
  modified_base (347)..(347): a, c, t, g, unknown or other
  misc_feature (347)..(347): n is a, c, g, or t
  modified_base (349)..(349): a, c, t, g, unknown or other
  misc_feature (349)..(349): n is a, c, g, or t
  modified_base (419)..(419): a, c, t, g, unknown or other
  misc_feature (419)..(419): n is a, c, g, or t
  modified_base (432)..(432): a, c, t, g, unknown or other
  misc_feature (432)..(432): n is a, c, g, or t
tcagtcacgtactacacgaccggtgctcgatttagatagatagacaggggctgggcctcaggaggcagcatcggaggtgcctcagccatggcatggatccctctcttcctcggcgtccttgcttactgcacagaatccatggcctcctatgagttgactcagccaccctccatgtccgtntcccccgganagacagcctacatcacctgctctgganatgtattgactaacgngtatggttcctggtatcagcagaaggcaggccagccccctgtcctactcatctttcaaaataccagcgcctctggggtccctgagcgattctccccggctccgctctgggaacncngtcactctgaccatcagcgggacccagcctattgatgaggctgtctacttctgtcaggctggggacaacngcgtgctgtcggnggaggggaccaggtctgaccgtcttaggtcagcccaggctgcccctcggtcactctgttcccaccc

SEQ ID NO: 299146 - DNA, 513 bp, Homo sapiens
  misc_feature: GZ8MTXP02FUOFD.13.5.A05.1.454.CMB.2.raw
  modified_base (366)..(366): a, c, t, g, unknown or other
  misc_feature (366)..(366): n is a, c, g, or t
tcagtcacgtactacacgaccggtgctcgatttagatagatagacaggggacacaagctcagctgtaactgtgccttgactgatcaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattggggttcaatcgggcctccggggtccctaagnggttcagtggcagtggatcgaggcacagtatttacactagaaatcagcagagtggagctggaggtagtggttaggggtttattacgtgcatgacaagctactacaacctcgtcgcggtacgtttccggcccgtacgggacctaaagg

SEQ ID NO: 299147 - DNA, 551 bp, Homo sapiens
  misc_feature: GZ8MTXP02JPYU2.13.5.A05.1.454.CMB.2.raw
  modified_base (191)..(191): a, c, t, g, unknown or other
  misc_feature (191)..(191): n is a, c, g, or t
  modified_base (332)..(332): a, c, t, g, unknown or other
  misc_feature (332)..(332): n is a, c, g, or t
  modified_base (355)..(355): a, c, t, g, unknown or other
  misc_feature (355)..(355): n is a, c, g, or t
  modified_base (357)..(357): a, c, t, g, unknown or other
  misc_feature (357)..(357): n is a, c, g, or t
tcagtcacgtactacacgaccggtgctcgatttagatagatagacaggggctgggcctcaggaggcagcatcggaggtgcctcagccatggcatggatccctctcttcctcggcgtccttgcttactgcacagaatccatggcctcctatgagttgactcagccaccctccatgtccgtgtccccccgganagacagcctacatcacctgctctggagatgtattgactaacgagtatggttcctggtatcagcagaaggcaggccagccccctgtcctactcatctttacaaataccaggccgccctcgtcggggtccctgacgcgattcnccccggctccgcctctgggaacncngtcactctcgaccatcgacggccggacccagccctagtgatgaggctgtctacttcgtgtcgaggtcggtagggacacgagcgtgcgtggtcggcggacgggcctaggtccgtcgtaccggtcgttacggtcgacgacccgaaggccgtccgtcccccgtcggtacctaccgttccgttccgtcccctaccccg

SEQ ID NO: 299148 - DNA, 515 bp, Homo sapiens
  misc_feature: GZ8MTXP02JZJ0Z.13.5.A05.1.454.CMB.2.raw
  modified_base (354)..(354): a, c, t, g, unknown or other
  misc_feature (354)..(354): n is a, c, g, or t
  modified_base (498)..(498): a, c, t, g, unknown or other
  misc_feature (498)..(498): n is a, c, g, or t
tcagtcacgtactacacgaccggtgctcgatttagatagatagacaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagcctacatcacctgctctggagatgtattgactaacgagtatggttcctggtatcagcagaaggcaggccagccccctgtcctactcatctttacaaaatccaggcgccctcgtggggtccctgacgcgattcgtccccggctccgctcgtgggacacngtcactctgaccatcagccggacccagcctatgatgaggctgtctacttctgtcgaggcgtggacacgagcgtgcgtggtcggcggaggaccgagtctggtaccgtcttacgggtcacgcccaaggcctcgccccctcggtccnctcctcgttccccgccc

SEQ ID NO: 299149 - DNA, 566 bp, Homo sapiens
  misc_feature: GZ8MTXP02F4TNO.13.5.A05.1.454.CMB.2.raw
  modified_base (192)..(192): a, c, t, g, unknown or other
  misc_feature (192)..(192): n is a, c, g, or t
  modified_base (368)..(368): a, c, t, g, unknown or other
  misc_feature (368)..(368): n is a, c, g, or t
  modified_base (411)..(411): a, c, t, g, unknown or other
  misc_feature (411)..(411): n is a, c, g, or t
  modified_base (454)..(454): a, c, t, g, unknown or other
  misc_feature (454)..(454): n is a, c, g, or t
tcagtcacgtactacacgaccggtgctcgatttagatagatagacaggggctgggcctcaggaggcagcatcggaggtgcctcagccatggcatggatccctctcttcctcggcgtccttgcttactgcacagaatccatggcctcctatgagttgactcagccaccctccatgtcccgtgtccccccgganagacagcctacatcacctgctctggagatgtattgactaacgagtatggttcctgatatcagcagaaggcaggccacgccccctgtcctactcatctttacaaaatccaggccgccctcgtcggggtcccctgacgcgacttcccgtcccggcctcccgcctcgtacgggaaaccncgacgtcactctcgaccatcacgccggacccagcctagttgangaggtctgtctacttctgttcgagggcgtacgggaacaaacgngcgtgcgtggtcgggcgggacggaccaggtctagtacccgtgttaacggtccacggccccgtaaggcccgtcccggccccctcgggtcctacgttccgtccggtttcccccg

SEQ ID NO: 299150 - DNA, 510 bp, Homo sapiens
  misc_feature: GZ8MTXP02GS5G1.13.5.A05.1.454.CMB.2.raw
  modified_base (368)..(368): a, c, t, g, unknown or other
  misc_feature (368)..(368): n is a, c, g, or t
  modified_base (426)..(426): a, c, t, g, unknown or other
  misc_feature (426)..(426): n is a, c, g, or t
tcagtcacgtactacacgaccggtgctcgatttagatagatagacaggggacacaagctcagctgtaactgtgccttgactgatcaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacactcctgatctattggggttctaagtcgggcctccggggtaccctaagnggttcagtggcagtggatcgaggcacagtatttacactagaaatcagcagagtggagntgagatgttgggttatacgtgcatgacaagctactaacaacctcgtacgtcggtactttccggacccgtacgggaacctaaagg

SEQ ID NO: 299151 - DNA, 577 bp, Homo sapiens
  misc_feature: GZ8MTXP02IAQ70.13.5.A05.1.454.CMB.2.raw
  modified_base (346)..(346): a, c, t, g, unknown or other
  misc_feature (346)..(346): n is a, c, g, or t
  modified_base (352)..(352): a, c, t, g, unknown or other
  misc_feature (352)..(352): n is a, c, g, or t
  modified_base (354)..(354): a, c, t, g, unknown or other
  misc_feature (354)..(354): n is a, c, g, or t
tcagtcacgtactacacgaccggtgctcgatttagatagatagacaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagcctacatcacctgctctggagatgtattgactaacgagtatggttcctggtatcagcagaaggcaggccagccccctgtccctactcatctttcaaaatccaggcggcccctcgtcggggtccctgacgcgattctccggctccgctcgnggaacncngtcactctagacctatcagccggaccagcctatgatgaggctgtctacttcgtgtcgaggcggtgggaacctaacgacgccgtgcgttcggttcgggcggtagggaccctaggtctcggtacccggttctttaaggggcctacggaccccgtaagggcccgttaacggcccccccgttcgggttaccctaaccgtcccgtttccggtttaccccctacccccg

SEQ ID NO: 299152 - DNA, 560 bp, Homo sapiens
  misc_feature: GZ8MTXP02G6W18.13.5.A05.1.454.CMB.2.raw
tcagtcacgtactacacgaccggtgctcgatttagatagatagacaggggacacaagctcagctgtaactgtgccttgactgatcaggactcctcagttcaccttctcacaatgaggctccctgctcagctcctggggctgctaatgctctgggtctccggatccagtgggaatattgtgatgactcagtctccactctacctgccccgtcacccctggagagccggcctccatctcctgcaggtccagtcagacgcctcctgcaatagaaatggataataactatttggattggtatctgcagagcagggcacgtcccaccaactcctgatctagttggggttctaaagtcgggccgtccggggtaccctaagtaggttcagtgcagtcgatcgaggcacgtagtatttacacttaagaaatcgaagtcagaggtaggagagtaggaaggtagttagggttaggggtttaattacgtggactagtcgactaacgtactacctaacaaaccgtcgtacggaccggttacgttccggtacccgtacgggaaccgtaaaggg

SEQ ID NO: 299153 - DNA, 549 bp, Homo sapiens
  misc_feature: GZ8MTXP02I99NP.13.5.A05.1.454.CMB.2.raw
  modified_base (329)..(329): a, c, t, g, unknown or other
  misc_feature (329)..(329): n is a, c, g, or t
  modified_base (350)..(350): a, c, t, g, unknown or other
  misc_feature (350)..(350): n is a, c, g, or t
  modified_base (352)..(352): a, c, t, g, unknown or other
  misc_feature (352)..(352): n is a, c, g, or t
  modified_base (380)..(380): a, c, t, g, unknown or other
  misc_feature (380)..(380): n is a, c, g, or t
tcagtcacgtactacacgaccggtgctcgatttagatagatagacaggggctgggcctcaggaggcagcatcggaggtgcctcagccatggcatggatccctctcttcctcggcgtccttgcttactgcacagaatccatggcctcctatgagttgactcagccaccctccatgtccgtgtccccccggacagacagcctacatcacctgctctggagatgtattgactaacgagtatggttcctggtatcagcagaaggcaggccagccccctgtcctactcatctttacaaaatccaggcgccctcgtggggtccctgagcgattcnccccggctccgctctggaacncngtcactctcgaccatcagccgggacccngccctattcgatgacggtctgtctacttctagtcaggcgtgggacaacgagcgtgcgtggtcggcgggtagggacccaggttccgtggacccgtcttacgggtcacggacccgaagggtcctccggccccccgttcgggtcctaccttccgtccgttccccctaccccg

SEQ ID NO: 299154 - DNA, 623 bp, Homo sapiens
  misc_feature: GZ8MTXP02JTLMR.13.5.A05.1.454.CMB.2.raw
  modified_base (191)..(191): a, c, t, g, unknown or other
  misc_feature (191)..(191): n is a, c, g, or t
  modified_base (371)..(371): a, c, t, g, unknown or other
  misc_feature (371)..(371): n is a, c, g, or t
tcagtcacgtactacacgaccggtgctcgatttagatagatagacaggggctgggcctcaggaggcagcatcggaggtgcctcagccatggcatggatcactctcttcctcggcgtccttgcttactgcacagaatccatggcctcctatgagttgactcagccaccctccatgtccgtcgtcccccgganagacagcctacatccacctgctctggagatgtattgactaacgagtatggttctggtatcagcagaaggcacggccacgccccctgtcctactctactcttaacaaaactccgacggccgccctcggtcggggtccctggacgcgtacttcccgtcccggctcccgccttcgacggaacncgacgtcaccgttcacgaccagtccgacggccgggacccagtcctagttgacgtggacggtcttacgtccttacgttcgtcggttacgacggggtcggtacgggaccgaaacgcggtcggtcggtcggttcgggttacggggacggggtaacggaccgtacggtccgtacggtacccggttcgttacggccgaccggacccgaggtcccgtcccggtcccccgtcggtacctccgttcgtcccgttcccccg

SEQ ID NO: 299155 - DNA, 501 bp, Homo sapiens
  misc_feature: GZ8MTXP02GM723.13.5.A05.1.454.CMB.2.raw
  modified_base (326)..(326): a, c, t, g, unknown or other
  misc_feature (326)..(326): n is a, c, g, or t
  modified_base (429)..(429): a, c, t, g, unknown or other
  misc_feature (429)..(429): n is a, c, g, or t
tcagtcacgtactacacgaccggtgctcgatttagatagatagacaggggacacaagctcagctgtaactgtgccttgactgatcaggactcctcagttcaccttctcacaatgaggctccctgctcagctcctggggctgctaatgctctgggtctccggatccagtgggaatattgtgatgactcagtctccactctacctgccccgtcacccctggagagccggcctccatctcctgcaggtccagtcagagcctcctgcatagaaatggatataactatttggattggtatctgcagaggccagggcacgtcccacactccngatctattggggttctaatcgggcctccggggtccctaacgaggttcagtgcagtggatcgaggcacgagtatttacactagaaaatcagcagagtggagcgngaggatggttggggttatactgcatgcaagctctacaacctcgtgcgtacttcggacccgtggacctaaagg

SEQ ID NO: 299156 - DNA, 535 bp, Homo sapiens
  misc_feature: GZ8MTXP02GDRLS.13.5.A05.1.454.CMB.2.raw
  modified_base (347)..(347): a, c, t, g, unknown or other
  misc_feature (347)..(347): n is a, c, g, or t
  modified_base (383)..(383): a, c, t, g, unknown or other
  misc_feature (383)..(383): n is a, c, g, or t
  modified_base (425)..(425): a, c, t, g, unknown or other
  misc_feature (425)..(425): n is a, c, g, or t
  modified_base (435)..(435): a, c, t, g, unknown or other
  misc_feature (435)..(435): n is a, c, g, or t
  modified_base (464)..(464): a, c, t, g, unknown or other
  misc_feature (464)..(464): n is a, c, g, or t
tcagtcacgtactacacgaccggtgctcgatttagatagatagacaggggacacaagctcagctgtaactgtgccttgactgatcaggactcctcagttcaccttctcacaatgaggctccctgctcagctcctggggctgctaatgctctgggtctccggatccagtgggaatattgtgatgactcagtctccactctacctgcccgtcacccctggagagccggcctccatcctcctgcaggtccagtcagacgcctcctgacaataagaaaatggaattaataaacttagtttaggatttaggtatcgtgcaggaggccagggcacgtccccacaactctgatntagttgggtctaagccggtccgtccgggtcctaagngttcagtgcagtgatgagcacgagtattacatagaaatcagnagagtggagngtagagtagtggttagggtttatagtcgnagtcgacaacgtctactaaccaacctcgtacgccggttacgttccggtacccgtacgggaaacctaaaggg

SEQ ID NO: 299157 - DNA, 530 bp, Homo sapiens
  misc_feature: GZ8MTXP02JG5QN.13.5.A05.1.454.CMB.2.raw
  modified_base (321)..(321): a, c, t, g, unknown or other
  misc_feature (321)..(321): n is a, c, g, or t
  modified_base (357)..(357): a, c, t, g, unknown or other
  misc_feature (357)..(357): n is a, c, g, or t
  modified_base (370)..(370): a, c, t, g, unknown or other
  misc_feature (370)..(370): n is a, c, g, or t
  modified_base (372)..(372): a, c, t, g, unknown or other
  misc_feature (372)..(372): n is a, c, g, or t
  modified_base (395)..(395): a, c, t, g, unknown or other
  misc_feature (395)..(395): n is a, c, g, or t
tcagtcacgtactacacgaccggtgctcgatttagatagatagacaggggacacaagctcagctgtaactgtgccttgactgatcaggactcctcagttcaccttctcacaatgaggctccctgctcagctcctggggctgctaatgctctgggtctccggatccagtgggaatattgtgatgactcagtctccactctacctgccccgtcacccctggagagccggcctccatctcctgcaggtccagtcagagcctctgcatagaatggatataactatttggattggtatctgcagagccaggcacgtcccacactcngatctagttgggtctagcggcctccgggtcctacgngtcagtgcagtgntnagcacagtatttacatagaaatnagcagagtggagcgagaggagttggtttagggtttaattacgtgtacgtagttacggactaaacgtctaacctaacctaaccgtcgtcggtaccggttacgtttccggcccggtacgggtaacccgtaaaacggg

SEQ ID NO: 299158 - DNA, 519 bp, Homo sapiens
  misc_feature: GZ8MTXP02GZBYQ.13.5.A05.1.454.CMB.2.raw
  modified_base (391)..(391): a, c, t, g, unknown or other
  misc_feature (391)..(391): n is a, c, g, or t
  modified_base (421)..(421): a, c, t, g, unknown or other
  misc_feature (421)..(421): n is a, c, g, or t
tcagtcacgtactacacgaccggtgctcgatttagatagatagacaggggacacaagctcagctgtaactgtgccttgactgatcaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaatggaatataactatttggattggtatctgcagaggccagggcagtcccacaactcctgatctagttgggttctaagtcggccgtccggggtcctaagcgttcagtgcgagtcgatcaggccanagtattacatagaaatcagcagagtgagcngagtagtggttagggttatacgtgacagtcgcaaacgtctactaactaacctcgtcgtaccggtactttccggaccgttacgggaacccgtaaaaggg

SEQ ID NO: 299159 - DNA, 590 bp, Homo sapiens
  misc_feature: GZ8MTXP02IZ782.13.5.A05.1.454.CMB.2.raw
  modified_base (234)..(234): a, c, t, g, unknown or other
  misc_feature (234)..(234): n is a, c, g, or t
  modified_base (290)..(290): a, c, t, g, unknown or other
  misc_feature (290)..(290): n is a, c, g, or t
  modified_base (327)..(327): a, c, t, g, unknown or other
  misc_feature (327)..(327): n is a, c, g, or t
  modified_base (404)..(404): a, c, t, g, unknown or other
  misc_feature (404)..(404): n is a, c, g, or t
  modified_base (491)..(491): a, c, t, g, unknown or other
  misc_feature (491)..(491): n is a, c, g, or t
tcagtcacgtactacacgaccggtgctcgatttagatagatagacaggggctgggcctcaggaggcagcatcggaggtgcctcagccatggcatggatccctctcttcctcggcgtccttgcttactgcacaggatccgtggcctcctatgagctgactcagccacctcagtgtccgtgtccccaggacagacagccagcatcacctgctctaggaaataatggcagataaatntacttctggtatcagcagaagtcagccagtcccctgtgctggtcatctatcaaagntagcaagcggcctgaggatccccctgacgcgattctntggcctccaaactcgtagggaacctcaagcccaactctacgaacccataccgagaccggggaccccagggcttacgngggaacttggaacggtactacggtaacttaacgtttaccgtggttaccaagggggtccggttagggggacaacggccaaggaccccncggtaccgcccgtacgttacgtccggttaccgttaccggaacgtacgggaaaccgtaacggtacccgtaacccgtacgtaaacgaccgaaccgaacccg

SEQ ID NO: 299160 - DNA, 565 bp, Homo sapiens
  misc_feature: GZ8MTXP02ICEBY.13.5.A05.1.454.CMB.2.raw
  modified_base (233)..(233): a, c, t, g, unknown or other
  misc_feature (233)..(233): n is a, c, g, or t
  modified_base (398)..(398): a, c, t, g, unknown or other
  misc_feature (398)..(398): n is a, c, g, or t
  modified_base (420)..(420): a, c, t, g, unknown or other
  misc_feature (420)..(420): n is a, c, g, or t
  modified_base (426)..(426): a, c, t, g, unknown or other
  misc_feature (426)..(426): n is a, c, g, or t
tcagtcacgtactacacgaccggtgctcgatttagatagatagacaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagcctacatcacctgctctggagatgtattgactaacgngtatggttcctggtatcagcagaaggcaggccagccccctgtccctactcattctttacaaaatccgaggccggccctgtcggggtccctgacgcgtattccgccccggctcccgcctcgtgggaaccacgacgtccactctacgaccatcgacgccgggacccngcctatgatgagctgtctactntgtcgnggcgtggacacgagcgtagcgtggtcgggcgggagggacccaggttcctggtaccgttcgttacggaccacggacccgtaagggccctccggccccccgttacggtccctaccgttcccgttcggttcccccgtccccg

SEQ ID NO: 299161 - DNA, 560 bp, Homo sapiens
  misc_feature: GZ8MTXP02JGGCC.13.5.A05.1.454.CMB.2.raw
  modified_base (190)..(190): a, c, t, g, unknown or other
  misc_feature (190)..(190): n is a, c, g, or t
  modified_base (335)..(335): a, c, t, g, unknown or other
  misc_feature (335)..(335): n is a, c, g, or t
  modified_base (359)..(359): a, c, t, g, unknown or other
  misc_feature (359)..(359): n is a, c, g, or t
  modified_base (361)..(361): a, c, t, g, unknown or other
  misc_feature (361)..(361): n is a, c, g, or t
  modified_base (375)..(375): a, c, t, g, unknown or other
  misc_feature (375)..(375): n is a, c, g, or t
tcagtcacgtactacacgaccggtgctcgatttagatagatagacaggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagcctacatcacctgctctggagatgtattgactaacgagtatggttcctggtatcagcagaaggcaggccagccccctgtccctactcatctttacaaaatccgaggccgccctcgtcggggtccctggacgcgattccnccccggctccgcctcgtcggaacncngtcactctcgaccntcacggccggacccagccctatgatgaggcttgtctacttcgtgtacgagggtcggtgggactaacggagtcggtgcgttggtcgggcggacgggtcccgaggtcgtcggaccgttcgttacggctacgcccgaacggtcccaaccggtccccctcggtccaccgttccgtcccttccctacccc

SEQ ID NO: 299162 - DNA, 537 bp, Homo sapiens
  misc_feature: GZ8MTXP02I3KW3.13.5.A05.1.454.CMB.2.raw
  modified_base (303)..(303): a, c, t, g, unknown or other
  misc_feature (303)..(303): n is a, c, g, or t
  modified_base (327)..(327): a, c, t, g, unknown or other
  misc_feature (327)..(327): n is a, c, g, or t
  modified_base (430)..(430): a, c, t, g, unknown or other
  misc_feature (430)..(430): n is a, c, g, or t
tcagtcacgtactacacgaccggtgctcgatttagatagatagacaggggacacaagctcagctgtaactgtgccttgactgatcaggactcctcagttcaccttctcacaatgaggctccctgctcagctcctggggctgctaatgctctgggtctccggatccagtgggaatattgtgatgactcagtctccactctacctgcccgtcacccctggagacgccggcctccatctcctgcaggtccagtcagacgcctcctgcatagaaatggatataactatttggattggtatctgcagngccaggcacgtccccacactcctnatctagttgggtctaagtccgggcctccggggtacctaacgtggttcgagtggcaggtgatcgaggcacagtactttacactagaaaatcagcagagtggagntaggaggtagttggtttagggtttatacgtgacatcgacaacgtcttactacctaaccgttcgtacgccggttaccgtttccggacccgtacgggaacctaaaaggg

SEQ ID NO: 299163 - DNA, 522 bp, Homo sapiens
  misc_feature: GZ8MTXP02GDLO5.13.5.A05.1.454.CMB.2.raw
  modified_base (233)..(233): a, c, t, g, unknown or other
  misc_feature (233)..(233): n is a, c, g, or t
  modified_base (272)..(272): a, c, t, g, unknown or other
  misc_feature (272)..(272): n is a, c, g, or t
tcagtcacgtactacacgaccggtgctcgatttagatagatagacaggggctgggcctcaggaggcagcatcggaggtgcctcagccatggcatggatccctctcttcctcggcgtccttgcttactgcacaggatccgtggcctcctatgagctgactcagccaccctcagtgtccgtgtccccaggacagacagccagcatcactgctctggaaataatggcagataaatntacttcctggtatcagcagaagtcaggccagtcccctgngctggtcatctatcaagatgccaagccggccctagagggactccccccgtgacgcgacttctctgggcctaccaaactcgtaggggaacctcacgccctacgtctacgacccatcgacgccggggacccaggctagtgatgacggtctagtactattactgtaccgaggcgtgggacagcagcactcgcccgctatcgtcttacggacgttcgggaacctaaggtccacggtcctaacgtcacgaacccg

SEQ ID NO: 299164 - DNA, 574 bp, Homo sapiens
  misc_feature: GZ8MTXP02IBKRD.13.5.A05.1.454.CMB.2.raw
  modified_base (381)..(381): a, c, t, g, unknown or other
  misc_feature (381)..(381): n is a, c, g, or t
  modified_base (386)..(386): a, c, t, g, unknown or other
  misc_feature (386)..(386): n is a, c, g, or t
tcagtcacgtactacacgaccggtgctcgatttagatagatagacaggggacacaagctcagctgtaactgtgccttgactgatcaggactcctcagttcaccttctcacaatgaggctccctgctcagctcctggggctgctaatgctctgggtctccggatccagtgggaatattgtgatgactcagtctccactctacctgcccgtcacccctgggagacgcccggcctccatctcctgcaggtcccagtcagcgcctcctgcatagaatggatataacttatttggattggtatctgcagaggcagggcacgtccccacactcctgattctagttgggttctaagtcggccctcggggtaccctagagttcagtgcngtggntcgaggcactagtactttacactaagaaaactcaagtacgaggtaggagggaggtctagggaagggtagtttgggtttagggggtttaccttaagtgtacgtagttagaccgtaaagtccttacctaactaaccccgtgtcggtaccgtttaccgtttccggacccgttacggggaaaccctaaaggg

SEQ ID NO: 299165 - DNA, 784 bp, Homo sapiens
  misc_feature: GZ8MTXP02HJYUS.13.5.A05.1.454.CMB.2.raw
  modified_base (240)..(240): a, c, t, g, unknown or other
  misc_feature (240)..(240): n is a, c, g, or t
tcagtcacgtactacacgaccggtgctcgatttagatagatagacaggggacacaagctcagctgtaactgtgccttgactgatcaggactcctcagttcaccttctcacaatgaggctccctgctcagctcctggggctgctaatgctcgtgggtctccggatccagtgggaatattgtgatgactcagtcctccactctacctcgcccgtcaccccgtggagacgccggcctccatcncctgcaggtccagtcagacgcctcctgcataagaaatggaataataaacttagtttggatttggtattctgcgaggacggccgaggggccacggtacccccaacctaaccctccgtagtacttcgttaaggtttcggggtttacctaaacgggttcccgggggtccccggtttacccccgggggtaacccccttaaacggtacgggtttccgtaacgggtcggtaccgtagggtagggtacgttacgacggacctaacgtaacggttaaacttttaaccgtaaacgttaaaggtaaaacttacgaacggtaccgaaagggtaagggttacggggagggtaccggttagggaagggttaggtttagggggtttttagggggttttaacgtttaaccggttaggtaccgtaagtttacggaaacgtaacggtaccgttaacccgttaaacccttaaacccgttaaccggttcctaacccgggggggggttaccctttacccggggtacccccggttaaccggggtaaaccccggttaaaacggggg

SEQ ID NO: 299166 - DNA, 703 bp, Homo sapiens
  misc_feature: GZ8MTXP02GVVJM.13.5.A05.1.454.CMB.2.raw
  modified_base (217)..(217): a, c, t, g, unknown or other
  misc_feature (217)..(217): n is a, c, g, or t
  modified_base (333)..(333): a, c, t, g, unknown or other
  misc_feature (333)..(333): n is a, c, g, or t
tcagtcacgtactacacgaccggtgctcgatttagatagatagacaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagcctacatcacctgctctgganatgtattgactaacgagtatggttcctggtatcagcagaaggcaggccacgccccctgtcctactcatctttacaaaatccaggccggccctcgtcgggtccctgacgcgacttcncccgcctccgcctcgtcgggaactacacgttccaactctacgaccactacacgggccggggacccacggtaccctagttcgaagtggacggtcttacggtaccttacttcgttaggtcccgaagggggtcggttacgggggaacctaaacggacggtccggttcggccgttcggggttccggggaccgggggaaacgggggtacccgtaagggttcccgttacggggtaccccggtttacggtttaaccggggtaccctaaccgggacccccgtaaaaggggttcccccgtaacccggtacccccccggttccggggttaccctaacccgtttccccgttacccggtttacccccccgtttaaccccccg

SEQ ID NO: 299167 - DNA, 526 bp, Homo sapiens
  misc_feature: GZ8MTXP02F372P.13.5.A05.1.454.CMB.2.raw
  modified_base (355)..(355): a, c, t, g, unknown or other
  misc_feature (355)..(355): n is a, c, g, or t
tcagtcacgtactacacgaccggtgctcgatttagatagatagacaggggctgggcctcaggaggcagcatcggaggtgcctcagccatggcatggatccctctcttcctcggcgtccttgcttactgcacagaatccatggcctcctatgagttgactcagccaccctccatgtcccgtgtccccccggacagacagcctacatcacctgctctggagatgtatgactaacgagtatggttcctggtatcagcagaaggcaggccacgccccctgtccctactcatctttacaaaatccaggccgccctcgtggggtccctgagcgattcgccccggctccgctctggaacacngtcactctgaccatcacgccgggacccacgccctattgagtgagtctgtctacttctgtcaggcgtggacaacgagcgtgcgtggttcggcggagggaccagtcgtcgacccgttgttacggcacgtcccgaaggcctcgcccccgtcggtccacgtctcgttccctaccc

SEQ ID NO: 299168 - DNA, 699 bp, Homo sapiens
  misc_feature: GZ8MTXP02HA93C.13.5.A05.1.454.CMB.2.raw
  modified_base (193)..(193): a, c, t, g, unknown or other
  misc_feature (193)..(193): n is a, c, g, or t
tcagtcacgtactacacgaccggtgctcgatttagatagatagacaggggctgggcctcaggaggcagcatcggaggtgcctcagccatggcatggatccctctcttcctcggcgtccttgcttactgcacagaatccatggcctcctatgagttgactcagcccaccctccatcgtccgtcgtcccccgganagacacgcctacatccacctgctcgtggagatgttattgaacttaaacggagttagttcggttccttaggtatcgagcgaagaaaggcgacggcccaccgccccctgtccctactcacttacctttaacaaaactaccgacggtccggccccttcggtcggggttccctggacgcgtacttccgtcccccggcctcccgacctcgtacgggaaccacgcgtccacttccgacgaccctactccgaccggacccggggaacccctacggtacccttattacggagtacggacggtcttacgttaccgttacttcgtaggttaccggaggggtccggtaggggaacctaaacgacggtccgtcggtcggttcggggttaccggggacgggaacgggtacgaccgggtttcgtaccgggtaccgttcggttaacggaccaccgggaccccgtaaggtccccgtccggcccccttcggaccctccttcccgtcccgttcccccgtacccg

SEQ ID NO: 299169 - DNA, 553 bp, Homo sapiens
  misc_feature: GZ8MTXP02FOCVS.13.5.A05.1.454.CMB.2.raw
  modified_base (367)..(367): a, c, t, g, unknown or other
  misc_feature (367)..(367): n is a, c, g, or t
tcagtcacgtactacacgaccggtgctcgatttagatagatagacaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagcctacatcacctgctctggagatgtattgactaacgagtatggttcctggtatcagcagaaggcaggccacgccccctgtcctactcatctttacaaataccaggccgccctcgtcggggtccctgacgcgacttccgtccccggcctcccgcctcgtacgggaaccacgngtcactctcgacccatcgacgccgggacccacgcctatcgatgaggtctgtctacttctgtcgaggcgtgggacaacgagcgtgcgtggttcgggcggacgggccgaggtcgtcggaccgttcgttacggtcacgacccgaacggcctccgcccctcggtccaccgttcctccgtcccctaccccg

SEQ ID NO: 299170 - DNA, 558 bp, Homo sapiens
  misc_feature: GZ8MTXP02IE0SN.13.5.A05.1.454.CMB.2.raw
  modified_base (467)..(467): a, c, t, g, unknown or other
  misc_feature (467)..(467): n is a, c, g, or t
  modified_base (497)..(497): a, c, t, g, unknown or other
  misc_feature (497)..(497): n is a, c, g, or t
tcagtcacgtactacacgaccggtgctcgatttagatagatagacaggggacacaagctcagctgtaactgtgccttgactgatcaggactcctcagttcaccttctcacaatgaggctccctgctcagctccgtggggctgctaatgctctgggtctccggatccagtgggaatattgtgatgactcagtctccacttctacctgcccgtcacccgtggagacgccgcctcatctcctgcaggtccagtcagacgcctcctgacaataagaaatggaataataaacttagtttggatttggtatctgcaggacgcagggccacgtccccacaactcctgatcttagttcgggttctaacgtcgggcccgttccggggtacccctaagtcggttcagtcggctaaggtggaactcgaggacctaataagtaactttaacgataaagaaatcgagacgagagtggagngtaggaggtgttggttagggtttatagtgnttagcacactactactacacctaacgtcgtacgtacgttcgtaccggtacgtaacgaaagg

SEQ ID NO: 299171 - DNA, 840 bp, Homo sapiens
  misc_feature: GZ8MTXP02INVJJ.13.5.A05.1.454.CMB.2.raw
  modified_base (194)..(194): a, c, t, g, unknown or other
  misc_feature (194)..(194): n is a, c, g, or t
  modified_base (219)..(219): a, c, t, g, unknown or other
  misc_feature (219)..(219): n is a, c, g, or t
  modified_base (223)..(223): a, c, t, g, unknown or other
  misc_feature (223)..(223): n is a, c, g, or t
  modified_base (253)..(253): a, c, t, g, unknown or other
  misc_feature (253)..(253): n is a, c, g, or t
  modified_base (347)..(347): a, c, t, g, unknown or other
  misc_feature (347)..(347): n is a, c, g, or t
tcagtcacgtactacacgaccggtgctcgatttagatagatagacaggggctgggcctcaggaggcagcatcggaggtgcctcagccatggcatggatccctctcttcctcggcgtccttgcttactgcacagaatccatggcctcctatgagttgactcacgcccaccctcatcgtcccgtcgtcccccgganacgacacgcctacatcacctgctcngganatgtattgaactaacgtagttatggttccnggtatcagcagaggcacggccaccgtccccctgtcctactcactttacttaacaaaacgtcccgcggtcccgtcccgttcgggtccgggttccncggacgtcgtaccgttcccgtccccggtccctccccgtcgtcggtaacggaaacctcgtccgtacctaaccgttccgtaccgaaccccgttacgaccgggaacccgggggaacccccgtaacccggtaaccgttacccgtttaaaggttcggtaacgggtaacggggtacgttcccggtttaaccgtttcccgtttaccgttacggttccgggttaaccgggggtacgggtaccgggggtttaaacgggaaacctaacccgggttacgggtcgggttaccggttccggggtttaccgggggtacccggggtaaaccgggggccgggtaaaccgttaccgggtttaccggtacccgggtttaaccggttacccggtttaacggaccggttaccccgaaacccggtaaccggttccccgtcccccggttacccccgtaccgggttacccacccggttttcccccggtttaccccggttcccccctttacccccgg

SEQ ID NO: 299172 - DNA, 501 bp, Homo sapiens
  misc_feature: GZ8MTXP02I7DBX.13.5.A05.1.454.CMB.2.raw
  modified_base (287)..(287): a, c, t, g, unknown or other
  misc_feature (287)..(287): n is a, c, g, or t
  modified_base (301)..(301): a, c, t, g, unknown or other
  misc_feature (301)..(301): n is a, c, g, or t
  modified_base (322)..(322): a, c, t, g, unknown or other
  misc_feature (322)..(322): n is a, c, g, or t
  modified_base (384)..(384): a, c, t, g, unknown or other
  misc_feature (384)..(384): n is a, c, g, or t
  modified_base (446)..(446): a, c, t, g, unknown or other
  misc_feature (446)..(446): n is a, c, g, or t
tcagtcacgtactacacgaccggtgctcgatttagatagatagacaggggctgggcctcaggaggcagcatcggaggtgcctcagccatggcatggatccctctcttcctcggcgtccttgcttactgcacagaatccatggcctcctatgagttgactcagccaccctccatgtccgtgtccccagggcagacagccaccataacctgctctggatatttgttgagggatagatatgcttgtggtatcaacagaaggccgcagtcactacattggtatctatgaanacagagcggccctnagggactcctgagcgacttcnctggctccaactctaggggaacacgacgccactctcgaccactcacgcggacccagccctancgatgaggctagactattactgttcatacgatggaacagtatagttgatggactggttcggnggacgggaccaaacgtcgaccgtcaggtcacgccgtacggctcgccctggtaccc

SEQ ID NO: 299173 - DNA, 711 bp, Homo sapiens
  misc_feature: GZ8MTXP02G54DS.13.5.A05.1.454.CMB.2.raw
  modified_base (235)..(235): a, c, t, g, unknown or other
  misc_feature (235)..(235): n is a, c, g, or t
  modified_base (260)..(260): a, c, t, g, unknown or other
  misc_feature (260)..(260): n is a, c, g, or t
tcagtcacgtactacacgaccggtgctcgatttagatagatagacaggggacacaagctcagctgtaactgtgccttgactgatcaggactcctcagttcaccttctcacaatgaggctccctgctcagctcctggggctgctaatgctctgggtctccggatccagtgggaatattgtgatgactcagtctccactctacctcgcccgtcaccctggagagccggcctccatcncctgcaggtccagcagacgcctccngacaataagaagtagaataataaacttagttagtagttagtatcgtgacgaggacggccgaggacctaaccgtaccccaacctaacctccgtagtacttacgttaggtttacggggttacctaacgggtcccggggtccccggttaccccggggtaaccctaaacgtacggttacgaggtcggacgtaggtaggtacgtacgacggacctaaacgtaaacgtttaactttaaacgtaaacgtaaaagtaaaacgtaaacgaacgtaacgaaggtaagggtaggggtaacgggtacggtagggtaagggttaagggtttaggggttttaaggggttttaacgtttaacgtacgtacgtacgtacgtacgtaacgtaccgtacctaacctaacccgtaaccgtacggtaccggtaccggttaccggtacccggtaaccggtaaacggaaacgg

SEQ ID NO: 299174 - DNA, 694 bp, Homo sapiens
  misc_feature: GZ8MTXP02J1KES.13.5.A05.1.454.CMB.2.raw
tcagtcacgtactacacgaccggtgctcgatttagatagatagacaggggacacaagctcagctgtaactgtgccttgactgatcaggactcctcagttcaccttctcacaatgaggctccctgctcagctcctggggctgctaatgctctgggtctccggatccagtgggaatattgtgatgactcagtctccactctacctcgcccgtccaccccgtggagacgcccggcctccatcctcctgcaggtccagtcagacgcctcctgcataagaaatggaataataacttgtttaggattggtatctgcgaggacggccgagggcacgtaccccacacctcctagtacttcgttaggtttcggggttacctaacggttcccggggtcccgttacccgggggttacccctaacgttacggggttccggggtgggtaccgtaggtcgggtacgtcggaacgggccaacgtaagttaaacgtttttaaccaacgttaaagaaaacgttaccgaaggacgaagggtaagggtaggggtaacggtacgtaggggtaaggttaggtttggggtttaggggtttacttacgttgacgtagttacggacgttaaacgtccttaccgtaacctaacccgttcgtcggtacccgggttaccgttacccgggtaccgtacggggtaaaccgtaaaggtaacggg

SEQ ID NO: 299175 - DNA, 581 bp, Homo sapiens
  misc_feature: GZ8MTXP02IY2PG.13.5.A05.1.454.CMB.2.raw
tcagtcacgtactacacgaccggtgctcgatttagatagatagacaggggacacaagctcagctgtaactgtgccttgactgatcaggactcctcagttcaccttctcacaatgaggctccctgctcagctcctggggctgctaatgctctgggtctccggatccagtgggaatattgtgatgactcagtctccactctacctgccccgtcacccctggagacgccggcctccatctcctgcaggtccagtcagacgcctcctgcatagaatgatataacttatttggatttggtatctgcagaggccagggcacgtccccacaacctcctgacttcgttagttcggggttctaagttcccggggcccgtcccgggggttacccctaaagtcgggttcagtgacgtagtggatcgaggcacgtagtactttacactaagaaaactcaagcagagtaggagcgtggaggtagttggtttaggggttattacgtgtctaagtcgaacgtaacgtcctactaaccgtaaccgttcgtacggtacggttaccgtttaccggaccgttacgggaaccgtaaaacgg

SEQ ID NO: 299176 - DNA, 718 bp, Homo sapiens
  misc_feature: GZ8MTXP02HA0N7.13.5.A05.1.454.CMB.2.raw
  modified_base (190)..(190): a, c, t, g, unknown or other
  misc_feature (190)..(190): n is a, c, g, or t
  modified_base (217)..(217): a, c, t, g, unknown or other
  misc_feature (217)..(217): n is a, c, g, or t
  modified_base (232)..(232): a, c, t, g, unknown or other
  misc_feature (232)..(232): n is a, c, g, or t
tcagtcacgtactacacgaccggtgctcgatttagatagatagacaggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagcctacatcacctgctctgganatgtatgactaacgngtatggttctggtatcagcagagcacggccacgcccctgtcctactcacttctttaacaaaactccgacggcccgtcccttcggtcggggtcccctggacgtccgtacttccgcccccggcctacccgccgttacgtcgggaaacccacgacgtccaacttccgtacgaaccctagtaccgaccgggacccgggaaccccaggtcccttaagttacggagttaggacggtcttcgttaccttacgttcgtacggttaccgaggggtccggtaagggaacctaacggacgggtcgttcgggccgtttcgggggtaccggggacggggaaccggggtaccaacggtttccggtaccgggttaaccccttggggtttaaccggacccgtaaccggtacccccggaacggggttccccttccccgggtaccccccggttcggtaccccttacccggttccctttccccggttaaccccccttacccccgg

SEQ ID NO: 299177 - DNA, 583 bp, Homo sapiens
  misc_feature: GZ8MTXP02GHM2L.13.5.A05.1.454.CMB.2.raw
  modified_base (190)..(190): a, c, t, g, unknown or other
  misc_feature (190)..(190): n is a, c, g, or t
  modified_base (477)..(477): a, c, t, g, unknown or other
  misc_feature (477)..(477): n is a, c, g, or t
tcagtcacgtactacacgaccggtgctcgatttagatagatagacaggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagcctacatcacctgctctggatatgtattgactaagagtatggttcctggtatcagcagaaggcaggccacgccccctgtccctactcattctttaacaaaactacccaaggccggtacccctcgtcggggtccctggacgcgacttcctccccggcctcccgctcctcgggaacacgcgtcactctacgaccatacacggccgggacccacggccctagtgagttcgacggtcttgtcttacttctacggttcaggggtcgtggggaactaacgagccgtncggttggtcgggcggacgggacagtcgtcgtaccgtcgttaacggtcgacgtacccgaaggccgtaaccgcccccgtacggtcaccttcgtccgttcccgtacccc

SEQ ID NO: 299178 - DNA, 732 bp, Homo sapiens
  misc_feature: GZ8MTXP02FO715.13.5.A05.1.454.CMB.2.raw
  modified_base (189)..(189): a, c, t, g, unknown or other
  misc_feature (189)..(189): n is a, c, g, or t
  modified_base (216)..(216): a, c, t, g, unknown or other
  misc_feature (216)..(216): n is a, c, g, or t
  modified_base (231)..(231): a, c, t, g, unknown or other
  misc_feature (231)..(231): n is a, c, g, or t
  modified_base (356)..(356): a, c, t, g, unknown or other
  misc_feature (356)..(356): n is a, c, g, or t
tcagtcacgtactacacgaccggtgctcgatttagatagatagacaggggctgggcctcaggaggcagcatcggaggtgcctcagccatggcatggatccctctcttcctcggcgtccttgcttactgcacagaatccatggcctcctatgagttgactcagccacctccatgtccgtgtcccccgganagacagcctacatcacctgctctgganatgtattgactaagngtatggtctggtatcagcagaggcaggccacgccccctgtcctactcatctttacaaaatccaggccgccctcgtcggggtccctgacgcgtattcctcccggcctcccgctcgtgggaaccacncgtccactctacgaccctatccgaacggccgggacccacggtacccttagttcggaagttaggacgggtcttacggttaccttaaccgtttcgttacggttccgaacggggtccgggttaacgggggaaacccaaacgggacgggtcccggttacggtaccggtttcggggtttccgggggaccggggtaaacgggggtaccccgtaacggggttaccgttaccggggtaaacccgggtttaccggtttaaacgggggttcccaacccggggtaacccccgaaaaggggtcccccgttaacccgggaccccccccggtttacggggttcccctaacccgtttcccgttacccggtttaccccccctttaacccccg

SEQ ID NO: 299179 - DNA, 726 bp, Homo sapiens
  misc_feature: GZ8MTXP01DW8SW.44.31.C09.1.454.CMB.2.raw
tcagacagtatatacacgaccggtgctcgatttagacgtctcatcaaggaaggaagggcttgatgccttggggcacaagaggcagcactcaggacaatctccagcatggcctggtctcctctcctcctcactctcctcgctcactgcacagggtcctgggcccagtctgtgctgacgcagcccgccctcagtgtcgtcggggccccagggcagagggtcagcatctcctgctagttgggagcggcctccaacgaggcggggctagggttttgattgttacaaagtcggtaccagacaaacttccaaggaaccacgacccccaaatcgaccttactaactttacgaccttaaacacctacgtttccccggcccctcgacggggtcccctgaaaccccgtattccgtcacgggtcctacccgtaagtccgtcgggaccctacccgttcaccggtcccctcccgtcggaccctaacgttccacgttcggggccttacccgagggtccgtaggaacgggggtattggggaacggtccgttaggtaactttaacttaaccgttcggtaccctaaaggtaacccttagttcggaaacctaggttaacgttccgttaggtaagggttcggttccgggttttgggggttacgggtttccgggggtaccggggaacgggggtaaccccgtaaagggggttccggtaaccccggtttcccgggtttaaacccgggg

SEQ ID NO: 299180 - DNA, 594 bp, Homo sapiens
  misc_feature: GZ8MTXP01D3XGQ.44.31.C09.1.454.CMB.2.raw
tcagacagtatatacacgaccggtgctcgatttagacgtctcatcaaggaaggaagggcttgatgccttggggcacaagaggcagcactcaggacaatctccagcatggcctggtctcctctcctcctcactctcctcgctcactgcacagggtcctgggcccagtctgtgctgacgcagccgccctcagtgtcgtggggccccagggcagagggtcagcatctcctgcagttgggagcggctccaacgaggcggggctaggtttgatgttcaatggtacagcaacttccaggaaccacgacccccaaatcgcctcactttacgactaacaccacttccccggccctcgacggggtcccctgaacccgtattcctcgacggcctaccaagttctacggccaccctcgacgtccctcccgtggacccatccacgtcgggcctccgaggctggacggggatggagtctgtatttattacgtgcctagtacctagtcgaacgtgttagtcgttggtaggttgttcggtttggggttcggttaacggggacgggtaacggggtaaccgtagggttcggtaacccggttcgttaacggg

SEQ ID NO: 299181 - DNA, 660 bp, Homo sapiens
  misc_feature: GZ8MTXP01C4F4O.44.31.C09.1.454.CMB.2.raw
  modified_base (190)..(190): a, c, t, g, unknown or other
  misc_feature (190)..(190): n is a, c, g, or t
  modified_base (263)..(263): a, c, t, g, unknown or other
  misc_feature (263)..(263): n is a, c, g, or t
tcagacagtatatacacgaccggtgctcgatttagacgtctcatcaaggaaggaagggcttgatgccttggggcacaagaggcagcactcaggacaatctccagcatggcctggtctcctctcctcctcactctcctcgctcactgcacagggtcctgggcccagtctgtgctgacgcacgcccgccctnaggtgtccgtcgggggccccagggcaggagggtcagcatcctctgcagtgggacgcggctacacgaggcgggntaggtttgattgttacaagtcggtacagacaacttccgaaggaccaccgaccccaatgactacacgttacactaaccactcgtcccgcctacgcggtccctagaacccgtattccgtcgtcggactacgagtcgacggccctacctcgaccgtccccgtcccgcggtacccacgtaccgtacggtccgggcctaccgtacggaccgttaggaaggggtacgtaggggtaacggttattaactttaaaccgtcgtacgtaacccgtacgtaccgtacgacgtaccgtaacgcgttcggtacccttggttaacgggttgggttttacggggttcggttccggggaagggtaaaccgccggtacgtaccggttaccggtaaccccgttcgggtaacccgg

SEQ ID NO: 299182 - DNA, 732 bp, Homo sapiens
  misc_feature: GZ8MTXP01CAIT7.44.31.C09.1.454.CMB.2.raw
  modified_base (190)..(190): a, c, t, g, unknown or other
  misc_feature (190)..(190): n is a, c, g, or t
  modified_base (257)..(257): a, c, t, g, unknown or other
  misc_feature (257)..(257): n is a, c, g, or t
tcagacagtatatacacgaccggtgctcgatttagacgtctcatcaaggaaggaagggcttgatgccttggggcacaagaggcagcactcaggacaatcaccagcatggcctggtctcctctcctcctcactctcctcgctcactgcacgagggtcctgggcccagtctgtgctgacgcacgccgccctnagtgtcgtcggggccccgagggcaggagggtcagcatctcctgcagttgggacgcggctaccgaagnggcgggctaggtttgagtgttacaagtcggtaaccaactaccgttaccaacggaacacccgaaccccctaaacttccctactaactttcgtttaacggtaaacctaaacttacgtcccggtaccccgttacccggaaccggggtcctaggtaccctagttcccttcgtcggtcctacccgtaacggttccgcggtaccctaacccgtccgacccgtccccgtttccccgtcggtaccctaacgtcccgtaaccgggtttccgggaaccttcccggacggtccgttaagaacgttacggtgggggtaagggttagttaactttacgttaacgtccgtaccgtacgttacccttagtacgtaccgacgcgtaacgtccgttacggtaggtttggggttacggggttcggttccgggggacggttacggggaacgaacggtcgtccgggaccgttccggtaacgggttccgaaccggg

SEQ ID NO: 299183 - DNA, 737 bp, Homo sapiens
  misc_feature: GZ8MTXP01BOO5D.44.31.C09.1.454.CMB.2.raw
  modified_base (256)..(256): a, c, t, g, unknown or other
  misc_feature (256)..(256): n is a, c, g, or t
tcagacagtatatacacgaccggtgctcgatttagacgtctcatcaaggaaggaagggcttgatgccttggggcacaagaggcagcactcaggacaatctccagcatggcctggtctcctctcctcctcactctcctcgctcactgcacgagggtcctgggcccagtctgtgctgacgcagcccgccctcagtgtccgtcggggcccccagggcaggagggtcagcatctcctgcagttgggagcggctccaacgnggcgggctaggttttgagttgttacaagtcggtaccagacctaacttccgaaggaaccaccgacccccaaatcgacctactaactttaccgacctaaaccacctacgtttcccccggacccctacggtacccggggtcccctacggaaaccccgttacttcccgtacgaaccgggtcccttaacccgtaacgttcccgtacgggacccctacccgtccgtaaccggtcccctccccgtcggacccctaacgtccccgtacggttccggggcccttacccgaagggtccgttacgggaacggggtagtcgggtacgtaccgttaggttaactttacgttacgtacggtaccctaaggtacccttagacgtaactaaggttcgtcttagggtacgttgggttccgggttttggggttcgggttaacggggacggggtaacggtaccgggtacgggttaccggtaacccgttccggtaaccggg

SEQ ID NO: 299184 - DNA, 464 bp, Homo sapiens
  misc_feature: GZ8MTXP01A7DFE.44.31.C09.1.454.CMB.2.raw
  modified_base (424)..(424): a, c, t, g, unknown or other
  misc_feature (424)..(424): n is a, c, g, or t
  modified_base (436)..(436): a, c, t, g, unknown or other
  misc_feature (436)..(436): n is a, c, g, or t
  modified_base (455)..(464): a, c, t, g, unknown or other
  misc_feature (455)..(464): n is a, c, g, or t
tcagacagtatatacacgaccggtgctcgatttagacgtctcatcaaggaaggaaggggctcgagtgggtctcgacaattggcgctagtgcaactgacacatactacggagagtccgtgaagggccgcttcaccatctccagagacaattccggaaacacactttttctggaaatgaacagcctgagagtcgaagacacggccctttattctgtgcgaaggagggggggactggatccacaggtgggtgggtggttcaactccgtgggggccagggagcccctggtcaccgtcgccgcagcctccaccaaagggccccatccggtcttcccccctggccaccccgtcctcccaaagacgtccacctccgtgggggcacgaggccgcccccctggggctgccctggtacaaggctacgtcctatntactgtctgagnggctggcaaggcgcatagnnnnnnnnnn

SEQ ID NO: 299185 - DNA, 566 bp, Homo sapiens
  misc_feature: GZ8MTXP02G0KTC.44.31.C09.1.454.CMB.2.raw
  modified_base (392)..(392): a, c, t, g, unknown or other
  misc_feature (392)..(392): n is a, c, g, or t
tcagacagtatatacacgaccggtgctcgatttagacgtctcatcaaggaaggaagggcttgatgccttggggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcagcatctcctgcattggggagcggctccaacaggcggggcaggtttgatgttcaatggtaccagcaacttcaggaacacgaccccaaatgctcatttaccgactaacacctatccccggccctcgacggggtccctgaccgtattctcgaggcctaccaagtctcggcctaccctnaccgccctcccgtcggcccaatccacgttcgggcctccgaggtctggaggagtggagggtctagtaatttactactgaccagtaccctagtcgaacgtaggtagtcgtaggacgtgtcgtttggggtgttcggggcgggacgggaccgtaagggtcgtaacccggtcgtaacgg

SEQ ID NO: 299186 - DNA, 709 bp, Homo sapiens
  misc_feature: GZ8MTXP02HF6DL.44.31.C09.1.454.CMB.2.raw
  modified_base (237)..(237): a, c, t, g, unknown or other
  misc_feature (237)..(237): n is a, c, g, or t
tcagacagtatatacacgaccggtgctcgatttagacgtctcatcaaggaaggaagggcttgatgccttggggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcagcatctcctgcagttgggancggctccaacgaggcggggctaggtttgatgttcaatggtaccagcaacttcaggaacacgcccccaaatgactcatttacgctaacacctattccccggccctcgacggggtcccctagacccgtattccacgaacggccttaccgaaagttccgtacgggtaccctaacccgtcgaaccggtccccttacccgttcgggacccctaacgttcccgaaccggttccgggggtacccttacccggaacgggtccgttacgggaacgggtacgttacgggaacggtccgttacggtaacgtttaacgttaaccgtcggtacccgtaacggtacccttaagtacggtaaacgttacggttaacgttccgtagggtaacggttcggtaccggtttacggggttcggtttaaccggggacgggtaacggggtaacccgtaaaggggtccggtaacccggttaccggttaaccgggg

SEQ ID NO: 299187 - DNA, 561 bp, Homo sapiens
  misc_feature: GZ8MTXP02JLKJE.44.31.C09.1.454.CMB.2.raw
tcagacagtatatacacgaccggtgctcgatttagacgtctcatcaaggaaggaagggcttgatgccttggggcacaagaggcagcactcaggacaatctccagcatggcctggtctcctctcctcctcactctcctcgctcactgcacagggtcctgggcccagtctgtgctgacgcagccgccctcagtgtctggggccccagggcaggagggtcagcatctcctgcagttgggagcggctccaacaggcggggctaggtttgatgttacaagtggtaccagcaacttccaggaaccacgacccccaaatcgctcatttaccgctaacacctattccccggccctcgacggggtcccctgacccgtattcctcacggcctacccaagtcctcggaccacccgtcacgccctcccgtggcccactccacgtcgggcctcccgaggtcctggacggatcggaggtctagatttagtactgcctagtcctatcgacagcacgcctcgagttcgggttggtcggttcgggcggacggggaccaggcgttacggacccgttcgg

SEQ ID NO: 299188 - DNA, 515 bp, Homo sapiens
  misc_feature: GZ8MTXP02G488O.44.31.C09.1.454.CMB.2.raw
tcagacagtatatacacgaccggtgctcgatttagacgtctcatcaaggaaggaagggcttgatgccttggggcacaagaggcagcactcaggacaatctccagcatggcctggtctcctctcctcctcactctcctcgctcactgcacagggtcctgggcccagtctgtgctgacgcagccgccctcagtgtctgggccccagggcagaggtcagcatctcctgcagttgggagcggctccaacgaggcggggctagggtttgatgttcaatggtacagcaacttccaggaacacgaccccaaatgctcattacgctaacaccattcccgcctcgacgggtcctgaccgattctcagtctaccaagtctgccacctcacgccctcctgcccatccacgtcggactccgagctgagagtgaggctagattactactcgactagacctagcgacagtagtctagacgtgcgttgggtcgtcggacggacggacgtaaggtcgaccgtacgtaacgg

SEQ ID NO: 299189 - DNA, 706 bp, Homo sapiens
  misc_feature: GZ8MTXP02FSRBS.44.31.C09.1.454.CMB.2.raw
  modified_base (252)..(252): a, c, t, g, unknown or other
  misc_feature (252)..(252): n is a, c, g, or t
tcagacagtatatacacgaccggtgctcgatttagacgtctcatcaaggaaggaagggcttgatgccttggggcacaagaggcagcactcaggacaatctccagcatggcctggtctcctctcctcctcactctcctcgctcactgcacagggtcctgggcccagtctgtgctgacgcagccgcctcagtgtcgtcggggccccagggcaggaggtcagcatctcctgcagttgggagcggctaccgaacgnggtcggggctagggtttgatgttacaagtcggtaccagtacctaacgttccgaaggaaccaccgacccccaaaagtcgaccttactaacgtttaaccgacctaaacacctacgttccccggaccccttacggacggggtcccctaggaccccgtatttccgacgtacggtacctacccgtaagttccgacgggtaccctaacccgtcgtacccggtcccctccccgttcgggaccctaacgtcctacggttccggggcctacccggagggtccgttagggaacggtagtacgggtacggtcgttagttaactttaacgttaccgcgaccgtaacgtaacctagttacgaacgttagtcgtacgtgtacggttgttcggttcgggttcgggttaaccggggacggggtaaacggtacccggtaagggttaccgaacccggttacggtaaaccggg

SEQ ID NO: 299190 - DNA, 664 bp, Homo sapiens
  misc_feature: GZ8MTXP02JZ0PC.44.31.C09.1.454.CMB.2.raw
  modified_base (363)..(363): a, c, t, g, unknown or other
  misc_feature (363)..(363): n is a, c, g, or t
  modified_base (586)..(586): a, c, t, g, unknown or other
  misc_feature (586)..(586): n is a, c, g, or t
tcagacagtatatacacgaccggtgctcgatttagacgtctcatcaaggaaggaagggcttgatgccttggggcacaagaggcagcactcaggacaatctccagcatggcctggtctcctctcctcctcactctcctcgctcactgcacagggtcctgggcccagtctgtgctgacgcagccgcctcagtgtcgtcggggccccagggcaggaggtcagcatctcctgctagttggggagccggctcccaacgaggcggggctagggttttgagttgttacaagttggtacccaggtacctaaacgttccgaacggtaaccaccgaccccccaaaagtccgctactaacttacgacctaaacncctacttccccggccctcgtacgggtcccctgacccgtattccgtccgggcttacccgagtctcggcctaacctcgaaccgtccctcccgtacggccctactccgaccggtcgggtaccctccggacggtccgttagggaagggtacgtacgggacggtccttagggttaacttttaactaccgtcggaccgtacgtaccgtatacgacgtacggtacgtcgnggtagtgttaccggttggggttcggttcgggaacggggtaacggacgtagggtccgtaccggtacggtacgtacccgg

SEQ ID NO: 299191 - DNA, 508 bp, Homo sapiens
  misc_feature: GZ8MTXP01E2ZSX.45.75.G09.1.454.CMB.2.raw
tcagacgcgatcgacacgaccggtgctcgatttagtatagacatcagggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgtttttaagatgtctcctggtatcagcaacacccaggcaaagccccaaactcatcatttatgatgtcaataatcggccctcaggggtttctcatcgcttctcctggctccaagtctggcaatacggcctccctgaccatctctgggctccaggctgaagacgaggctgattatactgcaggcacatatattagtgtttccatcgggtattcggcggagggaacaagttgaccgttctaggtcagcccaaggctgcccctggtcactcttcgtcccc

SEQ ID NO: 299192 - DNA, 511 bp, Homo sapiens
  misc_feature: GZ8MTXP01ELKCK.45.75.G09.1.454.CMB.2.raw
  modified_base (418)..(418): a, c, t, g, unknown or other
  misc_feature (418)..(418): n is a, c, g, or t
  modified_base (451)..(451): a, c, t, g, unknown or other
  misc_feature (451)..(451): n is a, c, g, or t
  modified_base (464)..(464): a, c, t, g, unknown or other
  misc_feature (464)..(464): n is a, c, g, or t
tcagacgcgatcgacacgaccggtgctcgatttagtatagacatcaggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgtttttaagatgtctcctggtatcagcaacacccaggcaaagcccccaaactcatcatttatgatgtcaataatcggccctcaggggtttctcatcgcttctcctggctccaagtctggcaatacggcctccctgaccatctctgggctccaggctgaagacgaggctgattatactgcaggcanatatattagtgtttccatcgggtattcggcggngggaaccaagttnacgttctaggtcagcccaaggctgcccctggtcactcttcgttcccc

SEQ ID NO: 299193 - DNA, 519 bp, Homo sapiens
  misc_feature: GZ8MTXP01EVKVQ.45.75.G09.1.454.CMB.2.raw
  modified_base (326)..(326): a, c, t, g, unknown or other
  misc_feature (326)..(326): n is a, c, g, or t
tcagacgcgatcgacacgaccggtgctcgatttagtatagacatcaggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgtttttaagtatgtctcctggtatcagcaacacccaggcaaagcccccaaactcatcatttatgatgtcaataatcggccctcaggggtttcncatcgcttctcctggctccagtctggcaatacgcctccctgaccatctctgggctccaggctgaagacgaggctgattatactgcaggcacatatattagtgttttccacttcgggtattcgggcggaagggaaccaagtttgaccgttcgtaggtcagttccaaggctgcccctggtcactcttcgttcccc

SEQ ID NO: 299194 - DNA, 536 bp, Homo sapiens
  misc_feature: GZ8MTXP01BN3U4.45.75.G09.1.454.CMB.2.raw
tcagacgcgatcgacacgaccggtgctcgatttagtatagacatcaggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgtttttaagtatgtctctggtatcagcaacacccaggcaaagccccaaactcatcatttatgatgtcaataatcggcctcaggggtttctcatcgcttctcctggctccaagtctggcaatacggcctccctgaccatctctgggctccgagctgaagacgaggctgattatactgcaggcacatatattagtcgtttccaacgttcgggtaatttcgggcgggaagggaaccctaaaggttcgaaccgttccgtagggtcacggttcccaagggctcgcccctcggtcactcttcgttcccc

SEQ ID NO: 299195 - DNA, 529 bp, Homo sapiens
  misc_feature: GZ8MTXP01EYDT3.45.75.G09.1.454.CMB.2.raw
  modified_base (297)..(297): a, c, t, g, unknown or other
  misc_feature (297)..(297): n is a, c, g, or t
tcagacgcgatcgacacgaccggtgctcgatttagtatagacatcagggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgtttttaagtatgtctcctggtatcagcaacacccaggcaaagcccccaaactcatcatttangatgtcaataatcggccctctagggggtttctcgatcgcttctcctggctcaagtctggcaatacggcctccctgaccatctctggctcagctgaagacgaggctgattatactgcaggcacatatattagtgtttcacgttcggtattcgggcggagggaacccaagtttcggaaccgttcgtaggtcacgcccaagggctcgccccctggtccacgtccgttcgttcccc

SEQ ID NO: 299196 - DNA, 536 bp, Homo sapiens
  misc_feature: GZ8MTXP01A5YG5.45.75.G09.1.454.CMB.2.raw
tcagacgcgatcgacacgaccggtgctcgatttagtatagacatcaggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgtttttaagtatgtctcctggtatcagcaacacccaggcaaagcccccaaactcatcatttatgatgtcaataatcggccctcaggggtttctcatcgcttctctggctcagtctggcaatacggcctccctgaccatctctggctccaggctgaagacgaggctgattattactgcaggcactatatattagtgtttccacgttcgggtaattcgggcggaggggaacctaaggttcgaaccgttcgtagggtcacgttcccaaggcctcgcccccgtcggtcaccttcgttcgttcccccg

SEQ ID NO: 299197 - DNA, 519 bp, Homo sapiens
  misc_feature: GZ8MTXP01EJFY4.45.75.G09.1.454.CMB.2.raw
  modified_base (293)..(293): a, c, t, g, unknown or other
  misc_feature (293)..(293): n is a, c, g, or t
  modified_base (323)..(323): a, c, t, g, unknown or other
  misc_feature (323)..(323): n is a, c, g, or t
tcagacgcgatcgacacgaccggtgctcgatttagtatagacatcagggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgttttaagatgtctcctggtatcagcaacaccaggcaaacgccccaaatcatcatttangatgtcaataatcggcctcgaggggtttcncatcgcttctcctggctcaagtctggcaagtacggccctccctgaccatctctgggctcaggctgaagtacgaggctgattatactgcaggcaactatattacttagtcgtttccaagttcgggtattcgggcggaggaacaagttgaccgttcgtaggtcagccaaggctcgcccctggcactcgttcgttcccc

SEQ ID NO: 299198 - DNA, 537 bp, Homo sapiens
  misc_feature: GZ8MTXP01DMWVB.45.75.G09.1.454.CMB.2.raw
  modified_base (227)..(227): a, c, t, g, unknown or other
  misc_feature (227)..(227): n is a, c, g, or t
  modified_base (245)..(245): a, c, t, g, unknown or other
  misc_feature (245)..(245): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtnacgttactgtttttaagntgtctctggtatcagcaacacccaggcaaagccccaaaactcatcatttatgatgtcaaataatcggccctcaggggtttctcatcgcttctcctggctccaagtctggcaatacgcctccctgaccatctctggctccaggctagaagacgaggctgattatactgcaggcacatatattagtgttctactcggtagttcggcggagggaacgaacgttagtaccgttccgtacggtcgacgcccgacggaacgtcgtccccgtcccggtccacctccttcgtttcccccg

SEQ ID NO: 299199 - DNA, 628 bp, Homo sapiens
  misc_feature: GZ8MTXP01AL5FR.45.75.G09.1.454.CMB.2.raw
  modified_base (297)..(297): a, c, t, g, unknown or other
  misc_feature (297)..(297): n is a, c, g, or t
tcagacgcgatcgacacgaccggtgctcgatttagtatagacatcagggggctctgggagaggagcccagcactgggattccgaggtgtttccattcagtgatctgcactgaacacagaggactcgccatggagtttgggctgagcgtggtttcctgttgctatttaaaggtgtcagtctgaggagcagctggtggagtcgtgggggaggcttggtccgaggccgggggggtccctcagactctcgtgtgcagcctctggattcaccgtcagtggcagcttcctgagctgggtcccnccgaggcctccgagggggaacgggcctggagtggggtctcgtagttaattttagactaggcacgagcgtactaacgcaagacttccgggttaaagggccgtaattcaccctatcctaccaagacgaactaaattccgaaagggaactacgggtttcttacttaagaaatacgaaccaccggtaggaaccggaacccggacggaccgacggtctacttaatacttacgtgtacgacggaagaacgacgtacccgaaacccgaacggaaccggaagttaaacttactaactaacgtaacgtacggtagttacggtaaccgttcggtaacgggg

SEQ ID NO: 299200 - DNA, 531 bp, Homo sapiens
  misc_feature: GZ8MTXP01BXNSO.45.75.G09.1.454.CMB.2.raw
  modified_base (243)..(243): a, c, t, g, unknown or other
  misc_feature (243)..(243): n is a, c, g, or t
  modified_base (416)..(416): a, c, t, g, unknown or other
  misc_feature (416)..(416): n is a, c, g, or t
tcagacgcgatcgacacgaccggtgctcgatttagtatagacatcagggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgtttttaantgtctcctggtatcagcaacaccccaggcaaacgcccccaaactcatcatttatgatgtcaataatcggccctcaggggtttctcatcgcttctcctggctccaagtctaggcaatacggccctcctgaccatctctgggtctccgaggctgaagacgaggctgattattacngcaggcacatatattgtgtttccacgttcgggtattcggcggaggaacctaagttcgaccgttcgtacggtcacgcccaaggctcgccccgtcggtcacgttccgttcgttcccc

SEQ ID NO: 299201 - DNA, 522 bp, Homo sapiens
  misc_feature: GZ8MTXP01CINU8.45.75.G09.1.454.CMB.2.raw
  modified_base (244)..(244): a, c, t, g, unknown or other
  misc_feature (244)..(244): n is a, c, g, or t
  modified_base (418)..(418): a, c, t, g, unknown or other
  misc_feature (418)..(418): n is a, c, g, or t
tcagacgcgatcgacacgaccggtgctcgatttagtatagacatcagggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgtttttaagntgtctcctggtatcagcaacaccaggcaaacgcccccaaatcatcatttatgatgtcaataatcggccctcgtaggggtttctcatcgcttctcctggctccagtctaggcaatacggcctccctgaccatctctggctccaggctgaagacgagctgattatactgcaggcanatatattagtgtttccaacgttcgggtattcggcggagggaacctaagttcgaccgttcgtaaggtcacgcccaggctcgcccctcggcactcgttcgttcccc

SEQ ID NO: 299202 - DNA, 515 bp, Homo sapiens
  misc_feature: GZ8MTXP01C5856.45.75.G09.1.454.CMB.2.raw
  modified_base (223)..(223): a, c, t, g, unknown or other
  misc_feature (223)..(223): n is a, c, g, or t
  modified_base (241)..(241): a, c, t, g, unknown or other
  misc_feature (241)..(241): n is a, c, g, or t
  modified_base (310)..(310): a, c, t, g, unknown or other
  misc_feature (310)..(310): n is a, c, g, or t
tcagacgcgatcgacacgaccggtgctcgatttagtatagacatcagggggtctcaggaggcagcgctctcgggacgtctccaccatggcctgggctctgctattcctcaccctcctcactcagggcacagggtcctgggcccagtctgccctgactcagcctgcctcctgtctgggtctcctggacagtcgatcaccatcccctgcactggatccagcggtnacgttactgtttttaagntgtctctggtatcagcaacacccaggcaaagccccaaactcatcatttatgatgtcaataatcggcctntaggggtttctcatcgcttctcctggctcaagtctagcaatacggcctcctcgacatctctggctccaggctgaagacgagctgattatactgcaggcacatatattagtcgtttccaagtcggtattcggcggaggaaccaagttcgaaccgttcgtaagggtcagttcccaaggtctcgcccctggtcactcgttcgtccccg

SEQ ID NO: 299203 - DNA, 531 bp, Homo sapiens
  misc_feature: GZ8MTXP01ECZ9K.45.75.G09.1.454.CMB.2.raw
  modified_base (246)..(246): a, c, t, g, unknown or other
  misc_feature (246)..(246): n is a, c, g, or t
  modified_base (299)..(299): a, c, t, g, unknown or other
  misc_feature (299)..(299): n is a, c, g, or t
  modified_base (437)..(437): a, c, t, g, unknown or other
  misc_feature (437)..(437): n is a, c, g, or t
  modified_base (515)..(515): a, c, t, g, unknown or other
  misc_feature (515)..(515): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgtttactgtttttaagntgtctctggtatcagcaacacccaggcaaacgcccccaaaactcatcatttangatgtcaaataatcggccctctaggggtttctcatcgcttctcctggctccaagtctggcaagtacggccctccctgacctatctctgggctccaggctgaagacgagctgattatactgcaggcacatatattagtntttcacgttcggtattcggcggtaggaacctaagttcgaccgttcgtaggtcacgcccaaggcctcgcccctggtacncgttccttcgttcccc

SEQ ID NO: 299204 - DNA, 521 bp, Homo sapiens
  misc_feature: GZ8MTXP01B1JYL.45.75.G09.1.454.CMB.2.raw
  modified_base (354)..(354): a, c, t, g, unknown or other
  misc_feature (354)..(354): n is a, c, g, or t
  modified_base (411)..(411): a, c, t, g, unknown or other
  misc_feature (411)..(411): n is a, c, g, or t
  modified_base (415)..(415): a, c, t, g, unknown or other
  misc_feature (415)..(415): n is a, c, g, or t
tcagacgcgatcgacacgaccggtgctcgatttagtatagacatcagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgatgttgggattataaccttgtctcctggtaccaacagcaccaggcaaagccccaaatcatgatttatgaggcagtaagcggcctcgaggggtttctaatcgcttctctcggctcaagtctggacaacncggcctcctgacatctctgggctcaggctgaggacgaggctgattatactgctgctnatangcaggtagtagttacgtttggtgtttcgggcgggtagggaaccaaggcgtgaccgtcgtaaggttcacgcccgaaggcctcgcccctggttccaacgttcttcccg

SEQ ID NO: 299205 - DNA, 532 bp, Homo sapiens
  misc_feature: GZ8MTXP01EJGV1.45.75.G09.1.454.CMB.2.raw
tcagacgcgatcgacacgaccggtgctcgatttagtatagacatcagggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgtttttaagtattgtctcctggtatcagcaacacccaggcaaacgcccccaaactcatcatttatgatgtcaataatcggccctctaggggtttctcatcgcttctcctggctccaagtctaggcaatacggcctccctgaccatctctggctccagctgaagacgaggctgattatactgcaggcacatatattagtcgtttccacgttcgggtattcggcggaggaactaagttgaccgttcgtagggtcacggcccaaggcctcgcccctcggtccttactcgttcgttcccccg

SEQ ID NO: 299206 - DNA, 533 bp, Homo sapiens
  misc_feature: GZ8MTXP01A6AVQ.45.75.G09.1.454.CMB.2.raw
  modified_base (245)..(245): a, c, t, g, unknown or other
  misc_feature (245)..(245): n is a, c, g, or t
  modified_base (457)..(457): a, c, t, g, unknown or other
  misc_feature (457)..(457): n is a, c, g, or t
  modified_base (514)..(514): a, c, t, g, unknown or other
  misc_feature (514)..(514): n is a, c, g, or t
tcagacgcgatcgacacgaccggtgctcgatttagtatagacatcagggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttacttgtttttaagntgtctcctggtatcagcaacacccaggcaaacgcccccaaactcatcatttatgatgtcaaataatcggccctcaggggtttctcatcgcttctcctggctccaagtctggcaataccggcctccctgaccatctctgggctccaggctggaagtacgaggctgattatactgcaggcactatatattagtcgttcagtcggtatcggcggnggaaccagttcgaccgttcgtacggtcacgccttaacggcctcgccccgtcggtccncctcgttccgtttcccccg

SEQ ID NO: 299207 - DNA, 558 bp, Homo sapiens
  misc_feature: GZ8MTXP01ELTC0.45.75.G09.1.454.CMB.2.raw
  modified_base (424)..(424): a, c, t, g, unknown or other
  misc_feature (424)..(424): n is a, c, g, or t
  modified_base (536)..(536): a, c, t, g, unknown or other
  misc_feature (536)..(536): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatggcctgcactggaaccaacagtgatgttgggagtttttagtttgtctcctggtaccaacaacacccggcgaacgccccaaactaatcattataggacactaagcggcctcgggggtttcaagtcgcttctctggctccaagtctggcaaccacggctccctgacaaatctctgggctccaggctcgagggacaggctgatttattctgttgcttcattangcagggacaggtctacgttggggtgttcgggcggagggaccaaggctacggacccgttcctaggtcaacgcccgaaaggctccgccccttcggttaccttccttcgtccccncctcctcttcgtaacttcgtcg

SEQ ID NO: 299208 - DNA, 535 bp, Homo sapiens
  misc_feature: GZ8MTXP01DFFK7.45.75.G09.1.454.CMB.2.raw
  modified_base (504)..(504): a, c, t, g, unknown or other
  misc_feature (504)..(504): n is a, c, g, or t
  modified_base (528)..(535): a, c, t, g, unknown or other
  misc_feature (528)..(535): n is a, c, g, or t
tcagacgcgatcgacacgaccggtgctcgatttagtatagacatcaggggtccctcagactctcgtgtgcagcctctggattcaccgtcagtggcagcttcctgagctgggtccgccaggctccagggaagggcctggagtgggtctcagttaatttttagtacaggcacagcgtactacgcagattccgttaaggccgattcaccatctccagagacaattccaggaacacggtgtttctgaaatgaacaccctgagacccgaggacacggctctatattactgtgcgagagatcgaaacccagaccccgaagaaacttcaacaactactacggtatggacgtctggggccaagggaccccaccgtcaccgtctcctcagccctccaccaagggccccatcggtctcccctcgcaccctcctccaagacgcacctcgtcggggcacgacgccgcccgtgggggctgccgtggtcaaggcctacgttcctcgactcgcgtctgngcgggtcttggcgaaggcgcatgnnnnnnnn

SEQ ID NO: 299209 - DNA, 517 bp, Homo sapiens
  misc_feature: GZ8MTXP01AXSD5.45.75.G09.1.454.CMB.2.raw
  modified_base (293)..(293): a, c, t, g, unknown or other
  misc_feature (293)..(293): n is a, c, g, or t
tcagacgcgatcgacacgaccggtgctcgatttagtatagacatcaggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgtttttaagatgtctcctggtatcagcaacacccaggcaaagccccaaatcatcatttangatgtcaataatcggcctcagggggtttctcatcgcttctcctggctccaagtctggcaatacggcctccctgaccatctctgggctccgaggctgaagacgagctgattatactgcaggcacatatattagtgtttccagttcgggtattcgggcggtagggaaccaaggttcgaccgttcgtaggtcacgccaaggctcgccctcggtcactcttcgtcccc

SEQ ID NO: 299210 - DNA, 583 bp, Homo sapiens
  misc_feature: GZ8MTXP01DYXEL.45.75.G09.1.454.CMB.2.raw
  modified_base (262)..(262): a, c, t, g, unknown or other
  misc_feature (262)..(262): n is a, c, g, or t
  modified_base (286)..(286): a, c, t, g, unknown or other
  misc_feature (286)..(286): n is a, c, g, or t
  modified_base (476)..(476): a, c, t, g, unknown or other
  misc_feature (476)..(476): n is a, c, g, or t
  modified_base (530)..(530): a, c, t, g, unknown or other
  misc_feature (530)..(530): n is a, c, g, or t
tcagacgcgatcgacacgaccggtgctcgatttagtatagacatcaggggagctctgggagaggagcccagcactgggattccgaggtgtttccattcagtgatctgcactgaacacagaggactcgccatggagtttgggctgagctgggttttccttgttgctattttaaaaggtgtccagtctgaggagcagctggtggagtctgggggaggcttggtccgaggccggggggtccctcagactctcgtgtgcagcctcnggatcacgtcagtggcagcttccngagcgtggtccgccaggcctccgagggacggcctgggagtgggtctctagttattttagacaggcagagcgtaactacgcagtacttacccggttaaagggcccatttccacctatctaccagacactaacttaccgaggaacctacggtgttacttagaaatcgaacacccgtgaaccgacccgagacncgctactatattactgtgcgagagacgttacgaaacccgacgaaaccccggaanaaaaccttctaaaaccaacttaaccgtacggttagtcgggttaacgtccgggg

SEQ ID NO: 299211 - DNA, 577 bp, Homo sapiens
  misc_feature: GZ8MTXP01A20KG.45.75.G09.1.454.CMB.2.raw
  modified_base (375)..(375): a, c, t, g, unknown or other
  misc_feature (375)..(375): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctcctgtctgggtctcctggacagtcgatcaccatcccctgcactggatccagcggtgtacgttacttgtttttaagtatgtctctggtatcagcaacacccaggcaaacgcccccaaactcatctatttatgatgtacaataatcggccctcgagggggtttctcgtatcgcttctcctggctcaagtctaggcaatcgcctcccngaccatctctcggctcagctagagacgagctgattatactgcagcaactatattattagtgtttccacgttcggtacgtcgggacggtagggtaaccctaaggttcggtaacccggttccgtaacgggtccgacggcccgaaacgggtccctcccggtcccccgttcgggtcccttaccgttccgttccggtttcccccccg

SEQ ID NO: 299212 - DNA, 794 bp, Homo sapiens
  misc_feature: GZ8MTXP01BLBEG.45.75.G09.1.454.CMB.2.raw
tcagacgcgatcgacacgaccggtgctcgatttagtatagacatcagggggggagaggagcccagcacgtgggattccgaggttgtttccattcagtgatctgcactgaacacagaggactcgccatggagtttgggctgagtctgggttttccttgttgcttaattttaaaggtgtccagtctgaggagcagctggtggaggtcgtgggggaggcttgggtccgagggccggggggtccctcgagactctcgtgtgcagtcctctggtacttcaaccgtcaggtggcagtcttccgtggacgcgtggggtccccgccgaggggccgtccggaagggggaacgggtccgttgggaggtgggttactaacgtaagtttaatttttacgacgaggtcaacgacggaccgtaacgtaaccgactaaggtaacgtttacccgggttaaggggtcccgtaaatttcccgaaccctaagtttccaccgtaacgaacgtactaaacttaccgaaagggtaaaccgtacggttacggttttaccgttaaggtaaacgtacggaaacctaccccggttaaggacccggtaaccccggggtaagggtaaccgaaccgggtactacgttaacgtactttaccgtaggtacggcggtaacggacgaactaaccggtaaaccgttaacggtaaaccccgggttaaagtaaaaccgtttaccttaaaccgttaaactttaaaccggtaacggttaacgtcgggtaaccggtcgggttacgggggtaacccgaaaccgggtaaccccgg

SEQ ID NO: 299213 - DNA, 523 bp, Homo sapiens
  misc_feature: GZ8MTXP01BQFFF.45.75.G09.1.454.CMB.2.raw
tcagacgcgatcgacacgaccggtgctcgatttagtatagacatcaggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgtttttaagatgtctcctggtatcagcaacacccaggcaaagcccccaaactcatcatttatgatgtcaataatcggccctcaggggtttctcatcgcttctcctggctcagtctggcaatacgcctccctgaccatctctgggctccgagctgagacgagctgattatactgcaggcacattatattagtgtttccactcgggtattcggcggagggaaccaagttcggaccgttcgtacggtcacgcccaaggcctcggcccctcggtccaccgtccttcgttccccc

SEQ ID NO: 299214 - DNA, 527 bp, Homo sapiens
  misc_feature: GZ8MTXP01D7EB3.45.75.G09.1.454.CMB.2.raw
  modified_base (462)..(462): a, c, t, g, unknown or other
  misc_feature (462)..(462): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgtttttaagtatgtctctggtatcagcaacacccaggacaaacgcccccaaactcatcatttatgatgtcaaataatcggccctcgtagggggtttctctatcgtcttctcctggctccaagtctaggcaatccggcctccctgaccatctctggctccgaggctgaagacgaggctagattatactgcaggcacatatattagtgtttccagtcggtatcggcggnggaacctaagttcgaccgttcgtaggtcacgccaaggctcgccccgtggtcactccttcgtcccc

SEQ ID NO: 299215 - DNA, 666 bp, Homo sapiens
  misc_feature: GZ8MTXP01EGRNE.45.75.G09.1.454.CMB.2.raw
  modified_base (369)..(369): a, c, t, g, unknown or other
  misc_feature (369)..(369): n is a, c, g, or t
tcagacgcgatcgacacgaccggtgctcgatttagtatagacatcagggggggagaggagcccagcactgggattccgaggtgtttccattcagtgatctgcactgaacacagaggactcgccatggagtttgggctgagctgggttttccttgttgctattttaaaaggtgtccagtctgaggagcagctggtggagtcgtgggggaggcttgggtccgaggccgggggggtccctcgagactctcgtgtgcagcctctggattcaccgtcagtgcagcttcctgagcgtgggtcccgccgaggcctccgaggggacggccgtggagtgggtctcgtaagttaatttttagacaggcacacgcgtacncgcagtaacttccggtaaggccgtattccacctactctaccagacgaactaattcccgaaggtaacctacgggtttagtttaccttagaaaacttcggaaaaccctacccgtagaaccggaccccgggaaggacccgtaacgggtctaccgtaattaacttaccgtggtgccgtaagacgactaacccggaaaccccagggaaaccccgttaaagtaaacttaccaaacgaaccttaaccgtaacggtacgtcggtaaccggtcgttacgggggaacccttaaacgggggtaacccc

SEQ ID NO: 299216 - DNA, 613 bp, Homo sapiens
  misc_feature: GZ8MTXP01EX9WW.45.75.G09.1.454.CMB.2.raw
tcagacgcgatcgacacgaccggtgctcgatttagtatagacatcaggggggggtctcaggaggcagcgctctcgggacgtctccaccatggcctgggctctgctattcctcaccctcctcactcagggcacgagggtcctgggcccagtctgccctgactcagcctgcctccctgtctgggtctcctggacagtcgatcaccatcccctgcactggatccagcggtgtacgttacttgtttttaagtatgtctcctggtatcagcaacaccaggacaaacgaccccaaactcatctatttatgatgtacaataatcgcctcgtagggtttctctatcgtcttctctcggctccaagtctacgacaactaccggccctccctcgacctatctcgtcggctccgaggctaggaacgacggaacggtctagtattacttacgtgacaggtcaactaatattaagtttacgttcgtttacccgtacgttcgggttagttcggggcgggtaagggaaccgtaaggttcggtacccgttccggtacggtaccacggcccaaacgggtcctacccggtccccgttacgggtccttaccgtccgttcccgttaacccccc

SEQ ID NO: 299217 - DNA, 516 bp, Homo sapiens
  misc_feature: GZ8MTXP01DNAX3.45.75.G09.1.454.CMB.2.raw
tcagacgcgatcgacacgaccggtgctcgatttagtatagacatcagggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgtttttaagatgtctcctggtatcagcaacacccaggcaaagcccccaaactcatcatttatgatgtcaataatcggccctcaggggtttctcatcgcttctcctggctcaagtctaggcaatacggcctccctgaccatctctgggctccaggctgaagacgaggctgattatactgcaggcacatatattagtgtttcacgtcgggtattcggcggagggaaccaagtttcgaccgttcgtaggtcagccaggctcgcccctggccactcttcgttcccc

SEQ ID NO: 299218 - DNA, 542 bp, Homo sapiens
  misc_feature: GZ8MTXP01APS5C.45.75.G09.1.454.CMB.2.raw
  modified_base (244)..(244): a, c, t, g, unknown or other
  misc_feature (244)..(244): n is a, c, g, or t
  modified_base (326)..(326): a, c, t, g, unknown or other
  misc_feature (326)..(326): n is a, c, g, or t
tcagacgcgatcgacacgaccggtgctcgatttagtatagacatcagggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgtttttaagntgtctcctggtatcagcaacacccaggcaaacgccccaaatcatcatttatgatgtacaataatcggccctcaggggtttcncatcgcttctctggctccaagtctaggcaataccggccctccctgaccatctctcggctccgaggctagaagacgagctgattatactgcaggcactatattattagtgtttccacgttcgggtagttcgggcggagggaacgtaagttcgtaccgttccgtacggtcttacgcctttaacggctcgccccgtcggtcttacctcgttcgttcccc

SEQ ID NO: 299219 - DNA, 540 bp, Homo sapiens
  misc_feature: GZ8MTXP01AC60G.45.75.G09.1.454.CMB.2.raw
  modified_base (297)..(297): a, c, t, g, unknown or other
  misc_feature (297)..(297): n is a, c, g, or t
  modified_base (328)..(328): a, c, t, g, unknown or other
  misc_feature (328)..(328): n is a, c, g, or t
  modified_base (360)..(360): a, c, t, g, unknown or other
  misc_feature (360)..(360): n is a, c, g, or t
  modified_base (405)..(405): a, c, t, g, unknown or other
  misc_feature (405)..(405): n is a, c, g, or t
  modified_base (420)..(420): a, c, t, g, unknown or other
  misc_feature (420)..(420): n is a, c, g, or t
  modified_base (512)..(512): a, c, t, g, unknown or other
  misc_feature (512)..(512): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgtttttaagtatgtctcctggtatcagcaacacccaggcaaacgccccaaatcatcatttangatgtcagtaatcggccctgtaggggtttcngatcgcttctcctggctcaagtctaggcaacncggccctccctcgaccatctcgtgggctccgaggctggaggacgnggctgtattattacngtacacggtctacattacgtgaccacgcagctatcgacttgtaagtcgttcgggacggacgggaccaagcgttcgacccgtcgtacggtccncgacccgacggtccgttccggtcccccg

SEQ ID NO: 299220 - DNA, 551 bp, Homo sapiens
  misc_feature: GZ8MTXP01A32QL.45.75.G09.1.454.CMB.2.raw
  modified_base (245)..(245): a, c, t, g, unknown or other
  misc_feature (245)..(245): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgtttttaagntgtctctggtatcagcaacacccaggacaaacgcccccaaatcatcatttatgatgtacaataatccggtccctcgtagggggtttctcactcgtcttctcctggctccaagtctagggactaacgtaccggccctccctcgacctactctccgtgggcctccgaggctagaacgacgagctagtattatctgcacgcactatatattagttgttacacgttcggtagtcgggcgagggaactaggttcgacgttcgtagtcacgccacggctccgtccccgtcgtcacctccgttcgttcccccg

SEQ ID NO: 299221 - DNA, 570 bp, Homo sapiens
  misc_feature: GZ8MTXP01EK0DR.45.75.G09.1.454.CMB.2.raw
  modified_base (245)..(245): a, c, t, g, unknown or other
  misc_feature (245)..(245): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctccctgcctgggtctcctggacagtcgatcaccatccctgcactggatccagcggtgacgttacttgtttttaagntgtctctggtatcagcaacaccaggacaaacgaccccaaactcatctatttatgatgtacaaataactcggccctcgtaggggtttctcattcgcttctcctggtctaccgaagtctagggactaacgtaccggccctcccgtgaccctactcgtctcggggctccgaggtctagaagacgaggctgattatactgacaggcactatactattagtcgtttccaacgttcggtagttcgggcgggagggaacgtagttcgaccggttcgtacggtcacgttcccgaggcctccgtccccgtcggtccttactcgttccgttcccc

SEQ ID NO: 299222 - DNA, 666 bp, Homo sapiens
  misc_feature: GZ8MTXP01CR961.45.75.G09.1.454.CMB.2.raw
  modified_base (251)..(251): a, c, t, g, unknown or other
  misc_feature (251)..(251): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctcctgtctgggtctctggacagtcgatcaccatccctgcactggatccgaggcggtagtacgtttacttagtttttaaagtnttcgtctcgtgtatcacgacaaccaccgacgaaccaaaccgacccaactctatactattatgatatactaatacgtccggtaccttaggtacggttctactactcgtcttcgtccgtcgtactacgtacgtcgtaacgtaactaacgtacccgtcccttacccgtacacctacgttccgtcggtcggtacctaccggacgggtacgtaacggaaacggaacggtacggtacttacgtaattactacgtacgactacgactaactaattaagttacgtttacgttacgtttaccgtaacggttcgggttacggtaccgggtacgggtaacggtaacgtaacggttcgtaccgttacgtacgtacgaccgaccgacggtcctcccgtcccgtcgtacttaccgttccgttccgtccc

SEQ ID NO: 299223 - DNA, 521 bp, Homo sapiens
  misc_feature: GZ8MTXP01AOFD2.45.75.G09.1.454.CMB.2.raw
  modified_base (312)..(312): a, c, t, g, unknown or other
  misc_feature (312)..(312): n is a, c, g, or t
  modified_base (322)..(322): a, c, t, g, unknown or other
  misc_feature (322)..(322): n is a, c, g, or t
  modified_base (506)..(506): a, c, t, g, unknown or other
  misc_feature (506)..(506): n is a, c, g, or t
tcagacgcgatcgacacgaccggtgctcgatttagtatagacatcagggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgtttttaagatgtctctggtatcagcaacacccaggcaaagccccaaactcatcatttatgatgtcaataatcgcctnaggggtttcncatcgcttctctggctccaagtctaggcaatacggcctccctgaccatctctgggctcaggctagaagacgagctagattatactgcaggcacatatattagtcgttcctacgttcgggtagttcggcggagggtaacctaaggttcgaccgttcgtaggtcagccaggctcgcccctggtccnctcgttcgttccccg

SEQ ID NO: 299224 - DNA, 537 bp, Homo sapiens
  misc_feature: GZ8MTXP01AK1PV.45.75.G09.1.454.CMB.2.raw
  modified_base (290)..(290): a, c, t, g, unknown or other
  misc_feature (290)..(290): n is a, c, g, or t
  modified_base (411)..(411): a, c, t, g, unknown or other
  misc_feature (411)..(411): n is a, c, g, or t
  modified_base (428)..(428): a, c, t, g, unknown or other
  misc_feature (428)..(428): n is a, c, g, or t
  modified_base (460)..(460): a, c, t, g, unknown or other
  misc_feature (460)..(460): n is a, c, g, or t
  modified_base (470)..(470): a, c, t, g, unknown or other
  misc_feature (470)..(470): n is a, c, g, or t
tcagacgcgatcgacacgaccggtgctcgatttagtatagacatcaggggagctctgggagaggagcccagcactgggattccgaggtgtttccattcagtgatctgcactgaacacagaggactcgccatggagtttgggctgagctgggttttccttgttgctattttaaaaggtgtccagtctgaggagcagctggtggagtcgtgggggaggcttgggtccaggccgggggggtccctcagactctcgtgtgcagcctctggattcaccgtcagtggcagcttccngagcgtgggtccgccaggctccgaggggaacggcctgggaggtgggtctcgtagttaatttttagaccaggcacgagcgtaactacgcagtattccggtaagggccattcacatctcaganacaattccagacacgtnttactagaatgaacacctgacgacccgagacncggctctatntactgtgcgagagacaccgaacccgagaacccgaagaaactcaacaactacgtagactggcgtcggg

SEQ ID NO: 299225 - DNA, 601 bp, Homo sapiens
  misc_feature: GZ8MTXP01BQJJZ.45.75.G09.1.454.CMB.2.raw
  modified_base (501)..(501): a, c, t, g, unknown or other
  misc_feature (501)..(501): n is a, c, g, or t
  modified_base (504)..(504): a, c, t, g, unknown or other
  misc_feature (504)..(504): n is a, c, g, or t
tcagacgcgatcgacacgaccggtgctcgatttagtatagacatcaggggagctctgggagaggagcccagcactgggattccgaggtgtttccattcagtgatctgcactgaacacagaggactcgccatggagtttgggctgagcttgggttttccttgttgctattttaaaaggtgtccagtctgaggagcagctggtggagtcgtgggggagcttggtccgagggcccgggggggtccctcgagactcgtcgtgtgcagcctctggattccaccgtcagtggcagccttcctgacgtcgtcggggtccccgccgaggccctaccggaaggggaacgggccgtgggagtcgggtctcgtaagttaaatttttagaccaggcaagagccgtaaacacgcgagtacgtttaccggtaacgggccgtaattcgaccatctcagacgaacattaccgagaactaggttcttacttagaaatcgaacactgacgaccgagacncgntacatatactgtgaacgagagacttaccgaaacccacggaaacccggaagaacttaacgtaacaacctacgtaacggttagtcggaaccgtaacggg

SEQ ID NO: 299226 - DNA, 517 bp, Homo sapiens
  misc_feature: GZ8MTXP01EIJLX.45.75.G09.1.454.CMB.2.raw
  modified_base (226)..(226): a, c, t, g, unknown or other
  misc_feature (226)..(226): n is a, c, g, or t
  modified_base (244)..(244): a, c, t, g, unknown or other
  misc_feature (244)..(244): n is a, c, g, or t
  modified_base (410)..(410): a, c, t, g, unknown or other
  misc_feature (410)..(410): n is a, c, g, or t
tcagacgcgatcgacacgaccggtgctcgatttagtatagacatcagggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtnacgttactgtttttaagntgtctcctggtatcagcaacaccaggcaaagccccaaactcatcatttatgatgtacaataatcggccctcaggggtttctcatcgcttctctggctccaagtctaggacaactacggcctccctgaccatctctggctccagctgaagacgagctgattatactncagcacatatattagtgttcagtcggtattcggcggaggaacctaagttgaccgttcgtaggtcacgcccaaggcctcgcccctcggcttacgtcttcggttccccg

SEQ ID NO: 299227 - DNA, 696 bp, Homo sapiens
  misc_feature: GZ8MTXP01B0DWU.45.75.G09.1.454.CMB.2.raw
tcagacgcgatcgacacgaccggtgctcgatttagtatagacatcaggggagctctgggagaggagcccagcactgggattccgaggtgtttccattcagtgatctgcactgaacacagaggactcgccatggagtttgggctgagctgggtttccttgttgctatttaaaggtgtccagtctgaggagcagctggtggaggtcgtgggggaggcgttgggtccgaggcccgggggggtccctcgagactcgtcgtgtgcagcctctggattcaccgtcagtcggcagcttcctgagcgtgggtcccgccgaggctccgaggggaggcctgggagtgggtctctagttaattttagaccaggcacagcgtaaactacgcagtattcccggtaagggccgtatcgaaccctatcctaccgagacgaacctaagttacccaagggtaaacctacgggttagtttaccttaagtaaaactacggtaaacctaaccccgttaggaaccgaaccccgggaaagggaacccgaaccgggtcttaacccgttaattaacgtttaaccgtaggttacggaacggaaaggttaacgggtaaacttacccgggaaaaccccgaagggttaaacccccgggaaagttaaaactttaaccgtaaacctaacgttaaccgtacgggttataacgggaacgttcccgggg

SEQ ID NO: 299228 - DNA, 858 bp, Homo sapiens
  misc_feature: GZ8MTXP01D09I2.45.75.G09.1.454.CMB.2.raw
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgtttttaagatgtctctggtatcagcaacacccaggaccaaacgcccccaaaatcatcaatttatgatgtacaaataaactccgggtacccctcgtaagggggttttcctctaacgttccgtcctttcctccgttcggggtaccttacccgaaaaggttcccgttaacgggggaccctaaacgttaccccggggtccccttcccccgttaacggtaaccccctaattccccgttaccggttaccggggggtccctttacccccggtaagggggacccttaagggaaaacgggtaacccggaggggtacccttagggtaattttaaacgttaacccgttaaggcctaaacggggacctaaaccgtaacgtttaaactttaaagtttaaacggtttccggttttacccgttaaaccggtttaccggggggtttaacgttttacccggggggaccgggggtaaacgggggtaaacccgtaaaacgggtttccggtaaaccccgggtttaccccgtaaagggggttcccaaacccgggttaccccgttaaacgggtcccgttaaccccgggtcccccccgttcggggtccccttaacccgttcccgtttccccgggtttcccccccg

SEQ ID NO: 299229 - DNA, 566 bp, Homo sapiens
  misc_feature: GZ8MTXP01C8ZI9.45.75.G09.1.454.CMB.2.raw
  modified_base (245)..(245): a, c, t, g, unknown or other
  misc_feature (245)..(245): n is a, c, g, or t
  modified_base (418)..(418): a, c, t, g, unknown or other
  misc_feature (418)..(418): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgtttttaagntgtctctggtatcagcaacaccaggacaaacgcccccaaatcatcatttatgatgtacaaataatccggcctcgtaggggtttctcatcgcttctctggctcaagtctggcaagtaccgcctcctgaccatctctgggctccaggctagaagacgaggtctagtattattacngacagactaatattaagttagttacgttcgttaccgtacgttcggtagttcgggacgggtaacgggtaaccgtaaggttcgtaccgttcgtacggtcacgccgacgtcctaccgtccccgtcggtccttaccgttccgttcccgtccc

SEQ ID NO: 299230 - DNA, 552 bp, Homo sapiens
  misc_feature: GZ8MTXP01AXBR8.45.75.G09.1.454.CMB.2.raw
  modified_base (245)..(245): a, c, t, g, unknown or other
  misc_feature (245)..(245): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttacttgttttaagntgtctctggtatcagcaacacccaggcaaacgccccaaactcatcatttatgatgtacaataactcggccctcgtaggggtttctctatcgcttctcctggtctccaagtctaggctaactacggccctccctcgacctatcgtcgtcgggctccgagctagagacgagctagattatactgcaggcacattattattagttgtttccgagttcggtagttcgggacggagggaacctaggttcgaccgttcgtaggtcacgccgacggctccgccccgtacggtccttaccgtcttccgtcccccg

SEQ ID NO: 299231 - DNA, 574 bp, Homo sapiens
  misc_feature: GZ8MTXP01B8OYO.45.75.G09.1.454.CMB.2.raw
  modified_base (329)..(329): a, c, t, g, unknown or other
  misc_feature (329)..(329): n is a, c, g, or t
  modified_base (532)..(532): a, c, t, g, unknown or other
  misc_feature (532)..(532): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgtttttaagtatgtctcctggtatcagcaacacccaggcaaacgccccaaactcatcatttatgatgtacaataatccggcctcgagggtttcncatcgcttctcctggctccaagtctaggcaataccggccctccctgaccagtctctgggctccgaggctgaagacgaggctgattatactgcaggcacgatattagttagttgtttaccacgttcggttaagtccgggacgggtaagggtaaccctaaggtttcggacccgttcgtaacgggtcttacggcccgaaaggtccnccggtcccccgtcgggtccttaccgtcgttccgtttcccccg

SEQ ID NO: 299232 - DNA, 567 bp, Homo sapiens
  misc_feature: GZ8MTXP01BPZIJ.45.75.G09.1.454.CMB.2.raw
  modified_base (288)..(288): a, c, t, g, unknown or other
  misc_feature (288)..(288): n is a, c, g, or t
  modified_base (370)..(370): a, c, t, g, unknown or other
  misc_feature (370)..(370): n is a, c, g, or t
  modified_base (524)..(524): a, c, t, g, unknown or other
  misc_feature (524)..(524): n is a, c, g, or t
tcagacgcgatcgacacgaccggtgctcgatttagtatagacatcagggggctctgggagaggagcccagcactgggattccgaggtgtttccattcagtgatctgcactgaacacagaggactcgccatggagtttgggctgagctgggttttccttgttgctattttaaaaggtgtccagtctgaggagcagctggtggagtctgggggaggcttggtccgaggccgggggggtccctcagactctcgtgtgcagcctctggattcaccgtcagtggcagcttccngagctgggtcccgccaggctccgagggaacggcctggagtgggtctcgagttaattttagacaggcacagcgtactaacgcngattccgtaagggccattcacatctccagagacaattccgaaggaactacggtgtttactagaaatgaaccaccgtgacgacccgagaccacggctacgtatattctgtgcgaagagatcgaacccgagaacccggaaagttaacttaccgaanaacctaacgtaacgggtattcgggtaacgttcgtaaccggggg

SEQ ID NO: 299233 - DNA, 604 bp, Homo sapiens
  misc_feature: GZ8MTXP01D21XS.45.75.G09.1.454.CMB.2.raw
  modified_base (248)..(248): a, c, t, g, unknown or other
  misc_feature (248)..(248): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctcctgtctgggtctcctggacagtcgatcaccactcccctgcactggactccagcggtgtacgttacttgtttttaagntgtccttctggtatcagcaacacccaggacaaacgaccccaaatcatctatttatgtatgtactaaataacgtccggacccttcgtacgggggtttctcgtactcgtcttctcctcggctacgagtctaggactaacgtaccggccctccctcgacctactctcgtcgggctccgaggtctagaagacgaggtctagtattactactagcaggactataattattaagttcgttcgtttaccgacggtttcgggtacgtcgggacgggaacggtaacgtaagttcggtacccgttcgtacggtcacgccgacggtcctccggtccccgtcggtccttaccttccgttccgttcccc

SEQ ID NO: 299234 - DNA, 596 bp, Homo sapiens
  misc_feature: GZ8MTXP01BW4EG.45.75.G09.1.454.CMB.2.raw
  modified_base (243)..(243): a, c, t, g, unknown or other
  misc_feature (243)..(243): n is a, c, g, or t
  modified_base (294)..(294): a, c, t, g, unknown or other
  misc_feature (294)..(294): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctcctgtctgggtctcctggacagtcgatcaccatcccctgcactggatccagcggtgacgttactgttttaagntgtctctgtatcagcaacacccaggcaaacgccccaaactcatctatttangatgtcaaataatcggcctcgtagggtttcactactcgcttctcctggctacgaacgtctacgggactaacgtaccgtccctccctacgacctactcgtctcgggtctccgacggtcgtaggaaaggacgagggtctagtaacttatacgtagcgaaggctaactattaattattagttcgtttacctacggttcggttacgttcgggcggtaaggaaccgtaagttcggacccgttacgtacggtcacggccgttacggcctccggccccttcggtccttacctccgttccgttaaccccc

SEQ ID NO: 299235 - DNA, 602 bp, Homo sapiens
  misc_feature: GZ8MTXP01AIHDK.45.75.G09.1.454.CMB.2.raw
  modified_base (192)..(192): a, c, t, g, unknown or other
  misc_feature (192)..(192): n is a, c, g, or t
  modified_base (222)..(222): a, c, t, g, unknown or other
  misc_feature (222)..(222): n is a, c, g, or t
  modified_base (277)..(277): a, c, t, g, unknown or other
  misc_feature (277)..(277): n is a, c, g, or t
  modified_base (293)..(293): a, c, t, g, unknown or other
  misc_feature (293)..(293): n is a, c, g, or t
  modified_base (416)..(416): a, c, t, g, unknown or other
  misc_feature (416)..(416): n is a, c, g, or t
tcagacgcgatcgacacgaccggtgctcgatttagtatagacatcaggggggggtctcaggaggcagcgctctcgggacgtctccaccatggcctgggctctgctgctcctcactctcctcactcaggacacaggatcgtgggccctttctgccctgactcagcctgcctccgtgtctgggtctcctggacngtcgatcacatggcctgcactggaaccaanagtgatggttgggtagttttagtttgtctctgtaccaacaacacccggacgaacnccccaaatatcattanaggacacgtaagccggccgtggggttcagtcgcttctctgctcagtctcggcacgcgccctcctaagacaatctcgtcgggctcgaggctcgaggacgaggctagtattatttctgttgctanatatgcgagggggaccagtcgtacgttggggtcggttcgggacgggtacgggtaccgtagggttccgtacccggtcggtaacgggtccgaacggccccgaagggtccccgttccggttccccccgttcgggttaccctaacccgttccgttcccggttccccgtccccttcctccgttccggtccg

SEQ ID NO: 299236 - DNA, 586 bp, Homo sapiens
  misc_feature: GZ8MTXP01B82N7.45.75.G09.1.454.CMB.2.raw
  modified_base (245)..(245): a, c, t, g, unknown or other
  misc_feature (245)..(245): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgtttttaagntgtctcctggtatcagcaacacccaggacaaacgccccaaatcatcatttatgatgtacaaataactccggccctcgtagggggtttctcatcgtcttctcctggctcaagtctaggacaagtaccggccctccctcgacctatctcgtcgggctccgaggctaggaacgacgaggtctagtattacttacgtgacaggctaactaattattagtttaagttcgtttaccgtacggttcgggtacgttcgggacggagggaaccgtaaggttcgtaccgttcgtaggtcttacgccgaacggtcctacgccccgttcggtcttactccgttccgttccccc

SEQ ID NO: 299237 - DNA, 580 bp, Homo sapiens
  misc_feature: GZ8MTXP01CKFV9.45.75.G09.1.454.CMB.2.raw
  modified_base (264)..(264): a, c, t, g, unknown or other
  misc_feature (264)..(264): n is a, c, g, or t
  modified_base (539)..(539): a, c, t, g, unknown or other
  misc_feature (539)..(539): n is a, c, g, or t
tcagacgcgatcgacacgaccggtgctcgatttagtatagacatcaggggagctctgggagaggagcccagcactgggattccgaggtgtttccattcagtgatctgcactgaacacagaggactcgccatggagtttgggctgagctgggttttccttgttgctattttaaaaggtgtccagtctgaggagcagctggtggagtcgtgggggaggcttgggtccaggcccgggggggtccctcagactctcgtgtgcagcctntggattcaccgtcagtggcagcttcctgagctgggtccgccaggcctccgagggggacgggccgtgggagtgggtctcgaagttaatttttagaccaggcacgagcgtaaactacgcagtacttccggttaagggccgtattccacatcctaccagagaacaattaccgaaggaactacggttgtttactagaaattcgaactcccgtagacgacccgagaccacggtctactatacttactgtgcgagagacttcgaaacccagaacccggaanaaacgttcaacgtaactacgtacggttagtcggaacgtcgg

SEQ ID NO: 299238 - DNA, 532 bp, Homo sapiens
  misc_feature: GZ8MTXP01E0PTA.45.75.G09.1.454.CMB.2.raw
  modified_base (293)..(293): a, c, t, g, unknown or other
  misc_feature (293)..(293): n is a, c, g, or t
  modified_base (324)..(324): a, c, t, g, unknown or other
  misc_feature (324)..(324): n is a, c, g, or t
  modified_base (400)..(400): a, c, t, g, unknown or other
  misc_feature (400)..(400): n is a, c, g, or t
  modified_base (412)..(412): a, c, t, g, unknown or other
  misc_feature (412)..(412): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctcctgtctgggtctcctggacagtcgatcaccatcccctgcactggatccagcggtgacgttactgtttttaagatgtctcctggtatcagcaacaccaggcaaagccccaaatcatcatttangatgtcaataatcggcctcgtaggggtttcncatcgcttctcctggctccaagtctaggcaataccgggcctccctgacctatctctgggctcaggctagaagacgnggtctgtaattntaatgacaggctacatatatttagtcgtttccagttcggtattcgggcggaggaactaaagttgacccgttcgtagtcacgttcccaagggctcgccccgtggcactcgttcgttccccc

SEQ ID NO: 299239 - DNA, 516 bp, Homo sapiens
  misc_feature: GZ8MTXP01DM7XZ.45.75.G09.1.454.CMB.2.raw
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgtttactgtttttaagatgtctcctggtatcagcaacacccaggcaaagcccccaaactcatcatttatgatgtcaataatcggccctctagggggtttctcatcgcttctcctggctccaagtctgggcaatacggcctccctgaccatctctgggctccaggctgaagacgagctgattatactgcaggcacatatattagtgtttccactcggtattcggcggaggaacaagttgacgttctaggtcagccagctcgcccctcggtcactcgttcgttcccccg

SEQ ID NO: 299240 - DNA, 582 bp, Homo sapiens
  misc_feature: GZ8MTXP01EVF1L.45.75.G09.1.454.CMB.2.raw
  modified_base (229)..(229): a, c, t, g, unknown or other
  misc_feature (229)..(229): n is a, c, g, or t
  modified_base (245)..(245): a, c, t, g, unknown or other
  misc_feature (245)..(245): n is a, c, g, or t
  modified_base (258)..(258): a, c, t, g, unknown or other
  misc_feature (258)..(258): n is a, c, g, or t
  modified_base (438)..(438): a, c, t, g, unknown or other
  misc_feature (438)..(438): n is a, c, g, or t
tcagacgcgatcgacacgaccggtgctcgatttagtatagacatcagggggggggtctcgaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtnacgttatgttttaagntgtctctggtatnagcaacaccaggcaaacgccccaaatcatctatttatgatgtacaaataatcggccctcgtaggggtttctcatcgtcttctcctggtctaccgaagtctaagggacaacgttaccggccctccctcgaccctatctcgtcgggctaccgagcgaggaagacgaggtctagattattacngacagactataataattattagttacgttaccgtacgtcggttacggtacgggtacgggtaacgggtaacgtaacgttacgtacgttacgtacgtacgacgccgacgccgtccgtcccgtccgtcgttcctccgttccgtcccg

SEQ ID NO: 299241 - DNA, 679 bp, Homo sapiens
  misc_feature: GZ8MTXP01DIJVC.45.75.G09.1.454.CMB.2.raw
  modified_base (559)..(559): a, c, t, g, unknown or other
  misc_feature (559)..(559): n is a, c, g, or t
  modified_base (580)..(580): a, c, t, g, unknown or other
  misc_feature (580)..(580): n is a, c, g, or t
  modified_base (585)..(585): a, c, t, g, unknown or other
  misc_feature (585)..(585): n is a, c, g, or t
tcagacgcgatcgacacgaccggtgctcgatttagtatagacatcagggggctctgggagaggagcccagcactgggattccgaggtgtttccattcagtgatctgcactgaacacagaggactcgccatggagtttgggctgagctgggttttccttgttgctattttaaaggtgtccagtctgaggagcagctggtggagtcgtgggggaggtcttgggtccgaggcccggggggtccctcgagactctcgtgtgcagcctctggattcaccgtcagtggcagcttcctgagcgtgggtcccgccgaggcctcccggaaggggaacgggccgtgggacggtgggtcttacgtaagttaagtttttagaccgtaggcctaacgaggtaccgtaacgtaaaccgctaaggtactttacccgggttaaaggggccccgtaagttccaacccgtataccctaccaaggtaacgaactaacttacccgaagggtaaaccctagggttcgtttaacgtagaaactacgaaacctacccggtaggaacgaccccggaggaaccncggtactactaatatttccgngtcgngaagagactaaccgaaaccgtaacggaacccggaaagttaacttaccaaacgaacttaacgtaacggtagttacgggaacgttcgaaccggggg

SEQ ID NO: 299242 - DNA, 570 bp, Homo sapiens
  misc_feature: GZ8MTXP01C43NY.45.75.G09.1.454.CMB.2.raw
  modified_base (247)..(247): a, c, t, g, unknown or other
  misc_feature (247)..(247): n is a, c, g, or t
  modified_base (551)..(551): a, c, t, g, unknown or other
  misc_feature (551)..(551): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctcctgtctgggtctcctggacagtcgatcaccatcccctgcactggactccagcggtgtacgttacttgtttttaagntgtctctggtatcagcaacaccaggacaaacgccccaaatcatcatttatgatgtacaaataactccggaccctgtaaggggtttctcatcgtcttctcctggtctaccaagtctaggactaactaccggcctaccctacgacctactctcgtggtctccgaggctagaacgacgaggctagtattatactgacagactaactataatatttagtcgtttaccgtacgtcggtagttccgggacggtacgggaactaaggttcgaccgttcgtagtcacgccaacggctaccgcccctggtacnccgtcgttccgttcccccg

SEQ ID NO: 299243 - DNA, 617 bp, Homo sapiens
  misc_feature: GZ8MTXP01AWKQ6.45.75.G09.1.454.CMB.2.raw
  modified_base (534)..(534): a, c, t, g, unknown or other
  misc_feature (534)..(534): n is a, c, g, or t
tcagacgcgatcgacacgaccggtgctcgatttagtatagacatcagggctctggagaggagcccagcactggattccgaggtgtttccattcagtgatctgcactgaacacagaggactcgccatggagtttggctgagcgtggtttcgtgtagcgtatttaaagtagtcagtctgagagcagctgtggagtcgtggggaggcgttgtcgacggccggggtccgtcgagacgtcgtcgtgtgcgacgcgtcgtgtagtcgtaccgtcgagtgcgcgtcgtccgtcgcgcgtcggtccgccgacgcgtccgacggaacggcgtcggtaggtggtcgtacgtaagttaagttttaagttacgtacgacgacgacgtacgtacgtaacgacgtaacgtacgttacgttaacggtacgtacgttactacactactcacgacgactaacgtacgacgaacgtacgttacgttacgttacgtaagtacgtaacgaaccgtacgacgaccgacgacgacgcgtacgtatacttatagtgngaagagacgacgaaccgaacgaacgaacgttaacgttacgtaactaacgtaacgtaacgtacgttacgtaacgttcgtaacgg

SEQ ID NO: 299244 - DNA, 539 bp, Homo sapiens
  misc_feature: GZ8MTXP01C4WMJ.45.75.G09.1.454.CMB.2.raw
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgtttttaagatgtctctggtatcagcaacaccaggcaaacgcccccaaatcatcatttatgatgtacaataatcggccctcgtagggtttctcatcgcttctctggctccaagtctaggcaagtaccggccctccctgaccatctcgtcgggctccgagctagaagacgagctgattatactgcaggcactatatattagtcttctacgtcgggtagttcggacggtaggaacctaagttcggtaaccgttcgtaacggtcacggttcccaggctccgccccgtcgtcactccgttcgttcccc

SEQ ID NO: 299245 - DNA, 582 bp, Homo sapiens
  misc_feature: GZ8MTXP01D6YV2.45.75.G09.1.454.CMB.2.raw
  modified_base (250)..(250): a, c, t, g, unknown or other
  misc_feature (250)..(250): n is a, c, g, or t
  modified_base (302)..(302): a, c, t, g, unknown or other
  misc_feature (302)..(302): n is a, c, g, or t
  modified_base (420)..(420): a, c, t, g, unknown or other
  misc_feature (420)..(420): n is a, c, g, or t
  modified_base (424)..(424): a, c, t, g, unknown or other
  misc_feature (424)..(424): n is a, c, g, or t
  modified_base (439)..(439): a, c, t, g, unknown or other
  misc_feature (439)..(439): n is a, c, g, or t
  modified_base (562)..(562): a, c, t, g, unknown or other
  misc_feature (562)..(562): n is a, c, g, or t
tcagacgcgatcgacacgaccggtgctcgatttagtatagacatcagggggggggtctcaggaggcagtgctctcgggacgtctccaccatggcctgggctctgctattcctcaccctcctcactcagggcacagggtcctgggcccagtctgccctgactcagcctgcctccctgtctgggtctcctggacagtcgatccaccactcccctgcactggatccagcggtgtacgtttattgtttttaagntgtctctggtatcagcaacacccaggacaaacgcccccaaatcatcatttangatgtacaaataatcggcctcgtagggtttcacgatcgcttctctggctaccgaagtctaggactaataccggtccctccctacgacctactctcgtgggctccgagctagaagacgnggtntagtattactacgtnacaggactaactataattattacgtcgttccgtacgtcggtagttcgggacggaacgggaactaacggttcgaccgttacgtacggtacttacggccaaggtcctccgaaccccgtggtaccncgttcttaacccgttccccc

SEQ ID NO: 299246 - DNA, 599 bp, Homo sapiens
  misc_feature: GZ8MTXP01C5X4G.45.75.G09.1.454.CMB.2.raw
  modified_base (248)..(248): a, c, t, g, unknown or other
  misc_feature (248)..(248): n is a, c, g, or t
  modified_base (303)..(303): a, c, t, g, unknown or other
  misc_feature (303)..(303): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctcctgtctgggtctcctggacagtcgatcaccactcccctgcactggactccagcggtgtacgttacttgtttttaagntgtctctggtatcagcaaacacccaggacaaacgcccccaaaactcatcatttangattgtacaataatcggccctgtaggggtttctcatcgcttctcctggctcaagtctaggacaatacgccctccctgacccatctcgtgggctccgaggctagaagacgaggctagtattatactgcgaggcaactaattattaacgtttagtcgttttcccgtaaacgtttcggggttaatttcggggacgggtacgggaacctaaggttacgtaccggttacgtacgggtcgaacgcccgaaacgggtcctccggtcccccgttcgggtccacgttccgttccgtttaaccccc

SEQ ID NO: 299247 - DNA, 597 bp, Homo sapiens
  misc_feature: GZ8MTXP01C8V85.45.75.G09.1.454.CMB.2.raw
tcagacgcgatcgacacgaccggtgctcgatttagtatagacatcagggggctctgggagaggagcccagcactgggattccgaggtgtttccattcagtgatctgcactgaacacagaggactcgccatggagtttgggctgagctgggttttccttgttgctattttaaaaggtgtccagtctgaggagcagctgggtggagtcgtggggggaggcgttgggtccgaggcccgggggggtccctcgagactctcgtgtgcagcctctggattcaccgtcagtggcagcttcctgagctgggtcccgccgaggcctccgagggggaagggcctgggagtgggtctcgtagttaattttagacacggcacgagcgtactaacgcaagattcccggttaaagggccgtattccacatctccagagacaattccaaggaactaggttattctagaaatgaacaccgtgacgacccgagacacggctagtatattctgtgcgaagagactaccgaaacccgtaaggaacccggaaagttaaacttacctaacaaacgttaaccgtaacggtattacgggtaaccgttcggtaaccggggg

SEQ ID NO: 299248 - DNA, 566 bp, Homo sapiens
  misc_feature: GZ8MTXP01DSG75.45.75.G09.1.454.CMB.2.raw
  modified_base (247)..(247): a, c, t, g, unknown or other
  misc_feature (247)..(247): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgtttacttgtttttaagntgtctcctggtatcagcaacacccaggcaaacgccccaaatcatcatttatgatgtcaataatcgcctcgtagggtttctcatcgcttctcctggctcaagtctggactaagtacggcctccctcgacctactctctgggctcaggctaggaagacgaggtctgattatacgtgcaggcaactatattacttagttcgtttacctacgttcggggttaacgttcgggacgggaagggtaacctaaggttcggacccgttcgtacggtcacggcccgaaggtcctcgccccgtggtccaccgttcgttccggttcccccg

SEQ ID NO: 299249 - DNA, 596 bp, Homo sapiens
  misc_feature: GZ8MTXP01EFIW1.45.75.G09.1.454.CMB.2.raw
  modified_base (227)..(227): a, c, t, g, unknown or other
  misc_feature (227)..(227): n is a, c, g, or t
  modified_base (245)..(245): a, c, t, g, unknown or other
  misc_feature (245)..(245): n is a, c, g, or t
  modified_base (303)..(303): a, c, t, g, unknown or other
  misc_feature (303)..(303): n is a, c, g, or t
  modified_base (374)..(374): a, c, t, g, unknown or other
  misc_feature (374)..(374): n is a, c, g, or t
  modified_base (376)..(376): a, c, t, g, unknown or other
  misc_feature (376)..(376): n is a, c, g, or t
  modified_base (380)..(380): a, c, t, g, unknown or other
  misc_feature (380)..(380): n is a, c, g, or t
  modified_base (395)..(395): a, c, t, g, unknown or other
  misc_feature (395)..(395): n is a, c, g, or t
  modified_base (427)..(427): a, c, t, g, unknown or other
  misc_feature (427)..(427): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcgggcacagggtcctgggcccagtctgccctgactcagcctgcctccctgtctgggtctcctggacagtcatcaccatcccctgcactcggatccgagcggtnacgtttactgttttaagntgtctctggtatcagacaacaccaggccaaacgccccaaatcatcatttatgatgtanataactccggtcctcgtagggtttctcgtatcgtcttctctcggctcctaagtctaagcaactccgcctcncncacntctggctcagctagngacgagctagtattactactgcaggctaactnttactatttacgtcgttttaccgacgttcggggttacgtaccgggtacgggtaacgggtaaccgtaaacggtttcggacccgttccgtaacgggttccaacggttccccgaccgggtccgtcccggtaacccccgtcgggttccgccttcccggttccctttccccccg

SEQ ID NO: 299250 - DNA, 621 bp, Homo sapiens
  misc_feature: GZ8MTXP01A2IZ6.45.75.G09.1.454.CMB.2.raw
  modified_base (248)..(248): a, c, t, g, unknown or other
  misc_feature (248)..(248): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccgagcggtgtacgttacttgtttttaagntgtctctggtatcagcaacacccaggacaaacgacccccaaactcatctatttatgatgtacaataagtccggccctcgtagggtttctcatcgtcttctcctggctccgaagtctaggctaacgtaccggccctccctgaccatcctcgtcgggactccgaggcctgaaacggacggaggccttgtaattattacgtgacacggacaactaatttaattatttaacgttcggttttaccgaccggtttcgggtacgtttcgggacggggagggtaaccgtaaacggttcggacccggttacgtacggttcgaccggccgaacgggtcctcccggtccccgtcgtaccgttccttccgttcccggttcccccg

SEQ ID NO: 299251 - DNA, 578 bp, Homo sapiens
  misc_feature: GZ8MTXP01DWI8C.45.75.G09.1.454.CMB.2.raw
  modified_base (245)..(245): a, c, t, g, unknown or other
  misc_feature (245)..(245): n is a, c, g, or t
  modified_base (335)..(335): a, c, t, g, unknown or other
  misc_feature (335)..(335): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctcctgtctgggtctcctggacagtcgatcaccatcccctgcactggatccgagcggtgacgttactgtttttaagntgtctctggtatcagcaacacccaggacaaacgacccccaaactcatcatttatgatgtacaaataactccggccctcgtaggggtttcnctatcgctttctcctggctccgaagtcctaggacaacgtaccggccctccctagacccattcgtcgtcgggcctccgagggctaggaacgacgagggtctagtattacgttactgacaggcaactatattattagtcgttccaagttcggttagttcgggacggagggtaactaaggttcgaccgttcgtaacggtcacgcccaggcctccgcccctcggtccacttccgttccgttcccccg

SEQ ID NO: 299252 - DNA, 533 bp, Homo sapiens
  misc_feature: GZ8MTXP01CA8DE.45.75.G09.1.454.CMB.2.raw
  modified_base (244)..(244): a, c, t, g, unknown or other
  misc_feature (244)..(244): n is a, c, g, or t
tcagacgcgatcgacacgaccggtgctcgatttagtatagacatcagggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgtttttaagntgtctctggtatcagcaacacccaggcaaacgcccccaaatcatcatttatgatgtcaataatcggccctcgagggtttctcatcgcttctcctggctccaagtctaggcaagtaccggccctcccgtgacccatctcgtcgggcctccgaggcctggaagacgaggctagattattactgcaggcactatactattagtgtttccacgtcgggtattcgggcgagggaactaaggttcgaccgttctaggtcacgccaggctcgccctcggcactcgttcgtaacccc

SEQ ID NO: 299253 - DNA, 799 bp, Homo sapiens
  misc_feature: GZ8MTXP01DMRR4.45.75.G09.1.454.CMB.2.raw
  modified_base (251)..(251): a, c, t, g, unknown or other
  misc_feature (251)..(251): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccactcccctgcactggactccgagcggtgtacgtttacttgtttttaagnttgtctctggtatcagcaacacccaggaccaaacgacccccaaactcatctatttatagtatagtacaaattaacgtccggcccttacgtacggggtttctcgtattccgtctttctccgtcggtcctaccgtaaagttcgtaacgggacctaacggtacccgggtccccttaccccgtcgaacccctacttccgttccgtacggggtcccttacccggagggtacccgttaggaaaacggtaccgggaacgggttccttaaggttaaactttacgttaaccgttagaccgaaacgtactaaacttaagttaaactttaagtttacgtttaccgttttacccgtaaccgggtttacggggtttaacggtttacgggggaaccggggttaaacgggggtaaacccgttaaagggtttacccggtaaacccgggttacccggttaaacggggtcccaaccgggttaccccggttaacgggtccccttacccgggtaaccccccgttcggggtacccttaccggttcccgtttccccgggtttcccccccg

SEQ ID NO: 299254 - DNA, 827 bp, Homo sapiens
  misc_feature: GZ8MTXP01CFD0Z.45.75.G09.1.454.CMB.2.raw
tcagacgcgatcgacacgaccggtgctcgatttagtatagacatcagggggctctgggagaggagcccagcactgggattccgaggtgtttccattcagtgatctgcactgaacacagaggactcgccatggagtttgggctgagctgggtttccttgttgctatttaaaggtgtccagtctgaggagcagctgggtggagtcgtgggggagtcttgggtccgaggcccggggggtccctcaggactctcgtgtgcagcctgtggacttcgaccgtcagtggcagtccttccgtgacgcgtcgggtcccgccgaggcctccggaagggggaacggtccgtagggacggttcggggtacttacgtaaaggtttaaacgtttttagaaccgtaacgggtaccaacgtacgtaccgttaacgtaaaccgcgtaaggtaacgtttacccccggggttaaaaggggtcccctaactttacccgaaaccctattaccccgttacccgaaaggaaccggtaacctaaaaccgtttaccccggaaaacgggtaaaccgttaacggggtttcgttttaaccgtaagtaaaaacgtaccgtaaaaccccgtaacccgggttacggaaaccgggtaaacccccggtaagggaacccgtaccgggtactttacctaaagtttacgttaaccgtggtacggacgggtaacgaacggttaccgtaaacccgggaaacccgtaaaccgggaacccgggttaaaaagttaaacgtttaccctaaacggtaaacctaacccggttaagggtacgttacggggtaaccgttcggtaacccggggg

SEQ ID NO: 299255 - DNA, 717 bp, Homo sapiens
  misc_feature: GZ8MTXP01D7SE1.45.75.G09.1.454.CMB.2.raw
  modified_base (244)..(244): a, c, t, g, unknown or other
  misc_feature (244)..(244): n is a, c, g, or t
  modified_base (298)..(298): a, c, t, g, unknown or other
  misc_feature (298)..(298): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgttttaagntgtctctggtatcagcaacacccaggacaaacgacccccaaatcatctatttangatgtacaataactccggcctcgtagggtttctctactcgcttctcctcggctaccgagtcgtacggactaacgtaccggcccttccctgacctactcgtcgtcgggcctccgaggtctaggaaacggtacggacgggtacttaggtaactttacgttacgttacggacctaagggtacctaaactaaatttaatttaacgttttaaacggtttccgttttacccgaaccggttttaccgggggttaacggtttacccgggggaaccggggtaaaccggggttaaaccgttaaacgggtttccggtaaccccggtttacgttaacgggttacccgaaccggttcccgttaaacgggtccccgtaccggtccccccgttacgggtcccttaccgtttcccgttaacccgtttcccccccg

SEQ ID NO: 299256 - DNA, 626 bp, Homo sapiens
  misc_feature: GZ8MTXP01ANXMR.45.75.G09.1.454.CMB.2.raw
  modified_base (226)..(226): a, c, t, g, unknown or other
  misc_feature (226)..(226): n is a, c, g, or t
  modified_base (243)..(243): a, c, t, g, unknown or other
  misc_feature (243)..(243): n is a, c, g, or t
  modified_base (296)..(296): a, c, t, g, unknown or other
  misc_feature (296)..(296): n is a, c, g, or t
  modified_base (322)..(322): a, c, t, g, unknown or other
  misc_feature (322)..(322): n is a, c, g, or t
tcagacgcgatcgacacgaccggtgctcgatttagtatagacatcagggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtnacgttactgttttaagntgtctcctggtatcagcaacacccaggacaaacgcccccaaatcatcatttangatgcaataatcgcctcagggtttcncatcgtcttctcctggctcaagtctagggcaataccggccctccctcgacctatctcgtcgggctccgagctagaacgacgaggctgtattactctgccaggcaactatattacttagtcgtttaccgtacgttaccgggtaagttccggggacggaacggggtaacccgtaaaggttttccggaaccccggttaccggttaaacgggttcccgaacgggttccccgaaacgggggtccctaccgggtcccccccgttacggggttcccttaacccgttcccgtttccggtttaaccccccccg

SEQ ID NO: 299257 - DNA, 577 bp, Homo sapiens
  misc_feature: GZ8MTXP01CRHSO.45.75.G09.1.454.CMB.2.raw
  modified_base (248)..(248): a, c, t, g, unknown or other
  misc_feature (248)..(248): n is a, c, g, or t
  modified_base (558)..(558): a, c, t, g, unknown or other
  misc_feature (558)..(558): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctcctgtctgggtctcctggacagtcgatcaccatcccctgcactggatccgagccggtgacgttacttgtttttaagtntgtctcctggtatcagcaacaccaggacaaacgccccaaatcatctatttatgatgtacaataatccggcctcgtagggtttctcgatcgcttctcctggctccaagtctagggactaacgtaccggtccctaccctcgaaccctatcctcgtcggtctccgaggcgtagaaacgacggaggctgtattatactgcaggacaactatatattagtcgttaccacgttcggtagttcgggcggaagggtaacctaaggttcgaccgttcgtacggtcacggcccgaaggtccaccgtccccgtcggtaccncgttccgttcgttcccccg

SEQ ID NO: 299258 - DNA, 624 bp, Homo sapiens
  misc_feature: GZ8MTXP01ECU3E.45.75.G09.1.454.CMB.2.raw
  modified_base (225)..(225): a, c, t, g, unknown or other
  misc_feature (225)..(225): n is a, c, g, or t
  modified_base (242)..(242): a, c, t, g, unknown or other
  misc_feature (242)..(242): n is a, c, g, or t
  modified_base (261)..(261): a, c, t, g, unknown or other
  misc_feature (261)..(261): n is a, c, g, or t
  modified_base (288)..(289): a, c, t, g, unknown or other
  misc_feature (288)..(289): n is a, c, g, or t
  modified_base (324)..(324): a, c, t, g, unknown or other
  misc_feature (324)..(324): n is a, c, g, or t
tcagacgcgatcgacacgaccggtgctcgatttagtatagacatcagggggggggtctcaggaggcagcgctctcgggacgtctccaccatggcctgggctctgctattcctcaccctcctcactcagggcacagggtcctgggcccagtctgccccgatcagcctgcctcctgtctgggtctctggacagtcgatcaccatcccctgcactggatccagcggtnacgttattgttttaagntgtctctgtatcagcaacnccagacaacgcccaaatcatctattannatgtacaataacgtccgtccctaggtagggtttcncgtattccgtcttcgtcgtccggcctacgtaagtctaggtaaccaaacgtccggccctcccgtacacctatcgtcgttcggctccgaggctaggaagacggacgtatagttaattaacgtcgtagacaagactaactaatttattaagtttaggtaccgtttcgtacggttacggttacgttccgggaacggtaccggaacgttaaggttaccggccgttacgacgggtacaccgttaccgacggttcctaacccggtcccctggtaccctccgttccgttcccgttccccgtaaccccg

SEQ ID NO: 299259 - DNA, 769 bp, Homo sapiens
  misc_feature: GZ8MTXP01AKLKC.45.75.G09.1.454.CMB.2.raw
  modified_base (312)..(312): a, c, t, g, unknown or other
  misc_feature (312)..(312): n is a, c, g, or t
tcagacgcgatcgacacgaccggtgctcgatttagtatagacatcgggggagctctgggagaggagcccagcactgggattccgaggtgtttccattcagtgatctgcactgaacacagaggacttgccatggagtttgggctgagcttgggttttccttgttgcttattttaaaaggtgtccagtctgaggagcagctggtggagtcgtgggggaggcgttggtccgaggcccggggggtccctcgagactcgtcgtgtgcagtctctggattcaccgtcagtggcagcttccgtgacgtcgtgggtcccncgacggcctccgaggggaacggccgtagggagtgggtcctacgtaagttaagttttagaacgacggcacgaggacgtactaacgcgtaagtacgttacccgggttaaagggcccgtaacttccaacctacgtccctaccgaaggaacgtaacctaaacgttcccgaaacgggtaaaccgtacgggttcgttttaccgttaaggaaaactttacggaaaccccgtaccccggttaaggggaaacccggtaaccccgggaaagggtaaacccgaaccgggttacttacccggtttaaattaaacgtttaccgttaggtacggacccggaaaggtaacgttaaaccgttaacccggaaaccccgaaacgggtaaaccccggaaaagttaaaacttacccgtaaacctaaacgttaaccgtaacgggtaacgttcggggtaaccgttcggtaacccggggg

SEQ ID NO: 299260 - DNA, 616 bp, Homo sapiens
  misc_feature: GZ8MTXP01AP4PV.45.75.G09.1.454.CMB.2.raw
  modified_base (227)..(227): a, c, t, g, unknown or other
  misc_feature (227)..(227): n is a, c, g, or t
  modified_base (244)..(244): a, c, t, g, unknown or other
  misc_feature (244)..(244): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtnacgttactgttttaagntgtctctggtatcagcaacaccaggcaaacgccccaaatcatcatttatgatgtacaataatccggcctcgtaggggtttctctatcgtcttctcctggctccaagtctggcgcgtaccggccctccctgaccctatctcgtcgggctccgaggcctaggaagacggagtctagtattattaactgactacgggctaactattagttaagtttacgttcgtttaccgtacgttcggggttacgttcggggaccgggtaacgggaaccgtaaaggttcggtacccggttaccgtacgggtccgaccgttcccgaacgggtccctcccggaacccccgttcgggtccttaccgttccgttccgtttcccccccg

SEQ ID NO: 299261 - DNA, 701 bp, Homo sapiens
  misc_feature: GZ8MTXP01D5VQM.45.75.G09.1.454.CMB.2.raw
  modified_base (247)..(247): a, c, t, g, unknown or other
  misc_feature (247)..(247): n is a, c, g, or t
  modified_base (260)..(260): a, c, t, g, unknown or other
  misc_feature (260)..(260): n is a, c, g, or t
  modified_base (300)..(300): a, c, t, g, unknown or other
  misc_feature (300)..(300): n is a, c, g, or t
  modified_base (334)..(334): a, c, t, g, unknown or other
  misc_feature (334)..(334): n is a, c, g, or t
tcagacgcgatcgacacgaccggtgctcgatttagtatagacatcagggggggggtctcaggaggcagcgctctcgggacgtctccaccatggcctgggctctgctattcctcaccctcctcactcagggcacagggtcctgggcccagtctgccctgactcagcctgcctcctgtctgggtctcctggacagtcgatcaccatcccctgcactggatccagcggtgtactttacttgtttttaagntcgtctcgtgtancacgacaacaccgagaccaaaccacccaatcatctattantatagtactaatacgtccgtcctacgttggttcntactcgtcttcgtccgtcgtactacgtacgtcgtaacggactaacgtacccgtccctcccgtacgtacctcttcgtccgtcggtacctaccggacggtacgtaacgaacggtaacggtacgtacttacgtaattaacgtacgtacgaacgtaacgggtaactaacttaagttaacgttaacgtttacgttaccggtttacccgtaacgggtttacgggttaacggttaccggggtacggtaacgggtaaccgttaacggttacccggtacccggttacggtacggtaccgttaccggcccggttaaccggtcccgtaccccggtccccgttcggtacccttacccgttcccgttccccgttcccccg

SEQ ID NO: 299262 - DNA, 676 bp, Homo sapiens
  misc_feature: GZ8MTXP01CRUCY.45.75.G09.1.454.CMB.2.raw
  modified_base (250)..(250): a, c, t, g, unknown or other
  misc_feature (250)..(250): n is a, c, g, or t
  modified_base (262)..(262): a, c, t, g, unknown or other
  misc_feature (262)..(262): n is a, c, g, or t
  modified_base (427)..(427): a, c, t, g, unknown or other
  misc_feature (427)..(427): n is a, c, g, or t
tcagacgcgatcgacacgaccggtgctcgatttagtatagacatcagggggggggtctcaggaggcagcgctctcgggacgtctccaccatggcctgggctctgctattcctcaccctcctcactcagggcacagggtcctgggcccagtctgccctgactcagcctgcctcctgtctgggtctcctggacagtcgatccaccatcccctgcactggactccgaggtcggtatacgtttattgttttaantgtctctggtancagcaacaccagacaaaccgacccaaatcatctatttatgatacgtactaataacgtccggtccttagtacgggttctacacttcgtctttctcccgtcggtactacgtaactcgtacgactaacgtcccggtcctaccgtacgacctacgtcgtcgtcggtccnccggaaggtccgaggaaacgtaacgtacgggtcttagtaattaacgtacgtcgacctaggacctaaattattaagttaagtttacgttacggtttcccgtaacggttcgggttaacgttaccggggacggtaaacggtaaccgttaaaggttcggtaacccgttcggttaacgccgaacggttccccgttaacgggtcctccccggtccccgttcggtacccttaccgtttcccgttcccgttcccccg

SEQ ID NO: 299263 - DNA, 648 bp, Homo sapiens
  misc_feature: GZ8MTXP01DOT6M.45.75.G09.1.454.CMB.2.raw
  modified_base (309)..(309): a, c, t, g, unknown or other
  misc_feature (309)..(309): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctcctgtctgggtctcctggacagtcgatccaccactcccctgcactggatccagcggtgtacgtttacttgtttttaagtatgtcctctggtatcagacaaccacccaggaccaaacgacccccaaactcatctatttangtatgtacaataacgtccggtccctcgtacgggtttcctctactcgctttcctccgtcggtcctacgtaacgtcgtaacgggactaacgttacccggcccttacccgtacgtacctactcgtcgtcggcctaccgaggcgtaggaacgacggtacggtctagtacttaagttactagacaggactataattacttagtttacgttcgtttaccaacggtttcggtacgttacgggacgggtacgggtaaccgtaagttaccggaccgtttacgacggtcgaccgccgttacggtccgtcccgtccccgtcggtaccttaccttccgttccgttcccccg

SEQ ID NO: 299264 - DNA, 720 bp, Homo sapiens
  misc_feature: GZ8MTXP01BH5UP.45.75.G09.1.454.CMB.2.raw
tcagacgcgatcgacacgaccggtgctcgatttagtatagacatcagggggctctgggagaggagcccagcactgggattccgaggtgtttccattcagtgatctgcactgaacacagaggactcgccatggagtttgggctgagctgggttttccttgttgctattttaaaaggtgtccagtctgaggagcagctggtggagtcgtgggggaggcttggtccgaggtcccgggggggtccctcgagactctcgtgtgcagcctctggattcaccgtcagtggcagcttccgtgagcgtcgggtcccgccgaggcctcccgagggggaacgggtcctgggagtgggtctcgtaagttaatttttagacgtacggcacgagccgttacgtaacgacaaggtactttacccgggttaaaggggccctattcacctatcctaccaagtacgaactaacgttaccgaaggaacctacgggttcgtttactagtaaacttcgaaaccgacccgtagaaccggaaccccgaaggaaccgtaccgggtacttaccgttaattaacgtttaccgtaggttacgaccggaagtaacggaacgttaccccggaaaaccccgtaaacgggtaaaccccgggaaaagttaaaaccttaccgtaaaacctaaaccgtaaaccggttaacgggtaacggttacgggtaacccggtttcgggtaaaccccggggg

SEQ ID NO: 299265 - DNA, 720 bp, Homo sapiens
  misc_feature: GZ8MTXP01BTQSH.45.75.G09.1.454.CMB.2.raw
  modified_base (252)..(252): a, c, t, g, unknown or other
  misc_feature (252)..(252): n is a, c, g, or t
  modified_base (338)..(338): a, c, t, g, unknown or other
  misc_feature (338)..(338): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatccaccactcccctgcactggactccaggcggtgtacgttacttgtttttaagtntgtctctggtatcagcaacacccagaccaaacgccccaaatcatctatttatgatgtacaataagtccggcccttgtagggtttcncatccgcttctcctggctcgagtctaacggactaagtacccgccctccctacgacctagttcctcgtcgggtcctaccgagggtctaagggaaacgtaaccggaggtaccttagtaatttaacgttaacgtagaccgtaacgggtactaaactaatttaaacgtttatttaacggttaccgttttaccgtaaccgggtttacggggtttacgtttccgggggaacggggtaaccggggtaaaccgttaaacgggtttccggtaaccccggtttaccgtaaacgggttcccgaaacgggaccccgttaacgggtccccgttccccggtcccccccgttcgggtaccccttaccgtttccccggtttcccggtttccccccccg

SEQ ID NO: 299266 - DNA, 533 bp, Homo sapiens
  misc_feature: GZ8MTXP01B28CQ.45.75.G09.1.454.CMB.2.raw
  modified_base (226)..(226): a, c, t, g, unknown or other
  misc_feature (226)..(226): n is a, c, g, or t
  modified_base (244)..(244): a, c, t, g, unknown or other
  misc_feature (244)..(244): n is a, c, g, or t
  modified_base (293)..(293): a, c, t, g, unknown or other
  misc_feature (293)..(293): n is a, c, g, or t
  modified_base (305)..(305): a, c, t, g, unknown or other
  misc_feature (305)..(305): n is a, c, g, or t
  modified_base (352)..(352): a, c, t, g, unknown or other
  misc_feature (352)..(352): n is a, c, g, or t
  modified_base (414)..(414): a, c, t, g, unknown or other
  misc_feature (414)..(414): n is a, c, g, or t
  modified_base (418)..(418): a, c, t, g, unknown or other
  misc_feature (418)..(418): n is a, c, g, or t
  modified_base (426)..(426): a, c, t, g, unknown or other
  misc_feature (426)..(426): n is a, c, g, or t
tcagacgcgatcgacacgaccggtgctcgatttagtatagacatcagggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtnacgttactgtttttaagntgtctctggtatcagcaacaccaggacaaagccccaaatcatcatttangatgtcaataancgcctgagggtttctaatcgcttctctcggctcaagtctggacaacnccggcctcccgtagacaatctcgtcgggctccaggctagaggacgaggctgacttatactgnttcncgtctatntagacgtaggttagttagttacgtttggtcggtacggcggaggtaactagcgtacgccgtacgtagttcgcgccgaagccgtccgcccgtcgttcctcgttcgtccg

SEQ ID NO: 299267 - DNA, 591 bp, Homo sapiens
  misc_feature: GZ8MTXP01BRAQ5.45.75.G09.1.454.CMB.2.raw
  modified_base (225)..(225): a, c, t, g, unknown or other
  misc_feature (225)..(225): n is a, c, g, or t
  modified_base (323)..(323): a, c, t, g, unknown or other
  misc_feature (323)..(323): n is a, c, g, or t
  modified_base (573)..(573): a, c, t, g, unknown or other
  misc_feature (573)..(573): n is a, c, g, or t
tcagacgcgatcgacacgaccggtgctcgatttagtatagacatcagggggggtctcaggaggcagcgctctcgggacgtctccaccagtggcctgggctctgctattcctcaccctcctcactcagggcacagggtcctgggccagtctgccctgactcagcctgcctccctgtctgggtctcctggacagtcgatcaccatccctgcactggatccagcggtnacgttacttgtttttaagatgtctctggtatcagcaacacccaggcaaacgccccaaatcatcatttatgatgtcaataatcggcctcgagggtttcncatcgcttctcctggctccaagtctaggacaagtaccggcctaccctgacctatcgtctcgggcttccgaagggcctaggaagaccggaggcttaggatttacttaacgtggaccagggacctaacgtacttactaatttacgttcgtttaccaacgttcgggtatttcgggacgggtagggaaccgtaaaggttcgacccgttcgtaaggccacggcccttaagggcccttccgccccgttcggtaccnccttcgttcgttcccccg

SEQ ID NO: 299268 - DNA, 750 bp, Homo sapiens
  misc_feature: GZ8MTXP01B2YC1.45.75.G09.1.454.CMB.2.raw
  modified_base (262)..(262): a, c, t, g, unknown or other
  misc_feature (262)..(262): n is a, c, g, or t
  modified_base (276)..(276): a, c, t, g, unknown or other
  misc_feature (276)..(276): n is a, c, g, or t
tcagacgcgatcgacacgaccggtgctcgatttagtatagacatcagggggctctgggagaggagcccagcactgggattccgaggtgtttccattcagtgatctgcactgaacacagaggactcgccatggagtttgggctgagctgggttttccttgttgctattttaaaaggtgtccagtctgagagcagctggtggagtcgtgggggaggcttggtccgaggcccgggggggtccctcagactctcgtgtgcagcctntggattcgaccgtnagtgcagtcttccgtgacgcgtcgggtcccgccgaggcctccggaagggggaacgggccgtgggacggttgggtctcgtaagtttaaagttttttacgactaagggccaacgtacggaccgttacgtaaaccgactaaggtacgtttacccgggttaaaggggccctaagttccaaacctacgtcctaccgaagtaacgaaccgtaaacttcccgaaaggtaaccgtacgggttacgttttaccgtaagtaaaacttacggaaaccctaccccggttaggaaacccggacccccggaaagggaaccctaacccgggactttaccgttaaattaacgtttacctgggttaccgcggtaaagacgttaaacgtaccccggaaaacccgacggaaaccccgaaagttaaactttaccgtaaaccgtaaccttaacggtaacggtacgttacgggtaaccggttcggtaacccggggg

SEQ ID NO: 299269 - DNA, 565 bp, Homo sapiens
  misc_feature: GZ8MTXP01AQXBR.45.75.G09.1.454.CMB.2.raw
  modified_base (229)..(229): a, c, t, g, unknown or other
  misc_feature (229)..(229): n is a, c, g, or t
  modified_base (248)..(248): a, c, t, g, unknown or other
  misc_feature (248)..(248): n is a, c, g, or t
  modified_base (300)..(300): a, c, t, g, unknown or other
  misc_feature (300)..(300): n is a, c, g, or t
  modified_base (450)..(450): a, c, t, g, unknown or other
  misc_feature (450)..(450): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctccctgtctggtctcctggacagtcgatcaccatcccctgcactggactccgagtcggtntacgttacttgttttaagntgtctctgtatcagcaacacccaggaccaaacgccccaaatcatctatttangatgtacaataactccggcctcgtaggggtttctcatcgtcttctcctggctccgaagtctaaggacctaacgtaccggccctcctcgaccctatcctcgtcggcctccgaggtctaggaagacgaggctagtattatactgcaggctanatatattagtcttccacgtcggtagtcggcggaggtaactaaggttcgaccgttcgtagtcgacgccgttacgcctaccgtccccgtcggtcttaccgttccgttcgttcccccg

SEQ ID NO: 299270 - DNA, 577 bp, Homo sapiens
  misc_feature: GZ8MTXP01A5CP0.45.75.G09.1.454.CMB.2.raw
  modified_base (244)..(244): a, c, t, g, unknown or other
  misc_feature (244)..(244): n is a, c, g, or t
  modified_base (459)..(459): a, c, t, g, unknown or other
  misc_feature (459)..(459): n is a, c, g, or t
  modified_base (549)..(549): a, c, t, g, unknown or other
  misc_feature (549)..(549): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgttttaagntgtctctggtatcagcaacacccaggacaaacgaccccaaactcatcatttatgatgtacaataaactccggtacccctcgtacgggggttttctctacttcgtcctttctcctacggtctcctaagtctaaggcaacgtaccggccctaccctagacaattctacgtgggctaccgaggctggaggacgaggtctagtattatactgctggctnactagtgacgtaggtagttagttacttgggtgtcgggtggaagggaacagtcgttacgtaccggtcgttacggttcgacgccgaggtccncggtccccttcggtcttaaccgttcccg

SEQ ID NO: 299271 - DNA, 628 bp, Homo sapiens
  misc_feature: GZ8MTXP01D4B6U.45.75.G09.1.454.CMB.2.raw
  modified_base (226)..(226): a, c, t, g, unknown or other
  misc_feature (226)..(226): n is a, c, g, or t
  modified_base (242)..(242): a, c, t, g, unknown or other
  misc_feature (242)..(242): n is a, c, g, or t
  modified_base (292)..(292): a, c, t, g, unknown or other
  misc_feature (292)..(292): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctcctgtctgggtctcctggacagtcgatcaccatcccctgcactggatccagcggtnacgttatgttttaagntgtctctggtatcagcaacaccaggcaaacgccccaaatcatctatttangatgtacaataactcggtcctgtaggggtttctctatcgtcttctcgtcggctccgaagtctaagggacctaagtaccggtcccttccctagacccagttcgttccgtgggccttaccgagggcctaggaaagtacggaggtctagtaattatactgccagactaatattaattagttagttcgtttacctacggttcgggtacggttacgggacgggtacgggaaaccctaaggttccggtaaccgttaccgttaacgggtcgaacccggccgttaacgggtcccgtcccgtcccccggttccggtccttaccgttcccttccggtttccccccc

SEQ ID NO: 299272 - DNA, 649 bp, Homo sapiens
  misc_feature: GZ8MTXP01AXVLK.45.75.G09.1.454.CMB.2.raw
  modified_base (304)..(304): a, c, t, g, unknown or other
  misc_feature (304)..(304): n is a, c, g, or t
  modified_base (566)..(566): a, c, t, g, unknown or other
  misc_feature (566)..(566): n is a, c, g, or t
tcagacgcgatcgacacgaccggtgctcgatttagtatagacatcagggggctctgggagaggagcccagcactgggattccgaggtgtttccattcagtgatctgcactgaacacagaggactcgccatggagtttgggctgagctgggttttccttgttgctattttaaaaggtgtccagtctgaggagcagctggtggagtcgtgggggaggcttgggtccgaggccgggggggtccctcgagactctcgtgtgcagcctctggattcaccgtcagtggcagcttcctgagcgtgggtccnccgaggctccgaggggaacggccgtggagtgggtctcgaagttaattttagacacggtcagagcgtactaacgcaagtacgttcccgggtaaagggcccgtattccgaacctactcctacccaggacgaactaaacgttcccgaaaggtaacctacgggtttcgtttaccgttaggtaaacttcggaaaccctacccggttaggaaccgaacccggaaggacccgaccggtcttacgtaatagttaaccgtgtcgacggaanaacgactaccgaaacccgaggaaccccggaaagttaacttcaactaactaacgtaacggtagcggtaacgttcgtaaccgggg

SEQ ID NO: 299273 - DNA, 721 bp, Homo sapiens
  misc_feature: GZ8MTXP01BKIRW.45.75.G09.1.454.CMB.2.raw
  modified_base (296)..(296): a, c, t, g, unknown or other
  misc_feature (296)..(296): n is a, c, g, or t
tcagacgcgatcgacacgaccggtgctcgatttagtatagacatcaggggagctctgggagaggagcccagcactgggattccgaggtgtttccattcagtgatctgcactgaacacagaggactcgccatggagtttgggctgagcgtggtttcctgtgctatttaaaggtgtcagtctgagagcagctggtggagtcgtgggggagcttggtccgaggccggggggtcctcgagactcgtcgtgtgcagctctggatcacgtcagtggcagtcttccgtgagcgtggggtcccnccgaggctccgaggggacgggcctgggagtgggtctcgagttaattttagaccgaggtcagtgcgtaactacgcagtacgttaccggttaacgggccgtattcacctactcctaccgagagaacctaaacgttacccgaaggtaaacgtaccgggttgtttaccgtaagtaaaacttacggaaacctaacccgttacgggaaccggaaccccggaaagggaacccgtaccgggtacgttaccgttaaatttaacgtttaaccggttggttaccgggaacggtaaaggaacggaaaccgttaacccgggaaaccccgaaacgggttaaaacccccgggaaaaggttaaaaccgtttaaccctaaactaaacccgtttaacggtaaccgggtttaacgtaaccggggttaaccgtttaacccggggg

SEQ ID NO: 299274 - DNA, 533 bp, Homo sapiens
  misc_feature: GZ8MTXP01D1E08.45.75.G09.1.454.CMB.2.raw
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgtttttaagatgtctctggtatcagcaacacccaggcaaagcccccaaatcatcatttatgatgtcaataatcggccctcaggggtttctcatcgcttctcctggctccaagtctggcaatacggcctccctgaccatctctgggctccaggctgaagacgtagctgattattactgcaggcacatatattagtgtttcacgtcggtattcgggcggagggaacctaagttgaaccgttcgtaggtcagttcccaaagggcctcgcccccgttgggtccactccttcgtttccccccg

SEQ ID NO: 299275 - DNA, 656 bp, Homo sapiens
  misc_feature: GZ8MTXP01A1P6I.45.75.G09.1.454.CMB.2.raw
  modified_base (247)..(247): a, c, t, g, unknown or other
  misc_feature (247)..(247): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctcctgtctgggtctcctggacagtcgatcaccatcccctgcactggactccagcggtgtacgttacttgttttaagtntgtctctggtatcagcaacaccaggacaaacgccccaaactcatctatttatgtatgtactaataacgtccggtcctcgtaggggtttctctacttcgtcttctccgtggtctaccgaagtcgtaacgggacctaacgtaccgggtcccttaccctacggtaccctacgttccgttcggtcgggtccttaccgacgggtcgtaggaaacggacggacggtctagtaacttattacgtgacaggactatatagttacgttagttcgtttaccgtacgttcgggttacgttacggggtacgggacgggtaacgtaacggttcgaccgttaccgtacggtcgacggcccgttaacgggtccgttacccggcccccgttcgggtacccttaccgttccgttcccgttcccccg

SEQ ID NO: 299276 - DNA, 643 bp, Homo sapiens
  misc_feature: GZ8MTXP01CU91A.45.75.G09.1.454.CMB.2.raw
  modified_base (242)..(242): a, c, t, g, unknown or other
  misc_feature (242)..(242): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctcctgtctgggtctctggacagtcgatcaccatccctgcactggatccagcggtgacgttactgtttttaagntgtctctgtatcagcaacaccagacaaacgcccaaatcatcatttatgatgtacaataatcggcctgtaggggttctcactcgtcttctcctggtactccgaagtctagggactaacgtaccggtccctacccgtacgacctacttctcgtcggtctccgaggtcgtaggaaacgacggaagcgttagtaattaagttactagacaacgggtactaaactaattaacttaaagtttacgttcgtttaccgtaccggttacggggttacgtttaccggggacgggtaaaccggggtaacctaaacggggttcgtaccggttacccgttaacgggtccgaacggcccgaacgggtcctccggtccccgttcgggtccttaccgtcccgttccgttaacccccg

SEQ ID NO: 299277 - DNA, 679 bp, Homo sapiens
  misc_feature: GZ8MTXP01EJN0D.45.75.G09.1.454.CMB.2.raw
  modified_base (251)..(251): a, c, t, g, unknown or other
  misc_feature (251)..(251): n is a, c, g, or t
  modified_base (304)..(304): a, c, t, g, unknown or other
  misc_feature (304)..(304): n is a, c, g, or t
tcagacgcgatcgacacgaccggtgctcgatttagtatagacatcagggggggggtctcaggaggcagcgctctcgggacgtctccaccatggcctgggctctgctattcctcaccctcctcactcagggcacagggtcctgggcccagtctgccctgactcagcctgcctcctgtctgggtctcctggacagtcgatccaccactcccctgcactggactccgagcggtgtacgtttacttgtttttaantcgtctcgtgtatcagacaacaccagacaaacgccccaaatcatactatttangatgtactaaatactccggtccctacgtagggtttcactatccgtcttctcgtcggtactacgtaagttccgtaaggacctaacgtcccggtcccttcccgtacgaacctcgtccgtcgtcgggtacctaccgaggtcaaggaagaccggtaggtactagtaattaacttgacgactagactaagttattaagttaacgttacgttccgtttaccgtaccgggtttagggttaccgttaccggggacggtaaacgggtaaccgttaacgggttcggtaacccgttcgttaaccggtacacccgggttccgaaaccggtcccgtccccgtccccgttccggtaccttacccgttcccgtttcccggtttccccccg

SEQ ID NO: 299278 - DNA, 578 bp, Homo sapiens
  misc_feature: GZ8MTXP01ANST1.45.75.G09.1.454.CMB.2.raw
tcagacgcgatcgacacgaccggtgctcgatttagtatagacatcagggggggtctcaggaggcagcgctctcgggacgtctccaccatggcctgggctctgctattcctcaccctcctcactcagggcacagggtcctgggaccagtctgccctgactcagcctgcctccctgtctgggtctcctggacagtcgatcaccatcccctgcactggatccagcggtgtacgttactgtttttaagattgtctcctggtatcagcaacaccaggcaaacgccccaaactcatctatttatgatagtacaataaatccggcccttcgaaggggtttcctctattcgctttctcctcggctccaagtctaggcaataccggccctcctcgacctatctcgtggctcgaggctagaagacgaggtctagattagtactgacaggcaactataacttattacgtcgtttaccgacgttcggggtacttcggacgggtagggaacccgtaagttcggaaccgttccgtaagggtccacgccttaaggcctccgccccgtcggtaccttccgtcttccggttcccc

SEQ ID NO: 299279 - DNA, 740 bp, Homo sapiens
  misc_feature: GZ8MTXP01DLHJ7.45.75.G09.1.454.CMB.2.raw
  modified_base (313)..(313): a, c, t, g, unknown or other
  misc_feature (313)..(313): n is a, c, g, or t
tcagacgcgatcgacacgaccggtgctcgatttagtatagacatcagggggggggtctcaggaggcagcgctctcgggacgtctccaccatggcctgggctttgctattcctcaccctcctcactcagggcacagggtcctgggcccagtctgccctgactcagcctgcctccctgtctgggtctccgtgacagtcgatcaccactcccctgcactggactccgaggcggtagtacgtttacttagtttttaagtatgtctccgttagtatcagacaacaccaggacaacgaccccaaactcatctaatttanagtattagtacaaattaaccgttccggtacccttacggttacgggggttttacctcgtacttccgttcttccgttccgttccgggtacccttaaccgaacggtttccgttacgggaaacctaaaccggttcccggtacccttaccccgttacgaaccctacttcgtccggtcgggtacctaccgaggtctaggaacggacggaacgggtcttagtaactttacttacgtagaacctacgtactaaactagtttaacttagtttacggttacgtttacccgtacggttacggggttacgttacggggtacgggtaacgggtaaccgttaaaggttcggaccgttaccgttaacggtccgaccgttacccggacggttcccgtccgtccccgtcggtacctcgttcccttaacccgttcccctaacccc

SEQ ID NO: 299280 - DNA, 650 bp, Homo sapiens
  misc_feature: GZ8MTXP01BEJ22.45.75.G09.1.454.CMB.2.raw
  modified_base (246)..(246): a, c, t, g, unknown or other
  misc_feature (246)..(246): n is a, c, g, or t
  modified_base (407)..(407): a, c, t, g, unknown or other
  misc_feature (407)..(407): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggactccagcggtgacgttacttgttttaagntgtctctggtatcagcaacaccaggacaaacgccccaaactcatcatttatgatgtacaaataactccggtccctcgtaacgggggtttctctactcgtcttctccgtcggtctccaagtctagggactaacgtaccgggtccctcccgtacgtaaccctntccttcggtcggggtaccttccggagggcgttacggaaacgaccggtaagggtcctaggtaatttacttaaccgttgtaccggtacggacctaacttaattaacttaagtttacggttacgtttcccgtaaacggttcgggttaacgttcgggacgggtacgggtaaccgtaaggttcgtacccgttcgtacggtcacgttccgacgtcctccgccccgtcgtcttactccgttccgttcccc

SEQ ID NO: 299281 - DNA, 686 bp, Homo sapiens
  misc_feature: GZ8MTXP01COEYG.45.75.G09.1.454.CMB.2.raw
  modified_base (227)..(227): a, c, t, g, unknown or other
  misc_feature (227)..(227): n is a, c, g, or t
  modified_base (245)..(245): a, c, t, g, unknown or other
  misc_feature (245)..(245): n is a, c, g, or t
tcagacgcgatcgacacgaccggtgctcgatttagtatagacatcgaggggggggtctcaggaggcagcgctctcgggacgtctccaccatggcctgggctctgctattcctcaccctcctcactcagggcacagggtcctgggcccagtctgccctgactcagcctgcctcctgtctgggtctctggacagtcgatcaccatccctgcactggactccgagcggtntacgttatgtttttaagntcgtctcgtgtatcacacaacaccgacgaccaaaccacccaactcatactatttatgtatagtactaactacgtccggtccgttacggtacggttctactactcgtcttctccgtcgtctacgtacgtcgtaacgacctaacgtcccgtccctacccgtacgacctactcgtcgtcgtacctcgacggtacgtaaggaacggacggtacgtacgttagtaacttacgtacgtacgtacgacggtaactaacttaattaagttacgtttacgttacgttaccggtacggttacggggtacgttaccggggacgggtaacgggtaaccgtaacgggttaccggtacccgttacggtaacggtaccgaccggttacccgttaccggtcccgtaccccggtccccgttcggtaccgttacccgttcccgttccccgttaaccccg

SEQ ID NO: 299282 - DNA, 763 bp, Homo sapiens
  misc_feature: GZ8MTXP01CMF2K.45.75.G09.1.454.CMB.2.raw
tcagacgcgatcgacacgaccggtgctcgatttagtatagacatcagggggctctgggagaggagcccagcactgggattccgaggtgtttccattcagtgatctgcactgaacacagaggactcgccatggagtttgggctgagctggtttcctgttgctatttaaaaggtgtccagtctgaggagcagctggtggagtcgtgggggaggtcgttgggtccgaggccgggggggtccctcgagactcgtcgtgtgcagcctcgtggtacttcgaaccgtgaggtggcagtccttccgtgacgtcgtcgggtcccgccgaggcctccggagggggacgggccgtgggacggttggggtctacgtaagtttaagtttttacggacgtacggccacgaggtaccgtactaaccggactaacggtacgtttacccgggttaaagggccctattccaacctactccctacgaagacgtaactaaacgttacccgaacggtaacgtacggttacggtttacttagtaaactacggaaaccctacccgggtaggaaccggtaccccggaaaggaacccgtaaccgggctttaccgtaaagtttacgtttaaccgtcggttagaccggtaaaggtaacgacggtaaaccccggaaaccccgtaaacgggaaccccgggttaaaagttaaaccgttttaacccgaactaaaaccggttaacgttaacgggttaaacggttaccgggtaacccggttcgggtaacccggggg

SEQ ID NO: 299283 - DNA, 579 bp, Homo sapiens
  misc_feature: GZ8MTXP01D3S9Q.45.75.G09.1.454.CMB.2.raw
  modified_base (297)..(297): a, c, t, g, unknown or other
  misc_feature (297)..(297): n is a, c, g, or t
  modified_base (434)..(434): a, c, t, g, unknown or other
  misc_feature (434)..(434): n is a, c, g, or t
  modified_base (444)..(444): a, c, t, g, unknown or other
  misc_feature (444)..(444): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgatggttgggattataccttgtctctggtacaacagcaccaggacaaacgccccaaactcatgtatttagngaggcagtaagccggtcctcgtagggtttctaagtcgtcttctcgtcggctcgaagtctcggaccaacgccggccctcccgtagactactctacgtcgggtctcgaggctaggaggacgaggtctagtattattacngactgtactntatatgacgtaggttagtagtttacgtttgggtcggttacgggcgggtaacgggaacaaggttcgtcgttaccgtcgtaggttcgacgacccgtaaggcctccgaccccgtggttcctaacttccgttaaccccg

SEQ ID NO: 299284 - DNA, 562 bp, Homo sapiens
  misc_feature: GZ8MTXP01DYHP1.45.75.G09.1.454.CMB.2.raw
  modified_base (354)..(354): a, c, t, g, unknown or other
  misc_feature (354)..(354): n is a, c, g, or t
  modified_base (368)..(368): a, c, t, g, unknown or other
  misc_feature (368)..(368): n is a, c, g, or t
  modified_base (474)..(474): a, c, t, g, unknown or other
  misc_feature (474)..(474): n is a, c, g, or t
  modified_base (487)..(487): a, c, t, g, unknown or other
  misc_feature (487)..(487): n is a, c, g, or t
  modified_base (539)..(539): a, c, t, g, unknown or other
  misc_feature (539)..(539): n is a, c, g, or t
tcagacgcgatcgacacgaccggtgctcgatttagtatagacatcagggggctctgggagaggagcccagcactgggattccgaggtgtttccattcagtgatctgcactgaacacagaggactcgccatggagtttgggctgagctgggttttccttgttgctattttaaaaggtgtccagtctgaggagcagctggtggagtctgggggaggcttggtccgaggccgggggggtcctcagactctcgtgtgcagcctctggattcaccgtcagtggcagcttcctgagctgggtccgccaggctccgagggaagggcctggagtgggtctcgagtaattttagactaggcanagcgtactaacgcngattccgttaaagggccgtattcaccatctaccagagacattccaaggtacacggtgttcttagaaattcgaacaccgtgacgacccgaggacacggctcgtaatnttactgtgcgaangatccgaaacccaggaaccccggaaagaacttcaacaactaacgtacggtanacgggtaacgttcgtaacggggg

SEQ ID NO: 299285 - DNA, 612 bp, Homo sapiens
  misc_feature: GZ8MTXP01ELW30.45.75.G09.1.454.CMB.2.raw
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttacttgtttttaagtatgtctctggtatcagcaacaccaggcaaacgaccccaaactcatcatttatgatgtacaataactcggccctcgtaggggtttctctactcgcttctcctgctccaagtctggacaatcggccctccctgaccatctcgtggctcgaggtctagaacgacggaggtctaggtattattacgtgacaggactaactattaattattaagttcgtttaccgaacgttcgggtaagttccgggacgggaaggggtaaccctaaggtttccgaacccggttaccgtacgggttccgacggcccgaaacgggcccgttcccggtccccccgtccgggttccttaccgttccccgtttccgtttccccccg

SEQ ID NO: 299286 - DNA, 786 bp, Homo sapiens
  misc_feature: GZ8MTXP01BQHV7.45.75.G09.1.454.CMB.2.raw
  modified_base (301)..(301): a, c, t, g, unknown or other
  misc_feature (301)..(301): n is a, c, g, or t
  modified_base (334)..(334): a, c, t, g, unknown or other
  misc_feature (334)..(334): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggactccagcggtgtacgtttacttgtttttaagatgtctcctggtatcagcaacacccaggacaaacgccccaaatcatcatttangatgtacaataactccggcctcgtagggtttcncatcgcttctccgtcggctcaagtctagggacctaacgtaccggccctacccgtagaccctatccgttccgtcggggtcccttacccggaagggccgttaacgggaaacggtaaccgggtaacgggtaccgttaggtaacttttaaacttacgttacgggacccaaggggtaccctaaacgttaactttaaactttaagttttaaacggttccgtttttaacccggtaaaccgggttttccgggggttaaccggtttacgggggacccgggggtaaacggggtaaaccccggttaaaagggtttccgggtaaaccccggtttacccggttaaacgggttacccgaaaccggttaacccccgggaaagggtcccccgttccccgggaacccccccgtttaccgggggtacccttaccccgtttccccggtttccccggggttttccccccccg

SEQ ID NO: 299287 - DNA, 733 bp, Homo sapiens
  misc_feature: GZ8MTXP01DFEWW.45.75.G09.1.454.CMB.2.raw
  modified_base (267)..(267): a, c, t, g, unknown or other
  misc_feature (267)..(267): n is a, c, g, or t
tcagacgcgatcgacacgaccggtgctcgatttagtatagacatcagggggggagaggagcccagcactgggattccgaggtgtttccattcagtgatctgcactgaacacagaggactcgccatggagtttgggctgagctgggttttccttgttgcttattttaaaaggtgtccagtctgaggagcagctggtggaggtcgtgggggaggtcgttgggtccgacgggcccgggggggtccctcgagacctctcgtgtgcagcctntggacttcaccgtcagtgcagctcctgacgcgtcgggtcccgcgaggcctcggaggggaacgggtccgtggaggtgggtctacgttaagtttaatttttagacgaggcaacgtacgtacgtactacggactaaggtaacgtttaccggtaacgggtccgtaacttaccacctactcctaccgaagtacgtaaacctaaacgttaccgaaaggtaaaccgttaaccgggtttagttttaccgttaaaggtaaacttacggaaaacccctacccggttaggaacccggaacccgggggtaaacggaaccgtaaccggttacttaccgttaagttacgttaaccgtggtacgacgtaggaactacgtaacccgaaacccttaagggaaaccccgaaagttaaactaccgttaaacacgttaacgtaacgtagtcggtcgtacggttacgggaaccgaacgggtaacccc

SEQ ID NO: 299288 - DNA, 567 bp, Homo sapiens
  misc_feature: GZ8MTXP01A03UF.45.75.G09.1.454.CMB.2.raw
  modified_base (374)..(374): a, c, t, g, unknown or other
  misc_feature (374)..(374): n is a, c, g, or t
  modified_base (477)..(477): a, c, t, g, unknown or other
  misc_feature (477)..(477): n is a, c, g, or t
  modified_base (544)..(544): a, c, t, g, unknown or other
  misc_feature (544)..(544): n is a, c, g, or t
tcagacgcgatcgacacgaccggtgctcgatttagtatagacatcagggggctctgggagaggagcccagcactgggattccgaggtgtttccattcagtgatctgcactgaacacagaggactcgccatggagtttgggctgagctgggttttccttgttgctattttaaaaggtgtccagtctgaggagcagctggtggagtcgtgggggaggcttgggtccaggccgggggggtccctcgagactctcgtgtgcagcctctggattcaccgtcagtggcagcttcctgagctgggtccgccaggcctccgaggggaagggcctgggagtgggtctcgagttaattttagacaggcagagcgtactaacgcngacttccgtaagggcctatcacatctcagagacattcaaggactacgtgtttactagaaatcgaacaccgtagacgaccgaggacacggctactatattaccngtcgcgaagagagtaccgaaaccgacggaacccgaagttaaacttcgtaacaacgtaacaccggtancgggtaacgttcggtaaccgggg

SEQ ID NO: 299289 - DNA, 680 bp, Homo sapiens
  misc_feature: GZ8MTXP01DPAC6.45.75.G09.1.454.CMB.2.raw
  modified_base (223)..(223): a, c, t, g, unknown or other
  misc_feature (223)..(223): n is a, c, g, or t
  modified_base (239)..(239): a, c, t, g, unknown or other
  misc_feature (239)..(239): n is a, c, g, or t
  modified_base (290)..(291): a, c, t, g, unknown or other
  misc_feature (290)..(291): n is a, c, g, or t
  modified_base (320)..(320): a, c, t, g, unknown or other
  misc_feature (320)..(320): n is a, c, g, or t
tcagacgcgatcgacacgaccggtgctcgatttagtatagacatcgaggggggggtctcaggaggcagtgctctcgggacgtctccaccatggcctgggctctgctattcctcaccctcctcactcagggcacagggtcctgggcccagtctgccctgactcagcctgcctcctgtctgggtctctggacagtcgatcacatccctgcactgatccagcggtnagttactgttttaagntgtctctgtatcagcaaacaccaggacaaacgccccaaatcatcatttaannatatacaatacgtcgtcctgtacggttcntactcgtcttctccgtgtactacgagtcgtaacgactaacgtaccgtccctacccgtacgacctacgttcgtcgtcgggtactaccgacggtacgtaacggaaacggtacggacggtacgtaagttaagttaacgttaacgtacgtacgaacggtaactaaacgtaaattaacgttaacgtttaacgtttacgtttaccgttaaccggttacgggttacgggttaccggggtacgggtaacgggtaaacggtaacggttacggttaccggttaccggttaaccggtaccgaaccgttaccgaccggtaaccgtcccggtccccgtcccgtacccgttaccttccgttcccgttaaccccg

SEQ ID NO: 299290 - DNA, 621 bp, Homo sapiens
  misc_feature: GZ8MTXP01A3L0F.45.75.G09.1.454.CMB.2.raw
  modified_base (203)..(203): a, c, t, g, unknown or other
  misc_feature (203)..(203): n is a, c, g, or t
  modified_base (255)..(255): a, c, t, g, unknown or other
  misc_feature (255)..(255): n is a, c, g, or t
  modified_base (479)..(479): a, c, t, g, unknown or other
  misc_feature (479)..(479): n is a, c, g, or t
tcagacgcgatcgacacgaccggtgctcgatttagtatagacatcagggggggggtctcaggaggcagcgctctcgggacgtctccaccatggcctgggctctgctattcctcaccctcctcactcagggcacagggtcctgggcccagtctgccctgactcagcctgcctcctgtctgggtctcctggacagtcgatcaccnctcccctgcacgtggactccgagcggtagtacgtttacttagtttttaaagntgtctcctggtatcagcaaacaccaggacaaaccgtaccccaaactcatctatttatagatgtacaaataactccggcctcgtagggtttctactatcgtcttctctcggctacaacgtctaacggactaacgtacgccctccacgaccatctcgtcggtactccgagctagaaagacgcgtatagtattactactgactaggacactataacttattacgttnttacgtacgttcgggtacgttcggacggtaacgggtaactaaaggttcgtaccggttaccgtaacggttacgaaccgccgttaacggtccgttcccgtcccccggttggtacccttactttcccgttcccgtttaacccccc

SEQ ID NO: 299291 - DNA, 775 bp, Homo sapiens
  misc_feature: GZ8MTXP01BI0UG.45.75.G09.1.454.CMB.2.raw
  modified_base (300)..(300): a, c, t, g, unknown or other
  misc_feature (300)..(300): n is a, c, g, or t
tcagacgcgatcgacacgaccggtgctcgatttagtatagacatcaggggagctctgggagaggagcccagcactgggattccgaggtgtttccattcagtgatctgcactgaacacagaggactcgccatggagtttgggctgagcttgggttttccttgttgctaattttaaaaggtgtccagtctgaggagcagcgtggtggagtcgtgggggagcgttggtccgacggcccggggggtccctcgagactcgtcgtgtgcagcctctggacttcgaccgtcaggtggcagtcttccnggacgtcgtcgggtcccgccgaggcctccgaggggaacgggccgtgggagtgggtctacgtaagtttaagtttttacgaccgaggacaacgtacgtaccgtaaaccgttacgcgtaagtaacgtttacccgggttaacgggcctaacgttccaaccctatcctaccgaagaacgaacctaacgttaccgaaggtaaaccgttacgggttgtttaccgttaaggtaaaacttaccggaaacccgtaaccccgttagggaaacccgtaccccgggaaaggaacccgtaccgggtacctttaacgttaattaaccgtttaacgtcggtagaaccggaagacggtaaaccgacccggaaaaccccgaacggttaaacccccgggttaaaaagttaaaaccgtttaaccctaaaaccgtaaccgttaaacccggttaacgggttaacgttaaccgggggttaacccgtttaacccggggg

SEQ ID NO: 299292 - DNA, 755 bp, Homo sapiens
  misc_feature: GZ8MTXP01BK6AJ.45.75.G09.1.454.CMB.2.raw
  modified_base (310)..(310): a, c, t, g, unknown or other
  misc_feature (310)..(310): n is a, c, g, or t
  modified_base (323)..(323): a, c, t, g, unknown or other
  misc_feature (323)..(323): n is a, c, g, or t
tcagacgcgatcgacacgaccggtgctcgatttagtatagacatcagggggggggtctcaggaggcagcgctctcgggacgtctccaccatggcctgggctctgctattcctcaccctcctcactcagggcacagggtcctgggcccagtctgccctgactcagcctgcctcctgtctgggtctcctggacagtcgatcacactcccctgcactggactccgagcggtatacgtttacttagtttttaagtattgtcttcgtggtatcagacaaacaccgaggacaaacgaccccaaatcatactattangatgacaataacnccggtacctgtaggtttcacgtactcgtcttctccgtcggtactacgaacgtctaacggactaacgtaccggtccctaccctacgacctactctcgcgggtcctaccgaggtacgtagaaacggtacggacggtacttaggtaaactttaacttaacgtacggaccaacggggtaactaaacttaaagttaaattttaaaccgtttaacggtttaccgtttaaccgtaaaccggggtttcgggggttaaacgtttaccgggggaacgggtaaaccgggtaaaaccggttaacgtttacccgggggtaaccgttaccgggtaaacgggttacgaaaccggttaccccgaaaccggggtttcccgtacccccgggtcccccgtttaacggggtaccccttacccggtttcccgtttcccggggttccccccccg

SEQ ID NO: 299293 - DNA, 697 bp, Homo sapiens
  misc_feature: GZ8MTXP01BKV98.45.75.G09.1.454.CMB.2.raw
  modified_base (246)..(246): a, c, t, g, unknown or other
  misc_feature (246)..(246): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgtttttaagtntgtctcctggtatcagcaacacccaggacaaacgaccccaactcatctatttatgatgtactaataagtcggccctcgtaggggtttctcactcgtcttctctcggctccgaagtctacgggtacaacgtaccgcccgttccctacgtaacctcttcgtccgtcgggtccttacccgagggtaccgtacggaaacggacgggtaacgggtcttaagtaagtttaacttacgttacgacgaacgggactaacctaattaatttaagtttacggttacgtttacccgtacggttcggggttacgttccggggtaccgggtaacgggtaaacccgtaacggtttaccggtacccggttaccgtaacgggtccgttaccgggttccccgaaacgggtccccgtcccgtccccccggttcgggtccccttaccgttcccgttcccgtttccccccg

SEQ ID NO: 299294 - DNA, 601 bp, Homo sapiens
  misc_feature: GZ8MTXP01EREHA.45.75.G09.1.454.CMB.2.raw
  modified_base (263)..(263): a, c, t, g, unknown or other
  misc_feature (263)..(263): n is a, c, g, or t
  modified_base (297)..(297): a, c, t, g, unknown or other
  misc_feature (297)..(297): n is a, c, g, or t
  modified_base (370)..(370): a, c, t, g, unknown or other
  misc_feature (370)..(370): n is a, c, g, or t
  modified_base (384)..(384): a, c, t, g, unknown or other
  misc_feature (384)..(384): n is a, c, g, or t
  modified_base (415)..(415): a, c, t, g, unknown or other
  misc_feature (415)..(415): n is a, c, g, or t
tcagacgcgatcgacacgaccggtgctcgatttagtatagacatcagggggggggtctcaggaggcagcgctctcgggacgtctccaccatggcctgggctctgctattcctcaccctcctcactcaggacacagggtcctgggcccagtctgccctgactcagcctgcctccgtgtctgggtctcctggacagtcgatcaccatctcctgcactggaaccagcagtgatggttagggattatacttgtctctagtaccaacngcaccaggacaaacgccccaaactcatgattagngaggcagaagcgcctcgtaggtttacatcgcttctctcgctacagtctggaacacgccgcctcctgactatcncgtggctcgagtcnggaaggagagcttagtattaagtactgctcncgtactatgtagcgtaaggttgttacgtttacgtttgggtcggttcgggacggggtaacgggaaccgtaacggttacggtacggttaaaccccggttcggtaacggttaccgaacccggacccgtaacggggtcccctaacccgggtcccccggttggttacccctaaccgtttcccgttcccccg

SEQ ID NO: 299295 - DNA, 720 bp, Homo sapiens
  misc_feature: GZ8MTXP01AIEJW.45.75.G09.1.454.CMB.2.raw
  modified_base (257)..(257): a, c, t, g, unknown or other
  misc_feature (257)..(257): n is a, c, g, or t
tcagacgcgatcgacacgaccggtgctcgatttagtatagacatcagggggggggtctcaggaggcagcgctctcgggacgtctccaccatggcctgggctctgctattcctcaccctcctcactcagggcacagggtcctgggcccagtctgccctgactcagcctgcctcctgtctgggtctcctggacagtcatccaccactcccctgccactggactccgagtcggtagtacgtttacttagtttttaaagtntcgtctcgtagtatcacgaccaaccaccgacgaaccaaaccgacccctaaactctatactaatttatagtatacgtaactaacgtacgtccggtaccgttacggttacgggtttcctactacgttccgtctttcgtccgtcggtactaccgtacgtcgtaacgactaaccgtcccgtccctacccgtacgtacctactcgtcgtcggtaccgtaccggacggtacgtaacggaacggacggtacggtacgttagttaacttacgttacgtacgacgtaacgtaactaaacgttaattaacgtttaagtttacgtttcgtttaccgtacgggttacgggttacggttacggggtacgggtaacgggtaacgtaacggttaccggtaccgttacggtacggtaccgaccggccgttacggtcccgtcccgtccccgtcgtaccttaccgttcccgttcccgtccc

SEQ ID NO: 299296 - DNA, 612 bp, Homo sapiens
  misc_feature: GZ8MTXP01B03CN.45.75.G09.1.454.CMB.2.raw
  modified_base (250)..(250): a, c, t, g, unknown or other
  misc_feature (250)..(250): n is a, c, g, or t
  modified_base (300)..(300): a, c, t, g, unknown or other
  misc_feature (300)..(300): n is a, c, g, or t
tcagacgcgatcgacacgaccggtgctcgatttagtatagacatcagggggggggtctcaggaggcagcgctctcgggacgtctccaccatggcctgggctctgctattcctcaccctcctcactcagggcacagggtcctgggcccagtctgccctgactcagcctgcctcctgtctgggtctcctggacagtcgatcaccactcccctgcactggactccgagcggtgtacgttacttgtttttaagntgtctctggtatcagcaacaccagacaaacgaccccaatcatctatttangatgtacaataactcggccctgtagggtttctcatcgtcttctccgtcggtctaccgaacgttcgtaagggacctaacgtacccgggtcccttacccgtacgaccctactcgtcgtcgggtctaccgacggcgtaggaacgacggtaggtctaggtattatacgtcgacaggtacaataattagttaattagttcgttacctacggttcggttacgttcgggacgggacggtaacgtaacgttcggaccgttcgtacggtcacgccgacggtcctccgtccccgtcggtcttaccgtccgttccgttccccg

SEQ ID NO: 299297 - DNA, 671 bp, Homo sapiens
  misc_feature: GZ8MTXP01CC5CF.45.75.G09.1.454.CMB.2.raw
  modified_base (303)..(303): a, c, t, g, unknown or other
  misc_feature (303)..(303): n is a, c, g, or t
tcagacgcgatcgacacgaccggtgctcgatttagtatagacatcagggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccactcccctgcactggatccaggcggtgtacgttacttagtttttaagtatgtctctggtatcagcaacaccaggacaaacgccccaaatcatctatttangatgtacaaataactccggccctgtacgggttctctatcgtcttctccgtcggtctacgtaagtcgtaacggactaacgtacccggtccctaccctacgaccctagttcctcggtacgggtctaccggaggtccgtaaggaaacgacggtaggtactagtaattacgtacgtgactaggactaactattacttagttcgttacgttccgtaacgtcggggttaacgtccggggacgggtaacgggtaacctaaaggttccggtaaccggttccgtaacgggtcccgaaccggttcccggttaacgggtcccgttaccccggtcccccgttcgggtacccttccgttccccggttcccgttcccccccg

SEQ ID NO: 299298 - DNA, 654 bp, Homo sapiens
  misc_feature: GZ8MTXP01B655R.45.75.G09.1.454.CMB.2.raw
  modified_base (248)..(248): a, c, t, g, unknown or other
  misc_feature (248)..(248): n is a, c, g, or t
  modified_base (336)..(336): a, c, t, g, unknown or other
  misc_feature (336)..(336): n is a, c, g, or t
tcagacgcgatcgacacgaccggtgctcgatttagtatagacatcagggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccactcccctgcactggactccaggcggtgacgttattgttttaagntgtctcgtggtatcagcaacaccaggacaaacgccccaaatcatctatttatgatgtacaaatacgtccggccctacgtagggtttcnacttcgcttctaccgtcggtacttaccgaagttcctaacgggtacctaacgtcccgggtcccttaccccgtagaccctacgtcttcggtcggggactccgaggtacgtacggaaaggtaccggaggtaccttaggtaacttacgtacgtgaactacggacttaactagttaacgttatttcgttacgtttaccgtacgggttcgggttaacgtcgggacggtaagggtaacccgtaagttcgaccgttacgtaggtaccgacgttcccgaggtcctcccgtccccgttggtacttcccgttcgttccgttaacccccg

SEQ ID NO: 299299 - DNA, 774 bp, Homo sapiens
  misc_feature: GZ8MTXP01EHKWV.45.75.G09.1.454.CMB.2.raw
  modified_base (245)..(245): a, c, t, g, unknown or other
  misc_feature (245)..(245): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgtttttaagntgtctctggtatcagcaacaccaggacaaacgcccccaaatcatctaatttatagatgtacaaattaagtccggcccttcgtaaggggtttctctatcgtcttctcctggctaccaagttcctagggactaacgtaccgggcccttccctacgtaccctatcgtccgtggggtcctacccgaggtcctaggaaaggaaccggtagggtaccttaggtaactttaacgtttaaacgttcggtacccgtaaggggaacctaaaccttaagttaaactttaagttttaaacggttcccggtttttacccgtaaaccgggttttacgggggtttaaaccggttttccgggggaaccgggggtttaaacggggaaaccccggttaaacggttttaccggggtaaaccccggtttaccggttaaaccggggttaccgaacccggttaccccgggaaaccggggttccgtaccccggtccccccggttaccgggttacccgttaccctttcccgtttcccggttttaacccccccg

SEQ ID NO: 299300 - DNA, 641 bp, Homo sapiens
  misc_feature: GZ8MTXP01DN37Y.45.75.G09.1.454.CMB.2.raw
  modified_base (253)..(253): a, c, t, g, unknown or other
  misc_feature (253)..(253): n is a, c, g, or t
tcagacgcgatcgacacgaccggtgctcgatttagtatagacatcaggggggggtctcaggaggcagcgctctcgggacgtctccaccatggcctgggctttgctattcctcaccctcctcactcagggcacagggtcctgggcccagtctgcccctgactcagcctgcctccctgtctgggtctcctggacagtcgatcaccactcccctgcactggactccaggcggtgtacgtttacttgtttttaagtntgtctccgtggtatcagcaaacacccaggaccaaacgacccccaaatcatctatttatgatgtacaaataactccggtcctcgtacgggtttctacgtattccgtcttctctcggcctacagtctgaaccaatccggccctcccgtacgacctatcgtcgtcgggtctccgagctagaagacgaggtctagtaacttatactgactacgctaactaattaattagttagtttcgtttacctacggttacggggttacgttcgggacgggtacgggtaacgtaacggttcgaccgttccgttagggttccacggttacccgttacgggttccctcccggtacccccgtcggttccctacccgttccgttcccgttaacccccttccccg

SEQ ID NO: 299301 - DNA, 687 bp, Homo sapiens
  misc_feature: GZ8MTXP01A7M28.45.75.G09.1.454.CMB.2.raw
tcagacgcgatcgacacgaccggtgctcgatttagtatagacatcagggggctctgggagaggagcccagcactgggattccgaggtgtttccattcagtgatctgcactgaacacagaggactcgccatggagtttgggctgagctgggttttccttgttgctattttaaaaggtgtccagtctgaggagcagctggtggagtcgtgggggagcgttggtccgaggccgggggggtcctcgagactctcgtgtgcagcctctggattcaccgtcagtggcagcttcctgagcgtgggtcccgccgaggcctccgaggggaacgggccgtggagtgggtctcaagttaattttagacaggcagagcgtactaacgcaagacttccggtaaagggcccgtattcgacctatcctaccgagacgactaacttcccgaaaggtaaccgtacgggttcgtttacgttagtaaacgtcgaaacccgtacccgttacggaacgaaccccggagggtaaccaaccgggtaccttaccgttaattaacgtttacgtacggttcggacggaacggtaaacggttaccgtaccccggaaaccccgtaaacggaaaccccgggttaaaagttaaaccgtttaccaacctaaaccgttaacgtaacggtagttacgggtaaccgttcggtaaccggggg

SEQ ID NO: 299302 - DNA, 700 bp, Homo sapiens
  misc_feature: GZ8MTXP01A9Z5Z.45.75.G09.1.454.CMB.2.raw
  modified_base (262)..(262): a, c, t, g, unknown or other
  misc_feature (262)..(262): n is a, c, g, or t
  modified_base (276)..(276): a, c, t, g, unknown or other
  misc_feature (276)..(276): n is a, c, g, or t
  modified_base (290)..(290): a, c, t, g, unknown or other
  misc_feature (290)..(290): n is a, c, g, or t
  modified_base (580)..(580): a, c, t, g, unknown or other
  misc_feature (580)..(580): n is a, c, g, or t
tcagacgcgatcgacacgaccggtgctcgatttagtatagacatcagggggggagaggagcccagcactgggattccgaggtgtttccattcagtgatctgcactgaacacagaggactcgccatggagtttgggctgagcttgggttttccttgttgcttaattttaaaaggtgtccagtctgaggagcagctggtggagtcgtgggggagcgttggtccgagggccggggggtccctcagactctcgtgtcgcacgcctntggacttcaccgtnagtgcagtcttccngacgcgttcgggtccgtcgaggccgtaccgaggggaacggccgtggagtgggtctcgtaagtttaattttagacgaggacacgacgccgtactacgcaaggtaacgtttacccgggttaacgggcccgtaatttccaccctactacctaccgaagaaccgtaactaaacttacccgaagggtaaaccgtacgggtttagttttaccgttaaggaaacttacgaaaccctacccgtagaacccggaccggaacgggaaccaccgggtactactaagttacttacgttaggngacgtaagacgacgtaacccgaaacccaggaaacccgaaagtaaacgttccaaacgttaacttacgtaacggtacgtaacggtccggttacggaccgggtaaccgaaaccgggtaacccc

SEQ ID NO: 299303 - DNA, 706 bp, Homo sapiens
  misc_feature: GZ8MTXP01E02NY.45.75.G09.1.454.CMB.2.raw
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggaccagtctgccctgactcagcctgcctcctgtctgggtctcctggacagtcgatcaccactcccctgcactggactccagcggtgacgttacttgttttaagtatgtctctggtatcagcaacaccaggacaaacgccccaaactcatctatttatgatgtacaataacgtccggtcctacgtacggggtttctctactcgtcttctcctggctcaagtctaggctaacgtccgccctcctacgacctagtcctcgtcgggtcctccgaggtcgtaggaacgtacggaggtcttagtattacttactacgacacgggactaactaagttaacttaagtttacggttacgtttacccgtaaccgggttcggggttacggttaccggggtaccggggtaacggggtaaacccggttaacggtttaccgggtaaccccggtttaccgtaaccggggttccttaaacccgggttccccgttaaacgggtccccgttccccgggttaaccccccggttccgggttaccccttacccgtttcccgtttccccgggtttaaccccccccg

SEQ ID NO: 299304 - DNA, 607 bp, Homo sapiens
  misc_feature: GZ8MTXP01EUGM7.45.75.G09.1.454.CMB.2.raw
  modified_base (251)..(251): a, c, t, g, unknown or other
  misc_feature (251)..(251): n is a, c, g, or t
  modified_base (302)..(302): a, c, t, g, unknown or other
  misc_feature (302)..(302): n is a, c, g, or t
  modified_base (335)..(335): a, c, t, g, unknown or other
  misc_feature (335)..(335): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctcctgtctgggtctcctggacagtcgatcaccactcccctgcactggactccgagcggtgtacgtttacttgtttttaagtntgtctctggtatcagcaacaccaggacaaacgccccaaactcatcatttangatgtacaataactccggcctcgtagggtttcnctatcgtcttctcgtcggtctccgtaagtctaacggactaacgtaccggtccctcccgtagtacctacttctcgtcgggtacctccggaggctaaggaacgaacggacgggtactaggtaattacttacgtagacaacggctaactaattattaagttgttcgttacgtacgtcgggttagtcgggacggtagggaactaggttcgtaccgttcgtacggtacacgccgaacgtccgtaccgccccttggtccttacgttccttccgtcccc

SEQ ID NO: 299305 - DNA, 618 bp, Homo sapiens
  misc_feature: GZ8MTXP01AKCCN.45.75.G09.1.454.CMB.2.raw
  modified_base (308)..(308): a, c, t, g, unknown or other
  misc_feature (308)..(308): n is a, c, g, or t
tcagacgcgatcgacacgaccggtgctcgatttagtatagacatcagggggggggtctcaggaggcagcgctctcgggacgtctccaccatggcctgggctctgctattcctcaccctcctcactcagggcacagggtcctgggcccagtctgccctgactcagcctgcctcctgtctggtctcctggacagtcgatccaccactcccctgcactggactccgagtcggtagtacgtttacttagtttttaagtatgtctcgtggtatcagcaacaccaggaccaaacgccccaaatcatctatttangatgtacaataactccggtcccttgtacgggtttctctacgttcgtcttctccgtcggtctaccgtaagtcctaacgggacctaacgtcccggtccctacccgtacgaccctagtcctcggtcgggtcctaccggaggtcctaaggaacgacggaggtctagtaattactactggacaaggtctaattattaagttacgtttagtcgtttaccacggttcggtacgttcgggacgggtaggtaactaggttcgaccgttcgtacgtcacgccacgtcctccgtcccgtgtccacctcgttccgtaacccc

SEQ ID NO: 299306 - DNA, 903 bp, Homo sapiens
  misc_feature: GZ8MTXP01A1QJ8.45.75.G09.1.454.CMB.2.raw
  modified_base (282)..(282): a, c, t, g, unknown or other
  misc_feature (282)..(282): n is a, c, g, or t
  modified_base (296)..(296): a, c, t, g, unknown or other
  misc_feature (296)..(296): n is a, c, g, or t
  modified_base (309)..(309): a, c, t, g, unknown or other
  misc_feature (309)..(309): n is a, c, g, or t
tcagacgcgatcgacacgaccggtgctcgatttagtatagacatcagggggggagaggagcccagcactgggattccgaggtgtttccattcagtgatctgcactgaacacagaggactcgccatggagtttgggctgagctggtattttccttgttgcttaattttaaaaggtgtccagtctgaggagcagcgtggtggagtcgtgggggaggcgttggtccgagggtcccggggggtccctcgacgtactcgtcgtgtgcagcctcgtggattcaccgtnagtgcagtcttcgngagcgtcggtccncgaggcctccggaggggacggctggaggtggtctacgtaagtttaatttttacggaactaggacctaaccgacggtaccgtaacgtacgaccgtaaaggttaacccgtttaacccgggttaaacgggtcccgttaacgttacccaaccctacgtcccttaacccgaaggtaactaaaccgtaaaccgtttacccggaaaacgggtaaaccgtttaaccgggttttacgtttttacccgttaaagggtaaaaccttaccggtaaaaccccgttaaccccggttacgggaaacccgggggtaaacccccggggaaacggggtaaccccgttacccggggttaaccctttaaccggttaaactttaacggtttaaaccgttcgggttaccggtaaacgggtaaacgaaccggtaaacccgttaaaccccgggaaaaccccggtaaaccggttaaaccccggggtaaaaaacgttaaaaccctttaccggttaaaacccttaaacccgttaaacccggttaacgggttaaacggttacccggggtaaacccgggttccggggaaaccgggggttaaacccccggtaaaaccccggggg

SEQ ID NO: 299307 - DNA, 781 bp, Homo sapiens
  misc_feature: GZ8MTXP01CZYZN.45.75.G09.1.454.CMB.2.raw
  modified_base (267)..(267): a, c, t, g, unknown or other
  misc_feature (267)..(267): n is a, c, g, or t
tcagacgcgatcgacacgaccggtgctcgatttagtatagacatcagggggggagaggagcccagcactgggattccgaggtgtttccattcagtgatctgcactgaacacagaggactcgccatggagtttgggctgagctgggttttccttgttgcttattttaaaaggtgtccagtctgaggagcagctggtggagtcgtggggggaggtcgttgggtccgacgggcccgggggggtccctcgagactcgtcgtgtgcagcctntggattcgaccgtcgagtggcagtcttcctggacgtccgttgggtcccgtcgacgggccgtaccggaagggggtaacggggcccgttggggtaacggttcgggggttaccttacgtttaaaggtttaaacgttttttttacggaacgtaggggccaacgtaccggtaccggttaaccgtacgacgtaaggtaaaccgtttacccgggttaagggggcccgtaacttacccgaacctactcccgttacccgaaagtacgaacctaaacgttaccgaaggtaaccgtaccggttagttttacctaggttaaactacgaaaccgtaccgtagaacccggacccggggaaggaaccgtacggtaccttaccgttaataacttacgtagtcgtacggagacgtaactaacccggaacccgaaacggaaccccggttaaagttaaacttcgttaaacttaaacgttacgtaacggtacgtcggtacggtcgttacggggtaaccgaaacgggtaaccccg

SEQ ID NO: 299308 - DNA, 620 bp, Homo sapiens
  misc_feature: GZ8MTXP01AJPHP.45.75.G09.1.454.CMB.2.raw
  modified_base (246)..(246): a, c, t, g, unknown or other
  misc_feature (246)..(246): n is a, c, g, or t
  modified_base (297)..(297): a, c, t, g, unknown or other
  misc_feature (297)..(297): n is a, c, g, or t
  modified_base (327)..(327): a, c, t, g, unknown or other
  misc_feature (327)..(327): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctcctgtctgggtctcctggacagtcgatcaccatcccctgcatggactccgagcggtgtacgttacttgttttaagntgtctctggtatcagcaacaccaggacaaacgccccaaatcatctatttangtatgtacaatactcggcctgtaggtttcncatcgtcttctccgtggctacagtctaacggctaacgtaccggccctcctacgacctactctcgtcgggtctacccgaggacgtagaacgtacggacggtactaggtaatttactactacgacaggactaacttattaacgttacgtttacgttcgtttaccgtacggttcgggttacgttacggggacggtacgggaacccttaggttccggtacccgttgaccggtcaccggttcccgaggtccccgtacccgtccccgtggtcccttaccgttccgttcccgttcccccg

SEQ ID NO: 299309 - DNA, 755 bp, Homo sapiens
  misc_feature: GZ8MTXP01BSKAD.45.75.G09.1.454.CMB.2.raw
  modified_base (250)..(250): a, c, t, g, unknown or other
  misc_feature (250)..(250): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctcctgtctgggtctcctggacagtcgatcaccatcccctgcactggactccgagcggtgtacgttacttagtttttaagtntcgtcctcgtaggtactacacgaccaaccaccgacggaaccaaaccgacccctaaactctactactaatttagtagtacgtacgtaactaaacgttaacgtccggtacccgttacggttacgggtttcctacgtacttccgtcttcgtccgtcgtactaccgtacgtcgtaacgactaacgtcccgtccctacccgtacgacctcttcgtcgtcggtcctacgacgtacgtaaggaacggtacggtacgtacgtaagttaacttaacttaccgtacgacaacggtaactaacgttaacttaaagtttacgtttaacgttaccggtttaaccgtaccgggtttacgggtacggttaccggggaaccgggtaaccgggtaaaccgttaacggttccggtaaacccggttacggttaacggtaccgttaccggttacccgttacgggtccccgttccccggtaaccccgttcggtacccgttcccgtttcccgttcccggtaaccccg

SEQ ID NO: 299310 - DNA, 664 bp, Homo sapiens
  misc_feature: GZ8MTXP01EOL6Y.45.75.G09.1.454.CMB.2.raw
  modified_base (217)..(217): a, c, t, g, unknown or other
  misc_feature (217)..(217): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacgagggtcctgggcccagtctgccctgactcagcctgcctcctgtctggtctctggacagtcgatcacatccctgcactggaaccngcagtgatggttagggattataccttgtcctcgtggtaccaacacgcaccaggacaaacgaccccaaactcatgtatttagtgaggcagtaacgcggtcccgtcgtacgggggttttactcgtactcgtcttcgtctcggctacgaagtcgtcggaacaactccggccctccctagacctatctcgtgggcctcgaggtcgacgaagacggtaggacttagtacgtttaattacgcgacgtagtaccgtaacttaagttaattaacgttttacggttcgtttacccgtacgggtttaccggggttacgtttaccggggacggggtaaaccgggtaacggtaacggtttcgttaacccggttcggttacgggtccgaaccgacccgggttacgttccgtcccggtccccttcgggtcctaccgttccgtttcccgttccccgtccccg

SEQ ID NO: 299311 - DNA, 612 bp, Homo sapiens
  misc_feature: GZ8MTXP01EJAIY.45.75.G09.1.454.CMB.2.raw
  modified_base (203)..(203): a, c, t, g, unknown or other
  misc_feature (203)..(203): n is a, c, g, or t
  modified_base (252)..(252): a, c, t, g, unknown or other
  misc_feature (252)..(252): n is a, c, g, or t
  modified_base (302)..(303): a, c, t, g, unknown or other
  misc_feature (302)..(303): n is a, c, g, or t
  modified_base (337)..(337): a, c, t, g, unknown or other
  misc_feature (337)..(337): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacgagggtcctgggcccagtctgccctgactcagcctgcctcctgtctgggtctcctggacagtcgatcaccntcccctgcactggactccgagtcggtgtactttacttgtttttaaagtntcgtctcgtgtatcacacaacacgacgacaaccacccaatcatctattannatatactaatacgtcggtccttacggtaggttcnctacgtctcttcgtccgtcgtactacgtagtcgtaacgactaacgtacccgtccctaccgtacgtacctactcgtcgtcgtctacgacggtcaggaacgacgtagtctatattactacagcacgactaatattattagttacgttcgttacgtacggttcggttacggtacgggacggaacggtaacgttacgttcggtaccgttacgtacgtccgttacggccgacggtcccgtccgtccccgttcgtaccgttaccttccgttcccgttcccg

SEQ ID NO: 299312 - DNA, 775 bp, Homo sapiens
  misc_feature: GZ8MTXP01D3G9Z.45.75.G09.1.454.CMB.2.raw
  modified_base (251)..(251): a, c, t, g, unknown or other
  misc_feature (251)..(251): n is a, c, g, or t
tcagacgcgatcgacacgaccggtgctcgatttagtatagacatcagggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatccaccactcccctgcactggactccgagcggtgtacgttacttgttttaagntgtctctggtatcagcaacaccaggacaaacgaccccaaatcatctatttatgatgtacaatactccggtacctacgtagggttctactatcgtcttctctcggtctcgtaagtctacggactaacgtaccgcccttaccctcgacctactcgtccgtcgggtcctaccgacggtctaggaaacggtaaccggtaggtaccgttaggttaacttaacgttacgttacggtaaccaaggggtaaccctaactttaaacgtttaattttaacgtttaacggtttaccgtttttacccgtaaaccgggttttaccggggttaacggtttacccgggggaaccgggggtaacggggttaaaaccccggttaaacgggtttcccgggtaaacccggtttaccgggttaaacggggttcccgaaaccgggttaccccggttaaacggggttccccgttcccccggtaaccccccgggtttcccggtccgttaaccccgtttcccgggtttccccgggttttccccccccg

SEQ ID NO: 299313 - DNA, 522 bp, Homo sapiens
  misc_feature: GZ8MTXP01A54A4.45.75.G09.1.454.CMB.2.raw
  modified_base (245)..(245): a, c, t, g, unknown or other
  misc_feature (245)..(245): n is a, c, g, or t
  modified_base (334)..(334): a, c, t, g, unknown or other
  misc_feature (334)..(334): n is a, c, g, or t
  modified_base (498)..(498): a, c, t, g, unknown or other
  misc_feature (498)..(498): n is a, c, g, or t
  modified_base (500)..(500): a, c, t, g, unknown or other
  misc_feature (500)..(500): n is a, c, g, or t
  modified_base (509)..(509): a, c, t, g, unknown or other
  misc_feature (509)..(509): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgtttttaagntgtctcctggtatcagcaacacccaggacaaagcccccaaatcatcatttatgatgtacaataatcggccctcgtacgggttctcatcncttctctggtctcagtctgggacaataccgcctcccacgaccatctcgtcggctcgaggtctagaagacgaggctgattatactgctaggacactatactagttagtgttcctagtcggtagttcggaggtagggaactaggttgtacgcgtagcagccagtcncnccctgtacnctccgttgtcccc

SEQ ID NO: 299314 - DNA, 707 bp, Homo sapiens
  misc_feature: GZ8MTXP01AYSCO.45.75.G09.1.454.CMB.2.raw
  modified_base (298)..(298): a, c, t, g, unknown or other
  misc_feature (298)..(298): n is a, c, g, or t
tcagacgcgatcgacacgaccggtgctcgatttagtatagacatcagggggctctgggagaggagcccagcactgggattccgaggtgtttccattcagtgatctgcactgaacacagaggactcgccatggagtttgggctgagctgggttttccttgttgctattttaaaggtgtccagtctgaggagcagcgtgggtggagtcgtgggggaggcgttggtccgaggccggggggtccctcgagactctcggtgtgcacgtcctctggacttcgaccgtcagtggcagtcttccgngacgtcgtcgggtcccgccgaggccgtccggaaggggaacggtccgtgggacgttcgggtactacgttaagttaagtttttacgacgacggacacgagtccgtactaacgctaaggtacgtttaccggtaaacgggccctataccaccgtatacctaccgaagaccgtaactaacgttacccgaaacggtaaccgtacggtttacgtttaaccgtagaaaacttacggaaaccccttaccgggaggtaaaccggaaccccgaggacccgacggtccttattaacttcgttacgtcggtcgacggtaacgagaccgtaaccccgaaaccgaaacggttaaccccggaaagttaaccttaccgtaaccaacttcgtaacggtagttacggtaaccgttcgtaacccggggg

SEQ ID NO: 299315 - DNA, 585 bp, Homo sapiens
  misc_feature: GZ8MTXP01EHEH9.45.75.G09.1.454.CMB.2.raw
  modified_base (245)..(245): a, c, t, g, unknown or other
  misc_feature (245)..(245): n is a, c, g, or t
  modified_base (295)..(295): a, c, t, g, unknown or other
  misc_feature (295)..(295): n is a, c, g, or t
  modified_base (328)..(328): a, c, t, g, unknown or other
  misc_feature (328)..(328): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctcctgtctgggtctctggacagtcgatcaccatcccctgcactggactccagtcggtgacgttactgtttttaagntgtctctggtatcagcaacaccaggacaaacgccccaatcatctatttangatgtacaaataatcggtcctcgtagggtttcnctatcgtcttctcctggctcgaagtctacggactaacgtaccggcccttcccgtacgacctactcgtcgtcgggctcgagctagaagacgaggctagattatactgacaggacactaatagttattaagtcgtttactacgtcgggtagttcgggacgggacggtaacgtaggttcggtaccgttcgtacgggtcacggccgaacggtcctacccggtccccgttcggtcttaccgttccgttcccgtttccccccg

SEQ ID NO: 299316 - DNA, 782 bp, Homo sapiens
  misc_feature: GZ8MTXP01APASY.45.75.G09.1.454.CMB.2.raw
  modified_base (258)..(258): a, c, t, g, unknown or other
  misc_feature (258)..(258): n is a, c, g, or t
tcagacgcgatcgacacgaccggtgctcgatttagtatagacatcagggggggggtctcaggaggcagcgctctcgggacgtctccaccatggcctgggctctgctattcctcaccctcctcactcagggcacagggtcctgggcccagtctgccctgactcagcctgcctcctgtctgggtctccgtggacagtcgatccaccactcccctgcactggactccgaggtcggtagtacgtttacttagtttttaagtnttcggttccttcgtaggtactcacgaccaaacaccccaggaccaaacgccccccaaactcatctatttatgtatgtactaataacgtccgtacccttcgtacgggggttttctacgtactcgtcctttcgtaccctcggtacctaccgtaacgttcgtaacgggtacctaacgttacccgggaccccttaccccgtacggtaacccctacgtaccgtccgtcggggtccctaccgtacggacgttaacggaaacggacggtagggtaccttaggtaaactttaacggttacctagggtacccttaacggggacctaaacgtaaacgtttaacttaaacgttttaacggtttcgtttaaccgtaccgggtttaaccgggttacgggttacggggtaccgggtaacgggtaaccgttaaacgggttccggtacccgttacgtaaccgggtcaaccggttacccgttaaccgcccgtacccgtcccccgttccgtccgttacccttcccgttcccgtttaacccccc

SEQ ID NO: 299317 - DNA, 773 bp, Homo sapiens
  misc_feature: GZ8MTXP01EZM7R.45.75.G09.1.454.CMB.2.raw
  modified_base (295)..(295): a, c, t, g, unknown or other
  misc_feature (295)..(295): n is a, c, g, or t
tcagacgcgatcgacacgaccggtgctcgatttagtatagacatcagggggctctgggagaggagcccagcactgggattccgaggtgtttccattcagtgatctgcactgaacacagaggactcgccatggagtttgggctgagctgggttttccttgttgctattttaaaaggtgtccagtctgaggagcagctggtggagtcgtgggggaggcgttgggtccgaggcccgggggggtcctcgagactctcggtgtgcagcctcgtggattcaccgtcagtggcagcttccgngagcgtcgggtcccgccgaggcctcgagggggaacggtccgtgggaggttgggtcctagtaagttaatttttagactaggacaacgagacgtacgtaaaccgctaacgtacgtttaccgggttaaaggggccctagttccaaccgtactccgtacgagaacggtaactaaacgtttcccgaaagggtaaacctacgggtttaggttttacctaaaggtaaaacttccgaaaaccctaaccccggttaggaaacccgggtaaaccccgaacgggaaccgaccggtacccgttattaaacttacgttaaccgttggttacggacggtaaagtaacgaacccgtaaacccggaaaaccccgaaacgggtaaaaccccgggttaaaaaacgttaaacctttaacccggtaaacctaaaaacgtttaacccggtaaaccggttaaggttacgggtaaccggttttaacgggaaccccgggggg

SEQ ID NO: 299318 - DNA, 645 bp, Homo sapiens
  misc_feature: GZ8MTXP01DYKFI.45.75.G09.1.454.CMB.2.raw
  modified_base (246)..(246): a, c, t, g, unknown or other
  misc_feature (246)..(246): n is a, c, g, or t
  modified_base (416)..(416): a, c, t, g, unknown or other
  misc_feature (416)..(416): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctcctgtctgggtctcctggacagtcgatccaccactcccctgcactggatccagcggtgtacgttacttgttttaantgtctctggtatcagacaacaccaggacaaacgccccaaatcatcatttatgatgtacaataagtccggtcctcgtagggtttctctatcgtcttctcctggactaccgaagtcgtacggactaacgtcccggccccctcgacctactcgtcgtcgggtcctcgacggtntacgaagtaacggaggtacgtgtaattattacgtgtacacgtacgaactattaattatttacgttacgtttactacggttacgggttcggttaccgggacggggtaacgggtaaccgtaaacggttcggttaacccggtccgttacggtaccggtacgacccgaacgggttcccgtaaccggtcccccgtaacggttcctaccggttccttccgttccccgttaacccc

SEQ ID NO: 299319 - DNA, 707 bp, Homo sapiens
  misc_feature: GZ8MTXP01A0RAB.45.75.G09.1.454.CMB.2.raw
  modified_base (568)..(568): a, c, t, g, unknown or other
  misc_feature (568)..(568): n is a, c, g, or t
tcagacgcgatcgacacgaccggtgctcgatttagtatagacatcagggggctctgggagaggagcccagcactgggattccgaggtgtttccattcagtgatctgcactgaacacagaggactcgccatggagtttgggctgagctgggttttccttgttgctattttaaaaggtgtccagtctgaggagcagctggtggagtcgtgggggaggcgttggtccgaggcccggggggtccctcgagactcgtcgtgtgcagcctctggacttcaccgtcagtggcagtcttcctgagcgtgggtccgcgaggcgtccgaggggaacggccgtggaggttgggtctcgtaagtttaattttagacgacggactacgagcgtactaacgactaagtactttacccgggttaaagggccgtacgttcaccgtattacctcgaaggtacgaactaagttacccgaaggtaaacctacgggttacgtttaccttagaaacgttacgtaaacccgaccccgttaggaaccggaaccccgacggaaccgaccggtcttactaagtacttaaccgngttgaccgtaagaacgttagtaacccggaaacccgaacggtaaaccccgggttaaagttaaacctttcctaaaaccgtaaacccgttaacgttaacccggggtattaccggggtaacgtttaaccgggtaacccggggg

SEQ ID NO: 299320 - DNA, 788 bp, Homo sapiens
  misc_feature: GZ8MTXP01DK1VI.45.75.G09.1.454.CMB.2.raw
  modified_base (305)..(305): a, c, t, g, unknown or other
  misc_feature (305)..(305): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctcctgtctggtctctggacagtcgatcaccactcccctgcactggactccgagcggtgtacgttacttgtttttaagattgtcttcgtaggtatcagcaacaccaggaccaaacgacccccaaatcatcatttacngacttagtactaaaattacgtcccgggtacccctttacggtaacgggggttttcctacgttacgttcccggtctttccgtacccgttcgggtacctttacccgaaaggttcccgtagggaaccctaacgtacccgggtcccttaccccgtacgaaccctagttccgtcgtcgggtccttaccggacggtacgtaggtaaacggacggaacggttcacgttaacgttaacgttccgtagtaacccgagggtaaccctaagttaacgtttaacgtttaacgtttaccggttacgttttacccggtaaccggtttacgggggtttaaccggttcggggaaccgggttaaacggggtaacgttaacggttaccgggtaacccgtttaccgggtaaaggtcccgttaaccggcccgggttaaacggccccgttaccggtccccggttacggtaccttaccgttccccgtttaaccgggtttaaccccc

SEQ ID NO: 299321 - DNA, 699 bp, Homo sapiens
  misc_feature: GZ8MTXP01EGL12.45.75.G09.1.454.CMB.2.raw
  modified_base (194)..(194): a, c, t, g, unknown or other
  misc_feature (194)..(194): n is a, c, g, or t
  modified_base (259)..(259): a, c, t, g, unknown or other
  misc_feature (259)..(259): n is a, c, g, or t
  modified_base (320)..(320): a, c, t, g, unknown or other
  misc_feature (320)..(320): n is a, c, g, or t
  modified_base (352)..(352): a, c, t, g, unknown or other
  misc_feature (352)..(352): n is a, c, g, or t
tcagacgcgatcgacacgaccggtgctcgatttagtatagacatcagggggggggtctcaggaggcagcgctctcgggacgtctccaccatggcctgggctctgctattcctcaccctcctcactcagggcacgagggtcctgggcccagtctgccctgactcagcctgccctcctgtctggtctccgtggacngtcgatccaccactcccctgcacgtggactccgaggtcggtagtacgtttacttagtttttaagntcggtcctcgtggtatcagacaacacccgaggaccaaaccgaccccaaatcatctatttangatgtacaatacgccgtcctcgtagggtttcnctatcgtctttctccgtcgtactacgtaagtcgtaacggactaacgtccggtccctacccgtacgaaccctctccgttcggtcgggtaccttacggacggtactacgggaaagtacggaaccggtttactagtacttacgtacgtacgactaacggtaactaagtttaacgttaacgtttaacgtttaccgttaccgtttaccggttaccgggtttaccgggttacggtacgggtacgggtaacggtaaccgttacggttaccggtaccgttacggtacggcgttaccggccgttacggtcccgtcccgtaacccgtccgtccttaccgttcccgttcccgtccccg

SEQ ID NO: 299322 - DNA, 749 bp, Homo sapiens
  misc_feature: GZ8MTXP01B7S82.45.75.G09.1.454.CMB.2.raw
  modified_base (252)..(252): a, c, t, g, unknown or other
  misc_feature (252)..(252): n is a, c, g, or t
tcagacgcgatcgacacgaccggtgctcgatttagtatagacatcagggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccactcccctgcactggactccagctgtgtacgtttacttgtttttaagtntcgttctcctggtatcacgacaaccaccaggacaaaccgacccccaaactcatctatttatgtattgtactaaataacgtccggtcccctacgtacgggggtttcctctacttccgtctttccctccgtcggtcctaccctaacggttccgttacgggaacctaacgttacccgggtcccctaccccgtaccgtaccctacttcccgttccgtcgggtccgttacccggacggtccgtaaggaaacggaccgggtaacggtaccgttaggttaactttaacgttaaccgtcgtacggacgtaacctaacgtaagttaattacgtttacgtttacgtttaccgttaccggttccggggttagttccggggtacggggtaacggtaccggttaacgggttaccggttacccggttaccgttacggttaccgccgggaccccgtaagggtccccgcccggttcccccgtcgttacccgtaaccgttccccgtttccccgg

SEQ ID NO: 299323 - DNA, 684 bp, Homo sapiens
  misc_feature: GZ8MTXP01D2S6S.45.75.G09.1.454.CMB.2.raw
  modified_base (256)..(256): a, c, t, g, unknown or other
  misc_feature (256)..(256): n is a, c, g, or t
  modified_base (313)..(313): a, c, t, g, unknown or other
  misc_feature (313)..(313): n is a, c, g, or t
  modified_base (464)..(464): a, c, t, g, unknown or other
  misc_feature (464)..(464): n is a, c, g, or t
tcagacgcgatcgacacgaccggtgctcgatttagtatagacatcagggggggggtctcaggaggcagcgctctcgggacgtctccaccatggcctgggctctgctattcctcaccctcctcactcagggcacagggtcctgggcccagtctgccctgactcagcctgcctcctgtctgggtctcctggacagtcgatcaccactcccctgcacgtggactccgaggtcggtagtacgtttacttagtttttaagnttcgtctcgtggtactcagacaacaccgagaccaaacgaccccaatcatactattangatagtactaaatacgtccggtacctagttacggtttctctacgtccgtcttcgtccgtcggtactacgtaagtcgtaacggactaacgtaccgtccctccctacgactcgtctcgtcggctacgtaggactaggaaacgtacggacggtntagtattagtcgagaccaggtactataattagttagttacgttccgttaccgtacggttcggttacggttccgggaacgggtaacgggtaaccttaacgggtttaccgaacccgtttaaccggacggttaaccgaacccgggacccgttaaccgggtccccgtccccggttccccgttacggtcccttacccgttccccggttcccgtttaacccccccg

SEQ ID NO: 299324 - DNA, 780 bp, Homo sapiens
  misc_feature: GZ8MTXP01CYWPW.45.75.G09.1.454.CMB.2.raw
  modified_base (207)..(207): a, c, t, g, unknown or other
  misc_feature (207)..(207): n is a, c, g, or t
  modified_base (248)..(248): a, c, t, g, unknown or other
  misc_feature (248)..(248): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcaggcacagggtcctgggcccagtctgccctgactcagcctgcctcctgtctgggtctcctggacagtcgatcaccatccccngcactggactccgagcggtgtacgttacttagtttttaagntcgttctcctggtatcagacaacacccgaggaccaaaccgaccccaaactcatactatttatgatagtacaataacgtccggacccttcgtacggggtttctcgtactccgttcttcttccgcggtcttaccgtaagttcctaacgggactaacgtacccgggtccccttacccgttacgaaccctacgttccgttccggttccggggtaccttacccgaacggggtaacccgttaggaaaacgggtaaccgggacgggttaccgttaggttaaaccttttaagttaaccgttacggacctaacggggtactaaaccttaaaggttattttaaacgtttacggtttaccgtttaccgttaaccggtttacggggttaacggttacccggggtacggggtaaacggggtaacccgtttaaggttcccgggtaaacccgggttaccggttacgggtaccgaaccggttcccggaacggtcccgtaccccggtccccgttcgggacccttaccgttcccgttccgttcccccccg

SEQ ID NO: 299325 - DNA, 673 bp, Homo sapiens
  misc_feature: GZ8MTXP01DB41C.45.75.G09.1.454.CMB.2.raw
  modified_base (260)..(260): a, c, t, g, unknown or other
  misc_feature (260)..(260): n is a, c, g, or t
  modified_base (478)..(478): a, c, t, g, unknown or other
  misc_feature (478)..(478): n is a, c, g, or t
  modified_base (490)..(490): a, c, t, g, unknown or other
  misc_feature (490)..(490): n is a, c, g, or t
tcagacgcgatcgacacgaccggtgctcgatttagtatagacatcagggggggggtctcaggaggcagcgctctcgggacgtctccaccatggcctgggctctgctattcctcaccctcctcactcagggcacagggtcctgggcccagtctgccctgactcagcctgcctcctgtctgggtctcctggacagtcgatcaccactcccctgcacgtggactccgaggtcggttagtacgtttacgttagtttttaaagtnttcgttccttccgttaggtatcgaagaccaaaccacccgaaggaaccaaaaccgaccccctaaatctaatacttaatttactagtacttacgtaactaaagttaaccgtcccggtacccgtttcggttaacggggtttcctacgtctccgtctttctcccgtcggtcctacgtaacgtcgtaacgaccaaccgccgtccctaccagactactctccgngtctcgacggtntaggacggacgtaggtctagttaattctagtgtactgtacctagtagtatcggtaagtaggttaagttaaccgtttggtttagggtccgttcggggaacgggaagtaccaagggtcgttaccggtaccgtacggcgttcaccggcgaacgtccgtacccgtccgttacgtcttcccgttcccg

SEQ ID NO: 299326 - DNA, 742 bp, Homo sapiens
  misc_feature: GZ8MTXP01A27G6.45.75.G09.1.454.CMB.2.raw
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggactccgaggcggtgtacgtttacttgtttttaagattgtctcgtggtatcagcaacacccaggacaaacgccccaaactcatctatttatgatgtacaataacgtccggaccttcgtaggggtttctcactcgtacttcttcctcggtctaccgtaagtcttcgggacctaacgtacccgggtcccttaccctacgaccctaacttccgtcgtcggggtccttaccgcggtacgttacggaaacgtaacggtacggtacgttagtaacttaacgttaaccgtcgtacccgaagggttacaaaccgttatttaaatttacgtttaacgtttacggtttaccccttaaacgggttcgggtttaaccgttccgggggaccgggttaaacggggaacccgtaaagggttaccggtacccggttacccggttaaccggttacggaacccgggcccgttaaacggtccccgttccccgggtccccgttacccgggtcctttaccccggtccctttcccggtttcccccccgg

SEQ ID NO: 299327 - DNA, 675 bp, Homo sapiens
  misc_feature: GZ8MTXP01BARA4.45.75.G09.1.454.CMB.2.raw
  modified_base (295)..(295): a, c, t, g, unknown or other
  misc_feature (295)..(295): n is a, c, g, or t
  modified_base (313)..(313): a, c, t, g, unknown or other
  misc_feature (313)..(313): n is a, c, g, or t
tcagacgcgatcgacacgaccggtgctcgatttagtatagacatcaggggagctctgggagaggagcccagcactgggattccgaggtgtttccattcagtgatctgcactgaacacagaggactcgccatggagtttgggctgagctgggttttccttgttgcttatttaaaaggtgtccagtctgaggagcagcgtggtggagtcgtgggggagtcgttggtccgaggcccgggggggtccctcgagactcgtcgtgtgcagcctctggattcaccgtcagtggcagtctccngacgcgtcgggccgccgnggcctcggagggacggccgtgggagtcggtctagtagttaatttagacccgaggacacgacgtccgtaaacgacgcgaacgtacgttacccgggtaacggccgtacttcgacctactacctaccgaaggtaacaactaacttacgaacggtaaacgtcggtttagtttactaagtaaacgttacgaaacccgtaaccccgtaaggtaaaccccggaacgaccgtacggtccttaactataacgttcctagggtccgagaagtaacgacgtacccggaaacccgacggtaaacccgaaagttaacttaaccgtaactaaacgtaacgtaacgttacgttaccggtaacgttcggtaaccgggg

SEQ ID NO: 299328 - DNA, 618 bp, Homo sapiens
  misc_feature: GZ8MTXP02J4T6R.45.75.G09.1.454.CMB.2.raw
  modified_base (225)..(225): a, c, t, g, unknown or other
  misc_feature (225)..(225): n is a, c, g, or t
  modified_base (243)..(243): a, c, t, g, unknown or other
  misc_feature (243)..(243): n is a, c, g, or t
  modified_base (311)..(311): a, c, t, g, unknown or other
  misc_feature (311)..(311): n is a, c, g, or t
tcagacgcgatcgacacgaccggtgctcgatttagtatagacatcgagggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtntacgttactgttttaagntgtctctggtatcagcaaaccacccaaggcaaacgcccccaaatcatcatttatgatgtacaataacncggtccctgtagggtttctcatcgcttctcctcggtctaccgaagtctaggcctaacgtaccgggtccccttccctgacccattctccgtcgggcctccgacggacgtaggaacgacggaaggtctagtaattacttactcgcagacctatataatttagtttaagtcgtttttaccgacgttacgggggttaactttcggggacggggtaagggtacccgtaaaaggttccgaaacccggtccttaacgggtcacgaccccgtaaggcccgtcgcccccgttggtcccacgttcctcgttcccccg

SEQ ID NO: 299329 - DNA, 507 bp, Homo sapiens
  misc_feature: GZ8MTXP02GVG28.45.75.G09.1.454.CMB.2.raw
  modified_base (295)..(295): a, c, t, g, unknown or other
  misc_feature (295)..(295): n is a, c, g, or t
  modified_base (368)..(368): a, c, t, g, unknown or other
  misc_feature (368)..(368): n is a, c, g, or t
  modified_base (404)..(405): a, c, t, g, unknown or other
  misc_feature (404)..(405): n is a, c, g, or t
  modified_base (407)..(408): a, c, t, g, unknown or other
  misc_feature (407)..(408): n is a, c, g, or t
  modified_base (410)..(410): a, c, t, g, unknown or other
  misc_feature (410)..(410): n is a, c, g, or t
  modified_base (419)..(419): a, c, t, g, unknown or other
  misc_feature (419)..(419): n is a, c, g, or t
tcagacgcgatcgacacgaccggtgctcgatttagtatagacatcagggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgtttttaagatgtctcctggtatcagcaacacccaggcaaagccccaaactcatcatttangatgtcaataatcggcctcaggggtttctcatcgcttctcctgctcaagtctggcatacgctcctgaccatcnctggctccaggctgaaagacgaggctgatattaatnnannanatatatatnttctacgtcgtagtcgcggacggacgtagtacgtacgtacgtacgtacgacgaccgacgcgtccgcccgtccgtctactctcgtcccg

SEQ ID NO: 299330 - DNA, 517 bp, Homo sapiens
  misc_feature: GZ8MTXP02F9QC0.45.75.G09.1.454.CMB.2.raw
  modified_base (416)..(416): a, c, t, g, unknown or other
  misc_feature (416)..(416): n is a, c, g, or t
  modified_base (427)..(427): a, c, t, g, unknown or other
  misc_feature (427)..(427): n is a, c, g, or t
tcagacgcgatcgacacgaccggtgctcgatttagtatagacatcagggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgtttttaagatgtctctggtatcagcaacacccaggcaaagcccccaaatcaatcatttatgatgtacaataaatcggccctcgaggggtttctcatcgcttctcctgctcaagtctgacatacgcctccctgaccatctctgggctccaggctgaagacgaggctgattatactgcagcanatatattagtnttcactggtattcggcggaggtaccaaagttcgaccgtctacggtcacgcccaaaggctaccgcccctcggtccacgtctcgttcccccg

SEQ ID NO: 299331 - DNA, 525 bp, Homo sapiens
  misc_feature: GZ8MTXP02JXU8I.45.75.G09.1.454.CMB.2.raw
  modified_base (418)..(418): a, c, t, g, unknown or other
  misc_feature (418)..(418): n is a, c, g, or t
  modified_base (515)..(515): a, c, t, g, unknown or other
  misc_feature (515)..(515): n is a, c, g, or t
tcagacgcgatcgacacgaccggtgctcgatttagtatagacatcagggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgtttttaagtatgtctcctggtatcagcaacacccaggcaaacgcccccaaactcatcatttatgatgtcaataatcggccctcagggtttctcatcgcttctcctggctccaagtctggcatacggcctccctgaccatctctgggctccgaggctgaagacgaggctgattattactgcagcanatatattagtgtttccagttcgggtattcggcggaggacctaaggttcgaccgtcgtaggtccacggtcccaaggctcgccccgtcggtccacttcncgtttccccc

SEQ ID NO: 299332 - DNA, 503 bp, Homo sapiens
  misc_feature: GZ8MTXP02JGG71.45.75.G09.1.454.CMB.2.raw
  modified_base (294)..(294): a, c, t, g, unknown or other
  misc_feature (294)..(294): n is a, c, g, or t
  modified_base (495)..(495): a, c, t, g, unknown or other
  misc_feature (495)..(495): n is a, c, g, or t
tcagacgcgatcgacacgaccggtgctcgatttagtatagacatcagggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgtttttaagtatgtctcctggtatcagcaacacccaggcaaagccccaaactcatcatttangatgtcaataatcggcctcaggggtttctcatcgcttctcctgctccaagtctggcatacgctccctgaccatctctgggctccaggctgaagacgaggctgattattactgcagcacatatattagtgtttccatcggtattcggcgaggaccaagttgaccgtcctaggtcacgcccaaggctcgcccctggtcactcngttccccc

SEQ ID NO: 299333 - DNA, 515 bp, Homo sapiens
  misc_feature: GZ8MTXP02JOY4W.45.75.G09.1.454.CMB.2.raw
tcagacgcgatcgacacgaccggtgctcgatttagtatagacatcagggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgtttttaagtatgtctcctggtatcagcaacacccaggcaaagcccccaaactcatcatttatgatgtcaataatcggccctcaggggtttctcatcgcttctcctggctccaagtctggcatacggcctccctgaccatctctgggctccaggctgaagacgaggctgattattactgcagcacatatattagtgtttccacgtcggtattcggcggaggaccaagttgaccgtctaggtcagcccaaggcctacgccccctcggtcacgtctcgttccccc

SEQ ID NO: 299334 - DNA, 524 bp, Homo sapiens
  misc_feature: GZ8MTXP02HZP0P.45.75.G09.1.454.CMB.2.raw
  modified_base (225)..(225): a, c, t, g, unknown or other
  misc_feature (225)..(225): n is a, c, g, or t
  modified_base (256)..(256): a, c, t, g, unknown or other
  misc_feature (256)..(256): n is a, c, g, or t
  modified_base (367)..(367): a, c, t, g, unknown or other
  misc_feature (367)..(367): n is a, c, g, or t
  modified_base (511)..(511): a, c, t, g, unknown or other
  misc_feature (511)..(511): n is a, c, g, or t
  modified_base (515)..(515): a, c, t, g, unknown or other
  misc_feature (515)..(515): n is a, c, g, or t
  modified_base (517)..(517): a, c, t, g, unknown or other
  misc_feature (517)..(517): n is a, c, g, or t
  modified_base (519)..(520): a, c, t, g, unknown or other
  misc_feature (519)..(520): n is a, c, g, or t
  modified_base (522)..(524): a, c, t, g, unknown or other
  misc_feature (522)..(524): n is a, c, g, or t
tcagacgcgatcgacacgaccggtgctcgatttagtatagacatcaggggatggtgatcgactgtcctgggcccagtctgccctgactcagcctgcctccctgtctgggtctcctggacagtcgatcaccatcccctgcactggatccagcggtgacgtttactgtttttaagatgtctctggtatcagcaacaccaggacaaacgcccccaaatcatcatttangatgtacaataatcggccctgaggggtttcncatcgcttctctggctccaagtctggcaactacggcctcctgaccatctctgggcctcgaggctgaaagacgaggctagtatttatactgcagcactattaatatttagtntttccaagtttcgggtattcgggacggaaggacctaaaggttcgaccgtcgtaggtacacgccaagctaccgcccctggtcactcgtcttccaccctctcgtcgactcgtcgtctggacgcgggctgggacaacgggcacgaanaagncncnncnnn

SEQ ID NO: 299335 - DNA, 488 bp, Homo sapiens
  misc_feature: GZ8MTXP02GD685.45.75.G09.1.454.CMB.2.raw
  modified_base (239)..(239): a, c, t, g, unknown or other
  misc_feature (239)..(239): n is a, c, g, or t
  modified_base (310)..(310): a, c, t, g, unknown or other
  misc_feature (310)..(310): n is a, c, g, or t
  modified_base (327)..(327): a, c, t, g, unknown or other
  misc_feature (327)..(327): n is a, c, g, or t
  modified_base (352)..(352): a, c, t, g, unknown or other
  misc_feature (352)..(352): n is a, c, g, or t
tcagacgcgatcgacacgaccggtgctcgatttagtatagacatcaggggggttctcaggaggcagcgctctcgggacgtctccaccatggcctgggctctgctattcctcaccctcctcactcaggacacagggtcctgggcccagtctgccctgactcagcctgcctccgtgtctgggtctcctggacagtcgatcaccatctcctgcactggaaccagcagtgatgttgggattanaccttgtctcctggtaccaacagcaccaggcaaagccccaaatcatgatttatgaggcagtaagcggcctnaggggtttctaaatcgnttctctggctccaagtctggcaacncggctcctgacaatctctgggctcaggctgaggacgaggctgattatactgcagctcatatgcacgcagcatgactctagtacttcggcgaggaccaagctcgaccgtctaagtcagcccaaggctcgccccctgg

SEQ ID NO: 299336 - DNA, 507 bp, Homo sapiens
  misc_feature: GZ8MTXP02HU3IF.45.75.G09.1.454.CMB.2.raw
tcagacgcgatcgacacgaccggtgctcgatttagtatagacatcagggggggtctcaggaggcagcgctctcgggacgtctccaccatggcctgggctctgctattcctcaccctcctcactcagggcacagggtcctgggcccagtctgccctgactcagcctgcctcctgtctgggtctcctggacagtcgatcaccatcccctgcactggatccagcggtgacgttactgtttttaagatgtctctggtatcagcacaccaggcaaacgccccaaactcatcatttatgatgtcaataatcggcctctagggtttctcatcgcttctctgctcaatctgcatacgcctcctcgaccatctctcggtctcccgagctgaagacgagctagacttatactgcagcacatatattagtcgtttcacgtcggttattcggacggaggtacgaagttcgaccgtcgtacgtcacgccaaggctccgccctcgctactctcgttacccc

SEQ ID NO: 299337 - DNA, 578 bp, Homo sapiens
  misc_feature: GZ8MTXP02I22S1.45.75.G09.1.454.CMB.2.raw
  modified_base (287)..(287): a, c, t, g, unknown or other
  misc_feature (287)..(287): n is a, c, g, or t
  modified_base (495)..(495): a, c, t, g, unknown or other
  misc_feature (495)..(495): n is a, c, g, or t
  modified_base (531)..(531): a, c, t, g, unknown or other
  misc_feature (531)..(531): n is a, c, g, or t
tcagacgcgatcgacacgaccggtgctcgatttagtatagacatcagggggctctgggagaggagcccagcactgggattccgaggtgtttccattcagtgatctgcactgaacacagaggactcgccatggagtttgggctgagctgggttttccttgttgctattttaaaaggtgtccagtctgaggagcagctggtggagtctgggggaggcttggtccaggccgggggggtccctcagactctcgtgtgcagcctctggattcaccgtcagtggcagcttccngagctgggtccgcaggctccgagggaggcctggagtgggtctcgagttaattttaggactaggcacgagcgtactacgcagtattccgttaaagggccgtaattcaacctatcctacccagacgacaattcccaggaacacggttgtttacgtagaaattacgaacctaccgtgaacgacccgaggacaccggctactatacgttacngtgacgagacgactccgaaaccacggacccggaaanaactttaccaacgtaactaactacggtatacggacgtacgtacgggg

SEQ ID NO: 299338 - DNA, 516 bp, Homo sapiens
  misc_feature: GZ8MTXP02G422T.45.75.G09.1.454.CMB.2.raw
  modified_base (296)..(296): a, c, t, g, unknown or other
  misc_feature (296)..(296): n is a, c, g, or t
tcagacgcgatcgacacgaccggtgctcgatttagtatagacatcagggggggtctcaggaggcagcgctctcgggacgtctccaccatggcctgggctctgctattcctcaccctcctcactcagggcacagggtcctgggcccagtctgccctgactcagcctgcctccctgtctgcgtctcctggacagtcgatcaccatcccctgcactggatccagcggtgacgttactgtttttaagatgtctcctggtatcagcaacaccaggacaaacgcccccaaatcatcatttangatgtacaataatcggccctcgagggtttctcatcgcttcctctgctcagtctggcaactacggcctcctgaccatctctggctcaggctgaagcgagctgattatactgcagcacatatattagtgttaccacgtcggtagttcgggcggtacggacctaaggttcgaccgtctacggtcacgtacccgaagcctcgccccgtcgtcaccttcgtcccg

SEQ ID NO: 299339 - DNA, 569 bp, Homo sapiens
  misc_feature: GZ8MTXP02HE7UU.45.75.G09.1.454.CMB.2.raw
tcagacgcgatcgacacgaccggtgctcgatttagtatagacatcagggggggtctcaggaggcagtgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgttttaagatgtctcctggtatcagcaacacccaggcaaacgccccaaactcatcatttatgatgtcaataatcggcctcgagggtttctcatcgcttctcctgctcagtctggacactaccggcctccctgaccctatcctctgggctccgagcctgaagacgaggctagtattatactgcagctaacatattattagttcgtttaccacgttcgggttagttcgggacgggacgggtaaccgtaaaggttcggtaccgtacgtacggtaccgaacgcccgtaaacggtccgtccgcccccgttcggtacctaccgttccttaccgtttccccc

SEQ ID NO: 299340 - DNA, 530 bp, Homo sapiens
  misc_feature: GZ8MTXP02G55FJ.45.75.G09.1.454.CMB.2.raw
  modified_base (458)..(458): a, c, t, g, unknown or other
  misc_feature (458)..(458): n is a, c, g, or t
tcagacgcgatcgacacgaccggtgctcgatttagtatagacatcagggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgtacgttacttgtttttaagatgtctctggtatcagcaacaccaggacaaacgcccccaaaactcatcatttatgatgtcaataatcggccctcgaggggtttctcatcgcttctctggctcaagtctggcacgtacggcctcctcgacctatctcgtggctccgaggctaggaagacgaggctagtagttattactgcagcacatatattagtgttcacgtcggtattcggngacggaccagttacgaccgtcgtacggtcacgtccgaagccgtcgcccctcggtccactcgtacgttacccc

SEQ ID NO: 299341 - DNA, 668 bp, Homo sapiens
  misc_feature: GZ8MTXP02FSX3F.45.75.G09.1.454.CMB.2.raw
  modified_base (248)..(248): a, c, t, g, unknown or other
  misc_feature (248)..(248): n is a, c, g, or t
  modified_base (311)..(311): a, c, t, g, unknown or other
  misc_feature (311)..(311): n is a, c, g, or t
tcagacgcgatcgacacgaccggtgctcgatttagtatagacatcaggggggtctcaggaggcagcgctctcgggacgtctccaccatggcctgggctctgctattcctcaccctcctcactcagggcacagggtcctgggcccagtctgccctgactcagcctgcctcctgtctgggtctccgtggacagtcgatcaccactccctgcactggactccagcggtgtacgttacttagtttttaagtntcgtctcgtgtatcacgacaaccaccgacgaccaaaccgacccctaaactcactactatttangtatagtactaatacgtccgtcctcggtacggttctactactcgtcttctccgtcgtcctacgtacgtcgtacgactacgtccgtccctccgtacgtacctactccgtcggtcggtcctaccggacggtacgtaggaaacgacgacggtacgtagttaattactacgtacgacacgtactaataattaagttacgtttacgttacgtttaccgtacggttacgggttacggtaccggggtacgggtaacggtaaccgtaacggttaccggtacccgttacgtacggtaccgaccgtacccgtaacgtcccgtcccggtaccccgttcggtacctaccgttccgttcccgttaccccg

SEQ ID NO: 299342 - DNA, 499 bp, Homo sapiens
  misc_feature: GZ8MTXP02GVR5P.45.75.G09.1.454.CMB.2.raw
  modified_base (245)..(245): a, c, t, g, unknown or other
  misc_feature (245)..(245): n is a, c, g, or t
  modified_base (298)..(298): a, c, t, g, unknown or other
  misc_feature (298)..(298): n is a, c, g, or t
  modified_base (362)..(362): a, c, t, g, unknown or other
  misc_feature (362)..(362): n is a, c, g, or t
  modified_base (423)..(423): a, c, t, g, unknown or other
  misc_feature (423)..(423): n is a, c, g, or t
tcagacgcgatcgacacgaccggtgctcgatttagtatagacatcagggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgtttactgtttttaagntgtctcctggtatcagcaacacccaggcaaacgcccccaaactcatcatttangatgtcaataatcggcctcgagggtttctcatcgcttctctgctcagtctggcatacgcctccngaccatctctgggctccgagctgaagacgaggctgacttatactgcagcacatatatagtnttcactcggtatcggcgaggaccaagtgaccgtctagtcacgccaaggctacgcccctacgtcactctcgttcccc

SEQ ID NO: 299343 - DNA, 532 bp, Homo sapiens
  misc_feature: GZ8MTXP02FNSH7.45.75.G09.1.454.CMB.2.raw
  modified_base (299)..(299): a, c, t, g, unknown or other
  misc_feature (299)..(299): n is a, c, g, or t
  modified_base (365)..(365): a, c, t, g, unknown or other
  misc_feature (365)..(365): n is a, c, g, or t
  modified_base (462)..(462): a, c, t, g, unknown or other
  misc_feature (462)..(462): n is a, c, g, or t
  modified_base (492)..(492): a, c, t, g, unknown or other
  misc_feature (492)..(492): n is a, c, g, or t
tcagacgcgatcgacacgaccggtgctcgatttagtatagacatcagggggctctgggagaggagcccagcactgggattccgaggtgtttccattcagtgatctgcactgaacacagaggactcgccatggagtttgggctgagctgggttttccttgttgctattttaaaaggtgtccagtctgaggagcagctggtggagtctgggggaggcttggtccaggccgggggggtccctcagactctcgtgtgcagcctctggattcaccgtcagtggcagcttcctgagctgggtccnccaggctccgagggaaggcctggagtgggtctcgagtaattttagacaggcacagcgtactacgcngattcgtaaaggccattcaccatctccagagacaattccagacacgtgttctagaaatgaacaccctagacgacccgaggacacggctctatatacngtgcgagagatcgaaaccagacccggaaanaacttacaacaactaacgtacggtatcggacgtcgacggg

SEQ ID NO: 299344 - DNA, 537 bp, Homo sapiens
  misc_feature: GZ8MTXP02H2RP5.45.75.G09.1.454.CMB.2.raw
  modified_base (326)..(326): a, c, t, g, unknown or other
  misc_feature (326)..(326): n is a, c, g, or t
tcagacgcgatcgacacgaccggtgctcgatttagtatagacatcaggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgttttaagtatgtctcctggtatcagcaacaccaggcaaagcccccaaactcatcatttatgatgtacaataatcggccctgtaggggtttcncatcgcttctctgctcagtctggacatacggcctccctgaccatctcgtggctccagctgaaagcgaggctgattatactgcagcacatatattagtgtttcacgtcgggttattcgggcggtaggacctaaggtttcgacccgttaccgtaggtccaacgccccgaagggcctccggcccccgttcggtccaccttctccgtttcccccg

SEQ ID NO: 299345 - DNA, 642 bp, Homo sapiens
  misc_feature: GZ8MTXP02HYLB4.45.75.G09.1.454.CMB.2.raw
  modified_base (246)..(246): a, c, t, g, unknown or other
  misc_feature (246)..(246): n is a, c, g, or t
tcagacgcgatcgacacgaccggtgctcgatttagtatagacatcagggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttacttgtttttaagtntgtctcctggtatcagcaacacccaggcaaacgcccccaaatcatcatttatgatgtacaataatcggccctcgaggggtttctcatcgcttctcctgctcaagtctggcataccggcctcccctagaccctatcctcgtcgggcctcccgaggtcctaggaaacgacggacggtctacggtaatttacttacttaggccaaggacctaactaattaattaagtttagttacgtttacctaacggttacggggttacgtttccggggacgggtaacggggtaacctaaaggtttcgaacccggttaccgtaacgggttaccgaccgttaacccggaaaccggtccgtccgtcccccgttccggtacccgtaccgttcccgttcccgtttccccccg

SEQ ID NO: 299346 - DNA, 733 bp, Homo sapiens
  misc_feature: GZ8MTXP02IUYNV.45.75.G09.1.454.CMB.2.raw
  modified_base (289)..(289): a, c, t, g, unknown or other
  misc_feature (289)..(289): n is a, c, g, or t
  modified_base (302)..(302): a, c, t, g, unknown or other
  misc_feature (302)..(302): n is a, c, g, or t
tcagacgcgatcgacacgaccggtgctcgatttagtatagacatcagggggctctgggagaggagcccagcactgggattccgaggtgtttccattcagtgatctgcactgaacacagaggactcgccatggagtttgggctgagctgggttttccttgttgctattttaaaggtgtccagtctgaggagcagctggtggagtcgtgggggaggcgttggtccagggccggggggtccctcgagactctcgtgtgcagcctctggattcaccgtcagtggcagcttccngagcgtgggtccnccgaggcctccgaggggacggcctgggaggtcgggtctacgtagttaatttagtacaggcacgagactacgacgcagtacttaccggttaaagggcccgtaattcccaaacctacttaccctacccgaaggtaacgaacctaaacgtttacccgaaagggtaaaccctaaccggggtttagttttaccgtaaagtaaaacgttacgaaaaccccgtacccgtaacgggaaccggaaacccccgggaaggggaaaccctaccggggaccttaaccgttaagttaaacttaccggtagtacggacggaaagacggtacgaacccggaaaacccaacgggaaaccccgggtaaaagtaaaacctttaccgaaaacctaaaccgttaaaccgtaaccgggttaagtaccggggtaaccgttacggtaaccggggg

SEQ ID NO: 299347 - DNA, 571 bp, Homo sapiens
  misc_feature: GZ8MTXP02HAHW2.45.75.G09.1.454.CMB.2.raw
  modified_base (294)..(294): a, c, t, g, unknown or other
  misc_feature (294)..(294): n is a, c, g, or t
  modified_base (416)..(416): a, c, t, g, unknown or other
  misc_feature (416)..(416): n is a, c, g, or t
  modified_base (432)..(432): a, c, t, g, unknown or other
  misc_feature (432)..(432): n is a, c, g, or t
  modified_base (479)..(479): a, c, t, g, unknown or other
  misc_feature (479)..(479): n is a, c, g, or t
  modified_base (506)..(506): a, c, t, g, unknown or other
  misc_feature (506)..(506): n is a, c, g, or t
tcagacgcgatcgacacgaccggtgctcgatttagtatagacatcaggggggagaggagcccagcactgggattccgaggtgtttccattcagtgatctgcactgaacacagaggactcgccatggagtttgggctgagctgggttttccttgttgctattttaaaaggtgtccagtctgaggagcagctggtggagtctgggggaggcttgggtccaggccgggggggtccctcagactctcgtgtgcagcctctggattcaccgtcagtggcagcttcctgagctgggtccnccaggctccgagggaggcctggagtgggtctcagttaattttagacaggtcacagcgtactacgcagtacttcgttaggggccattcaccatctccagagactaattcccaggaacacggtntttctagaaatgaacncctagacgacccgaggacacggctactaatattactgtagcgaaganactaccgaaacccaggaacccggaaanaaacttccaaacaactaactaacgggtatacgggacgttcggacggggaccaaacggggtacccg

SEQ ID NO: 299348 - DNA, 568 bp, Homo sapiens
  misc_feature: GZ8MTXP02JZ2YC.45.75.G09.1.454.CMB.2.raw
  modified_base (299)..(299): a, c, t, g, unknown or other
  misc_feature (299)..(299): n is a, c, g, or t
  modified_base (428)..(428): a, c, t, g, unknown or other
  misc_feature (428)..(428): n is a, c, g, or t
tcagacgcgatcgacacgaccggtgctcgatttagtatagacatcagggggctctgggagaggagcccagcactgggattccgaggtgtttccattcagtgatctgcactgaacacagaggactcgccatggagtttgggctgagctgggttttccttgttgctattttaaaaggtgtccagtctgaggagcagctggtggagtctgggggaggcttggtccaggccgggggggtccctcagactctcgtgtgcagcctctggattcaccgtcagtggcagcttcctgagctgggtccnccaggctccgaggggaaggcctggagtgggtctcagttaattttgacaggcacagcgtactacgcagattccgttaagggccgattcaccatcctaccagagactaattcccgaggaacctacgggttntttactagaaactgaaaccacccgtgacgacccgaggaccacggctacgtatattactgtagcgtagagatccgaaacccagaacccgaaagtaacttcaacgaactacgtaacggtatcgggaaccgtcgtaccggggg

SEQ ID NO: 299349 - DNA, 567 bp, Homo sapiens
  misc_feature: GZ8MTXP02HE4JG.45.75.G09.1.454.CMB.2.raw
  modified_base (244)..(244): a, c, t, g, unknown or other
  misc_feature (244)..(244): n is a, c, g, or t
  modified_base (295)..(295): a, c, t, g, unknown or other
  misc_feature (295)..(295): n is a, c, g, or t
tcagacgcgatcgacacgaccggtgctcgatttagtatagacatcagggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgtttttaagntgtctcctggtatcagcaacaccaggcaaacgcccccaaatcatcatttangatgtacaatatcggcctcgtagggtttctcatcgcttctcctgctcaagtctggcagtacgcctcctgaccatctctcggctccaggctgaagacgaggctgattatactgctagctacatattactttagtcgtttccacgttcgggtagtttcgggcgggtaacgggtacctaaggttcggacccgttccgtaacggtaccgacggtaccccgaaagggtccctaccggccccccgttcggtaccgaccttccgttccgtttccccccg

SEQ ID NO: 299350 - DNA, 552 bp, Homo sapiens
  misc_feature: GZ8MTXP02GYV28.45.75.G09.1.454.CMB.2.raw
  modified_base (244)..(244): a, c, t, g, unknown or other
  misc_feature (244)..(244): n is a, c, g, or t
  modified_base (265)..(265): a, c, t, g, unknown or other
  misc_feature (265)..(265): n is a, c, g, or t
  modified_base (294)..(294): a, c, t, g, unknown or other
  misc_feature (294)..(294): n is a, c, g, or t
tcagacgcgatcgacacgaccggtgctcgatttagtatagacatcagggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgtttttaagntgtctcctggtatcagcaacnccaggcaaagccccaaactcatcatttangatgtcaataatcggccctcgaggggtttctcatcgcttctcctggctccaagtctggcataccggcctccctgacctatctcgtgggctccgagctagaagacgaggctagattacgttatgcagcacattatattagttgtttcccagttcgggtattcgggacggtacgggtaaccaaggtttcgaccgttaccgtacggttcacggccctaaggccttcggcccccttcggcctaccttccgtcgtttcccccg

SEQ ID NO: 299351 - DNA, 519 bp, Homo sapiens
  misc_feature: GZ8MTXP02JIS55.45.75.G09.1.454.CMB.2.raw
tcagacgcgatcgacacgaccggtgctcgatttagtatagacatcagggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgtttttaagtatgtctcctggtatcagcaacacccaggcaaagcccccaaactcatcatttatgatgtcaataatcggcctcaggggtttctcatcgcttctcctggctccaagtctggcatacggcctcctgaccatctctgggctccaggctgaagacgagctgattattactgcagcacatatattagtgtttccattcgggtattcgggcggtaggaccaaggttcgaccgtctaggtcaacgcccaaggcctcgccccctcggtcacctcgtcgtttccccc

SEQ ID NO: 299352 - DNA, 530 bp, Homo sapiens
  misc_feature: GZ8MTXP02G2N67.45.75.G09.1.454.CMB.2.raw
  modified_base (333)..(333): a, c, t, g, unknown or other
  misc_feature (333)..(333): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgtttacttgtttttaagatgtctcctggtatcagcaacacccaggcaaacgcccccaaactcatcatttatgatgtacaataatcggccctcgtaggggtttcncatcgcttctcctgctcaagtctggcataccggcctccctgaccatctctcgggctccgagctagaagacgagctagattagttactgacagacacatatattagttgttaccacgtcggtattcgggcggaggactagttcgaccgtcgtacggtcacgtccaagcgtcgcccctacggcactcctcgttcccccg

SEQ ID NO: 299353 - DNA, 526 bp, Homo sapiens
  misc_feature: GZ8MTXP02JJJN6.45.75.G09.1.454.CMB.2.raw
  modified_base (243)..(243): a, c, t, g, unknown or other
  misc_feature (243)..(243): n is a, c, g, or t
  modified_base (296)..(296): a, c, t, g, unknown or other
  misc_feature (296)..(296): n is a, c, g, or t
  modified_base (426)..(426): a, c, t, g, unknown or other
  misc_feature (426)..(426): n is a, c, g, or t
tcagacgcgatcgacacgaccggtgctcgatttagtatagacatcagggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgttttaagntgtctcctggtatcagcaacaccaggacaaacgcccccaaactcatcatttangatgtacaataatcggccctcgagggtttctcatcgcttctcctgctcaagtctggcacgtacgcctccctgacctatcctcgtcgggcctaccgaggctagaacgacgaggctgattatactgcagcanatatattagtcttacagtcgggtattcggcggacggactaaggttcgaccgtctaggtcacgtccaaggcctcgccccgtggccacgtctcgttcccccg

SEQ ID NO: 299354 - DNA, 575 bp, Homo sapiens
  misc_feature: GZ8MTXP02FPJ4R.45.75.G09.1.454.CMB.2.raw
tcagacgcgatcgacacgaccggtgctcgatttagtatagacatcagggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgtttttaagatgtctctggtatcagcaacaccaggcaaacgcccccaaactcatacatttatgatgtacaataatcggccctacgtagggttctcatcgcttctcctgctcaagtctggacactacggcctcctgaccctatctcgtggctccgagctagacgacgaggctgattagtactgcagcatatatattagtcgtttacacgttcgggtattcgggacgggtaacgggtaaccgtaaaggttcggtacccgttacgtacggtaccgtacgacccgtaaacggccgtcccgtcccccgttacgggtcctaaccgtccgttaccggtttcccccccg

SEQ ID NO: 299355 - DNA, 536 bp, Homo sapiens
  misc_feature: GZ8MTXP02HGUU0.45.75.G09.1.454.CMB.2.raw
  modified_base (227)..(227): a, c, t, g, unknown or other
  misc_feature (227)..(227): n is a, c, g, or t
  modified_base (242)..(242): a, c, t, g, unknown or other
  misc_feature (242)..(242): n is a, c, g, or t
tcagacgcgatcgacacgaccggtgctcgatttagtatagacatcgagggggggtctcaggaggcagcgctctcgggacgtctccaccatggcctgggctctgctattcctcaccctcctcactcagggcacagggtcctgggcccagtctgccctgactcagcctgcctcctgtctgggtctcctggacagtcgatcaccatcccctgcactggactccagcggtnacgttatgttttaanatgtctctgtatcagcaacaccaggacaaacgccccaaactcatcatttatgtatgtacaataaatcggccctcgtaaggggtttctcgtaattccgtcttctccgtcggacctaccgaagttctggctacgtaccggcctcccgtcgaccctagtcctcgttcgggccttccgacgctagaacgacgaggctgattatcgtgcagcacatatatagtgttcagtcggtattcggcgaggactagttgaccgtcgacgtcacgcaagcgtcgccctggtccacgtctcgtcccg

SEQ ID NO: 299356 - DNA, 634 bp, Homo sapiens
  misc_feature: GZ8MTXP02H0FP8.45.75.G09.1.454.CMB.2.raw
  modified_base (241)..(241): a, c, t, g, unknown or other
  misc_feature (241)..(241): n is a, c, g, or t
  modified_base (292)..(292): a, c, t, g, unknown or other
  misc_feature (292)..(292): n is a, c, g, or t
tcagacgcgatcgacacgaccggtgctcgatttagtatagacatcagggggggtctcaggaggcagcgctctcgggacgtctccaccatggcctgggctctgctattcctcaccctcctcactcagggcacagggtcctgggcccagtctgccctgactcagcctgcctcctgtctgggtctcctggacagtcgatcaccatcccctgcactggatccagcggtgacgttactgttttaanatgtctcctggtatcagcaacaccaggcaaacgccccaaatcatcatttangatgtacaataactcggtcctcgtacggggtttctcatcgcttctctgtctcaagtctggactacgtaccggcctccctgacctatcctcgtcgggtcctccgacggctaggaaacgacgaacggtctaggtaattacttacgtacgacagactaactaattataagtttacgttacgtttacctaaccggttcggggttacgttaccggggacgggtaacggggtaccgtaaacgggttacggtaccccggttacgtacgggttaccgaaccggtaccccgaaagggtcccgtccggtcccccgttacggtcctacccgtttccgttccggtttccccccg

SEQ ID NO: 299357 - DNA, 650 bp, Homo sapiens
  misc_feature: GZ8MTXP02HF0BJ.45.75.G09.1.454.CMB.2.raw
  modified_base (286)..(286): a, c, t, g, unknown or other
  misc_feature (286)..(286): n is a, c, g, or t
  modified_base (288)..(288): a, c, t, g, unknown or other
  misc_feature (288)..(288): n is a, c, g, or t
  modified_base (301)..(301): a, c, t, g, unknown or other
  misc_feature (301)..(301): n is a, c, g, or t
tcagacgcgatcgacacgaccggtgctcgatttagtatagacatcagggggctctgggagaggagcccagcactgggattccgaggtgtttccattcagtgatctgcactgaacacagaggactcgccatggagtttgggctgagcgtgggttttcctgttgctatttaaaaggtgtccagtctgaggagcagctggtggagtctgggggaggcttggtccaggccggggggtccctcagactctcgtgtgcagcctctggattcaccgtcagtggcagcttccgngngcgtcggccgcgnggccacgagggacggcgtggaggtggtctagtaagttaatttagacgacgcacgagtcgtacacgactagtacgttaccggtaacggccgtacttccacctactcctacgaacgacgtaactaacttacccgaacggtaaaccgtacggtttcgtttacgtaacgtaaacttacgaaaccctacccgtaggaaccggaaccccggagggaacccgtaccggtccttaacgtaacttacgttacgtgtacggacgtaaggacgaccgtacccgaaacccgaacggaacccggtaaaataacttaccgaaacgtaaacgtacgtacggtagtacggtacgtacggtacggg

SEQ ID NO: 299358 - DNA, 566 bp, Homo sapiens
  misc_feature: GZ8MTXP02ILJUR.45.75.G09.1.454.CMB.2.raw
  modified_base (289)..(289): a, c, t, g, unknown or other
  misc_feature (289)..(289): n is a, c, g, or t
tcagacgcgatcgacacgaccggtgctcgatttagtatagacatcagggggagaggagcccagcactgggattccgaggtgtttccattcagtgatctgcactgaacacagaggactcgccatggagtttgggctgagctgggttttccttgttgctatttaaaggtgtccagtctgaggagcagctggtggagtctgggggaggcttggtccaggccggggggtccctcagactctcgtgtgcagcctctggattcaccgtcagtggcagcttcctgagctgggtccnccaggctccgagggaggcctggagtgggctcagttaattttgacaggcacgagcgtactacgcagattcccgtaggggcccagttccacctatctccagagacaattccaggaacacggttgtttacttagaaatgaactaccctgacgaacccgaggaccgacggctactatattaatgtgcgagagactacgaacccaggacccgaaaagaaacttacaaacaactaacgtaacggtatacggtacgtacgtcggggaccgtaacggggaacccg

SEQ ID NO: 299359 - DNA, 547 bp, Homo sapiens
  misc_feature: GZ8MTXP02GGQEK.45.75.G09.1.454.CMB.2.raw
  modified_base (294)..(294): a, c, t, g, unknown or other
  misc_feature (294)..(294): n is a, c, g, or t
tcagacgcgatcgacacgaccggtgctcgatttagtatagacatcaggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgttttaagatgtctcctggtatcagcaacacccaggcaaacgcccccaaatcatcatttangatgtcaataatcggcctcgaggggtttctcatcgcttctcctgctcaagtctggcatacggcctcctgacctatctctgggctccgagctagaagacgaggctagattatactgcagcaactatactattagtcgtttaccacgttcgggtattcgggcggacgggtacctaaggttcgaacccgttcctaagggtccacgacccgaaggtccgtcgcccccgttcggtctaccgtcttacggtttcccccg

SEQ ID NO: 299360 - DNA, 518 bp, Homo sapiens
  misc_feature: GZ8MTXP02GWV6W.45.75.G09.1.454.CMB.2.raw
  modified_base (319)..(319): a, c, t, g, unknown or other
  misc_feature (319)..(319): n is a, c, g, or t
tcagacgcgatcgacacgaccggtgctcgatttagtatagacatcagggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgtttttaagtatgtctcctggtatcagcaacacccaggcaaagcccccaaactcatcatttatgatgtacaataatcggcccctntaggggttttctcatcgcttctcctgctcaagtctggcagtaccggcctccctgaccatctctggctccgagctgaagacgaggctgattatactgcagcacatatattagtgtttaccagtacgggtattcggacggacggacaagttcgaccgttcaggtcacgcccaggcctcgcccctggccacgtctcgtcccc

SEQ ID NO: 299361 - DNA, 528 bp, Homo sapiens
  misc_feature: GZ8MTXP02FZKCZ.45.75.G09.1.454.CMB.2.raw
  modified_base (296)..(296): a, c, t, g, unknown or other
  misc_feature (296)..(296): n is a, c, g, or t
  modified_base (316)..(316): a, c, t, g, unknown or other
  misc_feature (316)..(316): n is a, c, g, or t
tcagacgcgatcgacacgaccggtgctcgatttagtatagacatcaggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgtttttaagatgtctcctggtatcagcaacacccaggcaaacgcccccaaactcatcatttangatgtcaataatcggccctnagggtttctcatcgcttctcctgctcaagtctggcatacgcctcctgaccatctctgggcctccgaggctagaagacgaggctagtattattactgcagcaacattaatattacgtgtttaccagttcgggtattcgggacggacggacctaaggtttcgaccgttcctaggtcacgcccaaggcctcgcccctggccacgtctacttcccc

SEQ ID NO: 299362 - DNA, 576 bp, Homo sapiens
  misc_feature: GZ8MTXP02GFOBP.45.75.G09.1.454.CMB.2.raw
  modified_base (293)..(293): a, c, t, g, unknown or other
  misc_feature (293)..(293): n is a, c, g, or t
tcagacgcgatcgacacgaccggtgctcgatttagtatagacatcagggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgttttaagatgtctctggtatcagcaacaccaggcaaacgccccaaactcatcatttangatgtacaataactcggccctcgtaggggtttctcatcgcttctcctgctccaagtctggacagtaccggcctcctcgaccatctctggcctccaggctagaagacgaggctagtattattactgcagcacatatattagtgtttaccacgttcggttagttcgggacgggtacggaaccgtaaggttacggtacccggttaccgtacggttaccgaacggtccccgaaagggtcccgtaccggtcccccgttcggtcctaccgtcgtttcccgtttcccccg

SEQ ID NO: 299363 - DNA, 509 bp, Homo sapiens
  misc_feature: GZ8MTXP02GJH5N.45.75.G09.1.454.CMB.2.raw
  modified_base (244)..(244): a, c, t, g, unknown or other
  misc_feature (244)..(244): n is a, c, g, or t
  modified_base (298)..(298): a, c, t, g, unknown or other
  misc_feature (298)..(298): n is a, c, g, or t
  modified_base (350)..(350): a, c, t, g, unknown or other
  misc_feature (350)..(350): n is a, c, g, or t
tcagacgcgatcgacacgaccggtgctcgatttagtatagacatcagggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgtttttaagntgtctcctggtatcagcaacacccaggcaaacgcccccaaaactcatcatttangatgtcaatatcggccctcgaggggtttctcatcgcttctctgctcaagtcnggcatacggcctcctgaccatctctgggctccagctgaagacgaggctgtattatatgctagcacatatattagtgtttccacgtcggtattcggcggaggacagttgaccgtcgtacgtcacgcccaagcgtcgcccctcggccacgtctcgttcccc

SEQ ID NO: 299364 - DNA, 606 bp, Homo sapiens
  misc_feature: GZ8MTXP02JTXAC.45.75.G09.1.454.CMB.2.raw
  modified_base (215)..(215): a, c, t, g, unknown or other
  misc_feature (215)..(215): n is a, c, g, or t
  modified_base (599)..(599): a, c, t, g, unknown or other
  misc_feature (599)..(599): n is a, c, g, or t
  modified_base (601)..(603): a, c, t, g, unknown or other
  misc_feature (601)..(603): n is a, c, g, or t
  modified_base (605)..(606): a, c, t, g, unknown or other
  misc_feature (605)..(606): n is a, c, g, or t
tcagacgcgatcgacacgaccggtgctcgatttagtatagacatcaggggtccctcagactctcgtgtgcagcctctggattcaccgtcagtggcagcttcctgagctgggtccgccaggctccagggaagggcctggagtgggtctcagttaatttttagacaggcacagcgtactacgcagattccgttaagggccattcaccatctccaganacaattccaggaacacggtgtttctgaaatgaacaccctgacgacccgaggacacggctctatattactgtgcgagagatccgaacccaggaaccccggaaagtaaacttcaacaactactacggtatcggacgtcgtcggggaccaacgggaccccaccgtcacccgtctcctcgacgccctccgaaccgacgggccccagtcccggtcccttcccccgtcgccctacccctccctacccaacgacgccacccgtcgtcgggggccacgacggcccggcccgtcggggcctcggcccgtcgggtaccaacggtaccttaccgttcccgtcgacgtcgccgtctcggacggcgggcgtcggacgacggccgcgtagaaggcgcncnnncnn

SEQ ID NO: 299365 - DNA, 530 bp, Homo sapiens
  misc_feature: GZ8MTXP02HUTS0.45.75.G09.1.454.CMB.2.raw
  modified_base (435)..(435): a, c, t, g, unknown or other
  misc_feature (435)..(435): n is a, c, g, or t
tcagacgcgatcgacacgaccggtgctcgatttagtatagacatcagggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgtttttaagatgtctcctggtatcagcaacacccaggcaaagcccccaaatcatcatttatgatgtacaataatcggccctcaggggtttctcatcgcttctcctggcctcaagtctggcagtacggccctccctcgacctatctctgggcctccgagctgaagacgaggctgattatactgtcagcacatataattagtntttccacgtcgggttattcgggcggagggtacaagttcgaccgtcgtacgtcacgcccaaggcctcgacccctcggtccactcttacgttccccc

SEQ ID NO: 299366 - DNA, 583 bp, Homo sapiens
  misc_feature: GZ8MTXP02HJNL1.45.75.G09.1.454.CMB.2.raw
tcagacgcgatcgacacgaccggtgctcgatttagtatagacatcatgggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgttttaagatgtctctggtatcagcaacacccaggacaaacgccccaaactcatcatttatgatgtacaataactccgccctcgtagggttctcgatcgtcttctctgctcagtctggctaacgtacgccctccctagacctactctcgtcggcctaccgaggtctaggaacgaccgaggtctagtattattacgtcgacacgtcaactataattagttacgttcgtttaccgacgttcgggttacgttcggggacggtaacgggacctaggtacgaccgttccgtaacggtccgacgacccgaaggtcctccggtaccccgtcggtcctaacccttcgtttcccccg

SEQ ID NO: 299367 - DNA, 564 bp, Homo sapiens
  misc_feature: GZ8MTXP02HSENA.45.75.G09.1.454.CMB.2.raw
  modified_base (245)..(245): a, c, t, g, unknown or other
  misc_feature (245)..(245): n is a, c, g, or t
  modified_base (395)..(395): a, c, t, g, unknown or other
  misc_feature (395)..(395): n is a, c, g, or t
  modified_base (438)..(438): a, c, t, g, unknown or other
  misc_feature (438)..(438): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgtttttaagntgtctctggtatcagcaacaccagcaaacgccccaaatcatctatttatgatgtacaataactcggcctcgtagggtttctcactcgtcttctcctcggctccaagtctggacacgtaccggccctcctcgaccatctcgtggctaccgnggtctaggaagacggaggtctagtattagtactggcagctaanattatatttaagtcgtttacaacgttcgggtattcgggacggtaacgggtacctaaaggttcgaccgtcgttacggcacgcccgaaggtcctccgccccgttcggcctaccttcgttccttccccc

SEQ ID NO: 299368 - DNA, 496 bp, Homo sapiens
  misc_feature: GZ8MTXP02HQALK.45.75.G09.1.454.CMB.2.raw
  modified_base (208)..(208): a, c, t, g, unknown or other
  misc_feature (208)..(208): n is a, c, g, or t
  modified_base (244)..(244): a, c, t, g, unknown or other
  misc_feature (244)..(244): n is a, c, g, or t
  modified_base (317)..(317): a, c, t, g, unknown or other
  misc_feature (317)..(317): n is a, c, g, or t
  modified_base (407)..(407): a, c, t, g, unknown or other
  misc_feature (407)..(407): n is a, c, g, or t
  modified_base (413)..(413): a, c, t, g, unknown or other
  misc_feature (413)..(413): n is a, c, g, or t
  modified_base (439)..(439): a, c, t, g, unknown or other
  misc_feature (439)..(439): n is a, c, g, or t
  modified_base (484)..(484): a, c, t, g, unknown or other
  misc_feature (484)..(484): n is a, c, g, or t
tcagacgcgatcgacacgaccggtgctcgatttagtatagacatcagggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatccccngcactggatccagcggtgacgttactgtttttaagntgtctcctggtatcagcaacacccaggcaaacgccccaaactcatcatttatgatgtacaataatcggccctntaggggtttctcatcgcttctctgctcagtctggcatacgcctcctcgaccatctctggctccagctagaagacgaggctgattatactncagcanatatattgtgttcagtcggtatcggnggaggacagtcgacgtctagtcacgccaaggctcgcccctcgtcnctctcgttcccc

SEQ ID NO: 299369 - DNA, 518 bp, Homo sapiens
  misc_feature: GZ8MTXP02FQ1JF.45.75.G09.1.454.CMB.2.raw
  modified_base (295)..(295): a, c, t, g, unknown or other
  misc_feature (295)..(295): n is a, c, g, or t
  modified_base (440)..(440): a, c, t, g, unknown or other
  misc_feature (440)..(440): n is a, c, g, or t
  modified_base (458)..(458): a, c, t, g, unknown or other
  misc_feature (458)..(458): n is a, c, g, or t
tcagacgcgatcgacacgaccggtgctcgatttagtatagacatcagggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgtttttaagatgtctctggtatcagcaacaccaggacaaacgccccaaactcatcatttangatgtacaataatcggccctcgtaggggtttctcgatcgtcttctctgctcaagtctggcataccggcctcctcgacctatcctcgtgggctcccgaggctaggaagacgaggtctagattatactgcagcacattatattagtnttcattcgggtattcggngaggacaggttgaccgtctagtcacgcccgaaggcctcgccctcgtcacgtctcgtcccc

SEQ ID NO: 299370 - DNA, 524 bp, Homo sapiens
  misc_feature: GZ8MTXP02JXRPM.45.75.G09.1.454.CMB.2.raw
  modified_base (296)..(296): a, c, t, g, unknown or other
  misc_feature (296)..(296): n is a, c, g, or t
  modified_base (414)..(414): a, c, t, g, unknown or other
  misc_feature (414)..(414): n is a, c, g, or t
  modified_base (449)..(449): a, c, t, g, unknown or other
  misc_feature (449)..(449): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgtttttaagatgtctctggtatcagcaacacccaggcaaagcccccaaactcatcatttangatgtcaataatcggccctcaggggtttctcatcgcttctcctggctcaagtctggcatacggcctccctgaccatctctgggctccagctgaagacgagctgattatactgcagcanatatattagtgtttccacgttcgggttattcgggnggaacggggtaccaaggttcgaccgtcgtacggcacgcccaaggcctcgccccctcggccactctcgtttccccc

SEQ ID NO: 299371 - DNA, 579 bp, Homo sapiens
  misc_feature: GZ8MTXP02IKUTT.45.75.G09.1.454.CMB.2.raw
  modified_base (363)..(363): a, c, t, g, unknown or other
  misc_feature (363)..(363): n is a, c, g, or t
  modified_base (445)..(445): a, c, t, g, unknown or other
  misc_feature (445)..(445): n is a, c, g, or t
  modified_base (477)..(477): a, c, t, g, unknown or other
  misc_feature (477)..(477): n is a, c, g, or t
  modified_base (502)..(502): a, c, t, g, unknown or other
  misc_feature (502)..(502): n is a, c, g, or t
tcagacgcgatcgacacgaccggtgctcgatttagtatagacatcagggggctctgggagaggagcccagcactgggattccgaggtgtttccattcagtgatctgcactgaacacagaggactcgccatggagtttgggctgagctgggttttcctgttgctattttaaaaggtgtccagtctgaggagcagctggtggagtcgtgggggaggcttggtccgaggcccgggggggtccctcgagactctcgtgtgcagcctctggattcaccgtcagtggcagccttcctggagcgtgggtcccgccgaggcctaccgaggggaacgggccgtgggagtgggtctcgtagttaattttaganacggcacgagcgtacacgcagtacttaccggtaagggccgtactcgacctatcctacagacgactaatccgaagactggttnttctagaatgaacaccgtgacgaccgagaccncgctactagtactcgtgtgcgaganactacgaaaccgaggaacccggaataacgttacaacgaaacgttacgtacggtagtacggtaacgtcggtaacgggg

SEQ ID NO: 299372 - DNA, 614 bp, Homo sapiens
  misc_feature: GZ8MTXP02GB4W0.45.75.G09.1.454.CMB.2.raw
  modified_base (309)..(309): a, c, t, g, unknown or other
  misc_feature (309)..(309): n is a, c, g, or t
  modified_base (476)..(476): a, c, t, g, unknown or other
  misc_feature (476)..(476): n is a, c, g, or t
tcagacgcgatcgacacgaccggtgctcgatttagtatagacatcagggggctctgggagaggagcccagcactgggattccgaggtgtttccattcagtgatctgcactgaacacagaggactcgccatggagtttgggctgagctgggttttccttgttgctattttaaaaggtgtccagtctgaggagcagctggtggagtcgtgggggaggcgttggtccgagggcccgggggggtccctcgagactctcgtgtgcagcctcgtggattcaccgtcagtggcagcttcctgagcgtggggtcccnccgtaggcctccgaggggaacggccgtgggagtgggtctacgtaagttaattttagacaggcacgagcgtactacgcaggtacttccggttaaagggcctattcacctatccacagacgaactaattccgaaggaactacggttcgtttactagaaactacgaaacncctaggaacgacccgaagggacaaccggcttacgtaattacttacgtgtagcgaagagactaccgaaacccgacggaaccccgaaagtaactacctaacgaaactaacgtacgtagtcggtaacgtcgtaaccggggg

SEQ ID NO: 299373 - DNA, 540 bp, Homo sapiens
  misc_feature: GZ8MTXP02JMM4C.45.75.G09.1.454.CMB.2.raw
  modified_base (245)..(245): a, c, t, g, unknown or other
  misc_feature (245)..(245): n is a, c, g, or t
  modified_base (296)..(296): a, c, t, g, unknown or other
  misc_feature (296)..(296): n is a, c, g, or t
  modified_base (327)..(327): a, c, t, g, unknown or other
  misc_feature (327)..(327): n is a, c, g, or t
  modified_base (350)..(350): a, c, t, g, unknown or other
  misc_feature (350)..(350): n is a, c, g, or t
tcagacgcgatcgacacgaccggtgctcgatttagtatagacatcaggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgtttactgtttttaagtntgtctcctggtatcagcaacaccaggcaaacgcccccaaatcatcatttangatgtacaataatcgaccctcgagggtttcncatcgcttctcctgctcaagtcngcagtcgcctccctgacctatctctgggcctcgagtctagaagacgaggctgtattatactgcagcacattatattagtcgtttaccagttcggtagttcgggcgggaaggtacccgtaggttcgacccgtactacggtccacggacccaggcgtcccgccccttcggccaccgttcgtccgttaccccc

SEQ ID NO: 299374 - DNA, 691 bp, Homo sapiens
  misc_feature: GZ8MTXP02H2M8J.45.75.G09.1.454.CMB.2.raw
  modified_base (267)..(267): a, c, t, g, unknown or other
  misc_feature (267)..(267): n is a, c, g, or t
  modified_base (308)..(308): a, c, t, g, unknown or other
  misc_feature (308)..(308): n is a, c, g, or t
  modified_base (387)..(387): a, c, t, g, unknown or other
  misc_feature (387)..(387): n is a, c, g, or t
tcagacgcgatcgacacgaccggtgctcgatttagtatagacatcagggggctctgggagaggagcccagcactgggattccgaggtgtttccattcagtgatctgcactgaacacagaggactcgccatggagtttgggctgagctgggttttccttgttgctattttaaaaggtgtccagtctgaggagcagctgggtggagtcgtgggggaggcgttggtccgagggcccgggggggtccctcgagactctcgtgtgcagcctntggattcaccgtcagtggcagcttcctgagcgtgggtcccnccgaggcctccgaggggaacgggccgtgggaggtcgggtctcgaagtttaattttagacaggcacgagcgtactacgcngtacttaccggtaacgggcctagttccacctatcctaccaagacgaactaaacttcccgaaagggtaaaccctacgggttcgttttaccgtagaaaactttaccggaaaacctacccccggttaaggaaccggtaaacccccggaagggaacccaccgggtacccttacgttaactaacgtttacgtggcgtaacggaaggaacgtaccgacccgaaaacccgaacggaaaccccggaaaataaacttaccctaaacgtaaacttaacgtacggtaacgtcgggtaaccgtacggtaccggggg

SEQ ID NO: 299375 - DNA, 621 bp, Homo sapiens
  misc_feature: GZ8MTXP02H74MN.45.75.G09.1.454.CMB.2.raw
  modified_base (297)..(297): a, c, t, g, unknown or other
  misc_feature (297)..(297): n is a, c, g, or t
  modified_base (330)..(330): a, c, t, g, unknown or other
  misc_feature (330)..(330): n is a, c, g, or t
tcagacgcgatcgacacgaccggtgctcgatttagtatagacatcagggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgtttttaagtatgtctcctggtatcagcaacaccaggcaaacgcccccaaactcatcatttangatgtacaataatcggccctcgtaggggtttcnctatcgtcttctctggctccaagtctggctagtaccggcctccctgaccctatcctctcgggtctccaggctgaagacgagctgattatactgcagcactatattattagttcgtttaccacgttcgggtaactttcgggacgggtaacgggtaacctaaacggtttcggaacccggtttaccgtaacgggttacccgaaccggttaccccgaaaacgggggccttacccgggtacccccccgtttcggggtacccctaaccctttcccgttacccggttttcccccccgg

SEQ ID NO: 299376 - DNA, 566 bp, Homo sapiens
  misc_feature: GZ8MTXP02JLPMM.45.75.G09.1.454.CMB.2.raw
  modified_base (279)..(279): a, c, t, g, unknown or other
  misc_feature (279)..(279): n is a, c, g, or t
  modified_base (293)..(293): a, c, t, g, unknown or other
  misc_feature (293)..(293): n is a, c, g, or t
  modified_base (438)..(438): a, c, t, g, unknown or other
  misc_feature (438)..(438): n is a, c, g, or t
tcagacgcgatcgacacgaccggtgctcgatttagtatagacatcaggggagctctgggagaggagcccagcactgggattccgaggtgtttccattcagtgatctgcactgaacacagaggactcgccatggagtttgggctgagctgggttttccttgtggctattttaaaaggtgtccagtctgaggagcagctggtggagtcgtggggggaggcttgggtccgaggccgggggggtccctcgagactctcgtgtgcagcctctggattcaccgtnagtggcagcttccngagcgtgggtccgccaggctccgagggacggcctgggagtgggtctcgtagtaatttttagaccaggcacagcgtactacgctagattccggttaagggccgtattccacctatctacccagagacaataccaggaacacggttnttactagaaatcgaaacacccgtagacgacccgagtaccgacgctactatactacgtgagcgagagacgtacgaaccacgacccgaagtaactaactaactaactacgtacgtactacggacgtacgg

SEQ ID NO: 299377 - DNA, 635 bp, Homo sapiens
  misc_feature: GZ8MTXP02H31TB.45.75.G09.1.454.CMB.2.raw
  modified_base (248)..(248): a, c, t, g, unknown or other
  misc_feature (248)..(248): n is a, c, g, or t
  modified_base (333)..(333): a, c, t, g, unknown or other
  misc_feature (333)..(333): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgtttacttgtttttaagtntgtctcctggtatcagcaacaccaggcaaacgcccccaaatcatcatttatgatgtacaataactcggccctgacggggttttcncacttcgcttctctgtcctcaagtctggactagtaccggctccccgtgaccctatccttcgtcgggcctccgaggctggaaacgtacgaggtctagtatttactactgacagacaactatattagtttacgttcgtttacctaacgttcgggttacgttcgggacgggtaacgggtaccgtaaaggtttaccgacccggttaccgtaacgggttaccaaccggttacccgaaaacggggtccctacccggtacccccgttaccggggtcctaaccccgttcgtttaccccggtttccccccg

SEQ ID NO: 299378 - DNA, 642 bp, Homo sapiens
  misc_feature: GZ8MTXP02I6I09.45.75.G09.1.454.CMB.2.raw
  modified_base (285)..(285): a, c, t, g, unknown or other
  misc_feature (285)..(285): n is a, c, g, or t
tcagacgcgatcgacacgaccggtgctcgatttagtatagacatcagggggggagaggagcccagcactgggattccgaggtgtttccattcagtgatctgcactgaacacagaggactcgccatggagtttgggctgagcttgggttttccttgttgcttattttaaaaggtgtccagtctgaggagcagctggtggagtcgtgggggaggcttgggtccaggccggggggtccctcagactctcgtgtgcagcctctggattcaccgtcagtggcagcttccngagctgggtcctcaggctcgaggggacggcctggaggtgggtctcgtagtttaatttttagacgaggcacagccgtacgtacgctagtacgttacgttacggggccgtattaccgacctattccgtaccaaggacgtaactaaagttcccgaaagggaaacctacgggtttagtttaccttaaggaaaacttcgaaaacctacccgtaggaacgaccccggaaggaccgaccggtactactattaccttagtgtacgcgagacgtactaaccggaacccaacggaacccggaaataaacttactaaacacttaacgtaaccgttagcggaacgtcgtcggggaccaacggtaacccg

SEQ ID NO: 299379 - DNA, 802 bp, Homo sapiens
  misc_feature: GZ8MTXP02G607S.45.75.G09.1.454.CMB.2.raw
tcagacgcgatcgacacgaccggtgctcgatttagtatagacatcagggggctctgggagaggagcccagcactgggattccgaggtgtttccattcagtgatctgcactgaacacagaggactcgccatggagtttgggctgagctgggttttccttgttgcttattttaaaaggtgtccagtctgaggagcagcgtggtggagtcgtgggggaggtcgttgggtccgagggtcccgggggggtccctcgagtactctcgtgtgcagcctcgtggacttccgaccgtcaggtcggcagtccttccgtgacggtccgtcggggtccccgccgacgggcctcccggaaggggaacgggtccgtagggaggtcggggtcttacgtaaagttttaaagtttttacggaacgacgggtacctaacgtaacggtaccgttaaccgtaaccggacgtacgggttaaccgtttacccggggttaaaacggggtccccgtaacgtttacccgaaacccctaacgtttaccccgacccgtaaaaggaaccgaaaccttaaacgtttacccggaaaagggtaacccgtaacggggtttctttaccgttaagaaaacttacggaaaccctacccgtaggaacccggaaccggtaacggaccgtaaccggtccttacgtaattacttacgtcgtacgacggtaagacgtacgtacccggaaaacccgtaaacggaaaccccggtaaaattaaaccttaccgtaaaaccaaccgttaaacgtacggtaagtaccgggtacgtcggtaaaccgggg

SEQ ID NO: 299380 - DNA, 530 bp, Homo sapiens
  misc_feature: GZ8MTXP02GEVY4.45.75.G09.1.454.CMB.2.raw
tcagacgcgatcgacacgaccggtgctcgatttagtatagacatcgagggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgtttttaagatgtctctggtatcagcaacaccaggcaaagcccccaaatcatcatttatgatgtacaataatcggccctgaggggtttctcatcgcttctctggctcaagtctggcatacgcctcctgaccatctctcgggctcccgagctagaagacgagctgattatactgcagcacattatattagttcgtttacacgtcgggttattcggggacggaaggacctaaaggttcgaccgtcgtacggtcacgcccaaggcctacgcccctcggtccacgtcttcgttaccccc

SEQ ID NO: 299381 - DNA, 555 bp, Homo sapiens
  misc_feature: GZ8MTXP02JXKPJ.45.75.G09.1.454.CMB.2.raw
  modified_base (299)..(299): a, c, t, g, unknown or other
  misc_feature (299)..(299): n is a, c, g, or t
  modified_base (367)..(367): a, c, t, g, unknown or other
  misc_feature (367)..(367): n is a, c, g, or t
  modified_base (419)..(419): a, c, t, g, unknown or other
  misc_feature (419)..(419): n is a, c, g, or t
  modified_base (425)..(425): a, c, t, g, unknown or other
  misc_feature (425)..(425): n is a, c, g, or t
  modified_base (500)..(500): a, c, t, g, unknown or other
  misc_feature (500)..(500): n is a, c, g, or t
tcagacgcgatcgacacgaccggtgctcgatttagtatagacatcagggggctctgggagaggagcccagcactgggattccgaggtgtttccattcagtgatctgcactgaacacagaggactcgccatggagtttgggctgagctgggttttccttgttgctattttaaaaggtgtccagtctgaggagcagctggtggagtctgggggaggcttggtccaggccgggggggtccctcagactctcgtgtgcagcctctggattcaccgtcagtggcagcttcctgagctgggtccnccgaggctccgaggggaaggcctggagtgggtctcgagttaattttagacagcacagcgtactacgcngactccgttaaagggccattcaccatcctccagacgacaattccgaggaacncggttntttctagaaatgaaacaccctgacgacccgaggacacggctcgtaatacttactgtgcgagagatccgaaacccnggaacccggaagtaaacttcgaacaactacgtacggtatcggaacttcgacgggg

SEQ ID NO: 299382 - DNA, 598 bp, Homo sapiens
  misc_feature: GZ8MTXP02IQ9W9.45.75.G09.1.454.CMB.2.raw
  modified_base (223)..(223): a, c, t, g, unknown or other
  misc_feature (223)..(223): n is a, c, g, or t
  modified_base (253)..(253): a, c, t, g, unknown or other
  misc_feature (253)..(253): n is a, c, g, or t
  modified_base (277)..(277): a, c, t, g, unknown or other
  misc_feature (277)..(277): n is a, c, g, or t
  modified_base (308)..(308): a, c, t, g, unknown or other
  misc_feature (308)..(308): n is a, c, g, or t
  modified_base (576)..(576): a, c, t, g, unknown or other
  misc_feature (576)..(576): n is a, c, g, or t
  modified_base (590)..(590): a, c, t, g, unknown or other
  misc_feature (590)..(590): n is a, c, g, or t
  modified_base (592)..(593): a, c, t, g, unknown or other
  misc_feature (592)..(593): n is a, c, g, or t
  modified_base (595)..(595): a, c, t, g, unknown or other
  misc_feature (595)..(595): n is a, c, g, or t
  modified_base (597)..(598): a, c, t, g, unknown or other
  misc_feature (597)..(598): n is a, c, g, or t
tcagacgcgatcgacacgaccggtgctcgatttagtatagacatcaggggatggtgatcgactgtcctgggcccagtctgccctgactcagcctgcctccctgtctgggtctcctggacagtcgatcaccatcccctgcactggatccagcggtgacgttactgtttttaagatgtctcctggtatcagcaacaccaggcaaacgccccaaatcatcatttangatgtacaatatcggccctgaggggtttcncatcgcttctctggctccaagtcnggtacaatacggccctcctgacctatctcgngggctccgaggctagaagacgaggtctagatttatactgcagcacattaatagtttagtcgttttaccaacgttcggggtaaattccgggtacggacgggtaccaaaggtttcggaacccgtccgtaaggtaccaacggtaccccgaaagggtccctccggtacccccgttcgggtacctaaccctttccgttaccgttcccccgcccttcccttcctcgtacgtccgtcgtctcgggacgtccgggggctcgggaccgaacgggccncgaagtaacgcgcncnncncnn

SEQ ID NO: 299383 - DNA, 519 bp, Homo sapiens
  misc_feature: GZ8MTXP02IAZKN.45.75.G09.1.454.CMB.2.raw
  modified_base (245)..(245): a, c, t, g, unknown or other
  misc_feature (245)..(245): n is a, c, g, or t
  modified_base (324)..(324): a, c, t, g, unknown or other
  misc_feature (324)..(324): n is a, c, g, or t
tcagacgcgatcgacacgaccggtgctcgatttagtatagacatcagggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttacttgttttaagtntgtctcctggtatcagcaacacccaggcaaagcccccaaatcatcatttatgatgtcaatatcggccctgagggtttcncatcgcttctctgctcagtctggcataccggcctcctgaccatctctcgggctccgagctagaagcgagctgattagtatgcagcacatatattagtacgttcacgttcggttattcgggacggacggtacaaggttcgacgttcgtaacgtcgacgcccgaagccgtcgcccgtcgtccaccgtctcgtccccc

SEQ ID NO: 299384 - DNA, 509 bp, Homo sapiens
  misc_feature: GZ8MTXP02FOA3R.45.75.G09.1.454.CMB.2.raw
  modified_base (410)..(410): a, c, t, g, unknown or other
  misc_feature (410)..(410): n is a, c, g, or t
tcagacgcgatcgacacgaccggtgctcgatttagtatagacatcagggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgtttttaagatgtctcctggtatcagcaacacccaggcaaagcccccaaactcatcatttatgatgtcaataatcggccctcaggggtttctcatcgcttctctgctcaagtctggcatacgctcctgaccatctctggctccgagctgaagacgaggctgattatactgcagcanatatattagtgtttaccagtcggtattcgggcgaaggggaccaggttgaccgtctacggtcacgccaaggctcgccccctggccactctcgttcccccg

SEQ ID NO: 299385 - DNA, 542 bp, Homo sapiens
  misc_feature: GZ8MTXP02INYU6.45.75.G09.1.454.CMB.2.raw
  modified_base (243)..(243): a, c, t, g, unknown or other
  misc_feature (243)..(243): n is a, c, g, or t
  modified_base (317)..(317): a, c, t, g, unknown or other
  misc_feature (317)..(317): n is a, c, g, or t
  modified_base (406)..(406): a, c, t, g, unknown or other
  misc_feature (406)..(406): n is a, c, g, or t
tcagacgcgatcgacacgaccggtgctcgatttagtatagacatcaggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgttttaagtntgtctcctggtatcagcaacaccaggcaaagcccccaaaactcatcatttatgatgtcaaataatcggcccttnagggtttctcatcgcttctctgctcatctggcatacgcctccctgacctatctctggctccaggctgaagacgaggctgattatactgnagcacattatattagttcgtttaccagttcgggtattcgggcggaacgggtacctaaaggtttgacccgttacgtacggttcgacgccctaaagggcttccgcccccgttcggtctaaccttccgtcgtttccccc

SEQ ID NO: 299386 - DNA, 748 bp, Homo sapiens
  misc_feature: GZ8MTXP02JXLOH.45.75.G09.1.454.CMB.2.raw
  modified_base (275)..(275): a, c, t, g, unknown or other
  misc_feature (275)..(275): n is a, c, g, or t
  modified_base (303)..(303): a, c, t, g, unknown or other
  misc_feature (303)..(303): n is a, c, g, or t
tcagacgcgatcgacacgaccggtgctcgatttagtatagacatcagggggctctgggagaggagcccagcactgggattccgaggtgtttccattcagtgatctgcactgaacacagaggactcgccatggagtttgggctgagctgggttttccttgttgctattttaaaaggtgtccagtctgaggagcagctggtggagtcgtgggggaggcttggtccaggcccgggggggtccctcagactctcgtgtgcagcctctggattcaccgtnagtggcagcttcctgagcgtgggtcccnccaggcctccgaggggaaggccgtgggagtggggtctcgtaagtttaattttagacacggctacgacgtacgtactacgcagtacttaccggtaaagggcccgtattcccgaacctagtcctacccgaagtacgaactaaacttacccgaaagggtaaacctacggggttagtttaccgttaaggtaaaacttacggaaaccctaaccccgttacggaaccggaacccccggaacggggtaacccaaccgggtaccttaaccgtaatttaaaccgtttaacgttggtacggaaccggtaaaggaacggtaaccgttaaccggaaaaccccgaaacgggtaaacccccggggtaaaacgtaaaaccgtttacctaaaaccgtaaaaccgttaaaccggtaaacgggtttaacgtacggggttaaccggtacggttaaacccggggg

SEQ ID NO: 299387 - DNA, 645 bp, Homo sapiens
  misc_feature: GZ8MTXP02JAU5E.45.75.G09.1.454.CMB.2.raw
  modified_base (287)..(287): a, c, t, g, unknown or other
  misc_feature (287)..(287): n is a, c, g, or t
  modified_base (299)..(299): a, c, t, g, unknown or other
  misc_feature (299)..(299): n is a, c, g, or t
tcagacgcgatcgacacgaccggtgctcgatttagtatagacatcagggggctctgggagaggagcccagcactgggattccgaggtgtttccattcagtgatctgcactgaacacagaggactcgccatggagtttgggctgagctgggttttccttgttgctattttaaaaggtgtccagtctgaggagcagctggtggagtctgggggaggcttggtccagggccggggggtccctcgagactctcgtgtgcagcctctggattcaccgtcagtgcagcttccngagctgggtccncgaggctccgagggaggcctggagtgggtctcgtagttaattttagacaggcacagacgtactacgcagacttaccggttaagggccgattccgaaccattcctccgaagaacgaacaactttcccgaaaggtaacccgacgggtttcgtttaacctagaaaacttcggaaaccctaccccgttaggaaccgaacccccggaaggacccgaaccgggtcttaccgttaattaagttacctggtacgaccggtaagaacgtataccggaaaccccaggaaaccccgggaaataaacttccaaaacaacttacgtaacggtacgtacggtaccggtcgtaaccggggg

SEQ ID NO: 299388 - DNA, 854 bp, Homo sapiens
  misc_feature: GZ8MTXP02IDN4M.45.75.G09.1.454.CMB.2.raw
  modified_base (323)..(323): a, c, t, g, unknown or other
  misc_feature (323)..(323): n is a, c, g, or t
  modified_base (364)..(364): a, c, t, g, unknown or other
  misc_feature (364)..(364): n is a, c, g, or t
tcagacgcgatcgacacgaccggtgctcgatttagtatagacatcagggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatccaccactcccctgcacgtggactccgaggcggtagtacgtttactttagttttaagtattcgtctccgtggtatcagaccaaaccacccgaaggaccaaaccgacccccaaatcatactatttangtatcgtaactaataacgtccggcccttagtacgggtttcnctactccgtccttctacccgtcggtactaccgaagttcgtacggactaccgtccggtccctacccgtacgaaccctacgtccgttccgtccggggtccctaccggtaggtacccgtaaggaaacggtaccgggtaacggtccgttaagggttaaacttttaacgtttaaaccgtcgaaccggtaacgtaaccgtaaaccgttaatttaaaagtttaacgtttttaacgggtttacccggttttaaccccggaaaccggggttttaccgggggtttaacggggtttaccccgggggaaccggggtaaaaccgggggtttaacccgttaaaaacggggttttcccggtaaacccccggtttaccggttaaacgggggtttacccaaaccgggtaacccccggtaaaccgggtccccgttacccccgggtccccccgtttacggggtaccccctttaacccgttaccccggttttccccgttaaacccccccg

SEQ ID NO: 299389 - DNA, 495 bp, Homo sapiens
  misc_feature: GZ8MTXP02FLJLB.45.75.G09.1.454.CMB.2.raw
  modified_base (226)..(226): a, c, t, g, unknown or other
  misc_feature (226)..(226): n is a, c, g, or t
  modified_base (266)..(266): a, c, t, g, unknown or other
  misc_feature (266)..(266): n is a, c, g, or t
  modified_base (359)..(359): a, c, t, g, unknown or other
  misc_feature (359)..(359): n is a, c, g, or t
  modified_base (488)..(495): a, c, t, g, unknown or other
  misc_feature (488)..(495): n is a, c, g, or t
tcagacgcgatcgacacgaccggtgctcgatttagtatagacatcaggggatggtgatcgactgtcctgggcccagtctgccctgactcagcctgcctccctgtctgggtctcctggacagtcgatcaccatcccctgcactggatccagcggtgacgttactgtttttaagtatgtctcctggtatcagcaacacccaggcaaagcccccaaactcatcatttangatgtcaataatcggccctcaggggtttctcatcgcttcnctggctccaagtctggcaatacggcctccctgaccatctctgggctccaggctagaagacgagctgattattactgcagcacatatattagtntttcactcgggtattcggcggaggaccaagttgaccgtccaggtcagccaaggctcgcccctggtcactctcgtccccgccctctctcgatccgcgtcgtgcggcggcgtggacaacggcgcagtaagnnnnnnnn

SEQ ID NO: 299390 - DNA, 517 bp, Homo sapiens
  misc_feature: GZ8MTXP02FNV56.45.75.G09.1.454.CMB.2.raw
  modified_base (294)..(294): a, c, t, g, unknown or other
  misc_feature (294)..(294): n is a, c, g, or t
  modified_base (315)..(315): a, c, t, g, unknown or other
  misc_feature (315)..(315): n is a, c, g, or t
  modified_base (325)..(325): a, c, t, g, unknown or other
  misc_feature (325)..(325): n is a, c, g, or t
  modified_base (364)..(364): a, c, t, g, unknown or other
  misc_feature (364)..(364): n is a, c, g, or t
  modified_base (415)..(415): a, c, t, g, unknown or other
  misc_feature (415)..(415): n is a, c, g, or t
tcagacgcgatcgacacgaccggtgctcgatttagtatagacatcagggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgttttaagatgtctctggtatcagcaacaccaggcaaacgcccccaaactcatcatttangatgtacaataatcggccctnaggggtttcncatcgcttctctggctcaagtctggcagtacggcctccngaccatcctctgggctccagctagaagacgaggctgattatactgcagcanattatattagtcttaccagttcgggtatcgggcggaacggacctaaaggttcgaaccgtctaggtcacgcctaggctcgccctcggtcactctcgttacccc

SEQ ID NO: 299391 - DNA, 584 bp, Homo sapiens
  misc_feature: GZ8MTXP02JVR3R.45.75.G09.1.454.CMB.2.raw
  modified_base (227)..(227): a, c, t, g, unknown or other
  misc_feature (227)..(227): n is a, c, g, or t
  modified_base (245)..(245): a, c, t, g, unknown or other
  misc_feature (245)..(245): n is a, c, g, or t
  modified_base (295)..(295): a, c, t, g, unknown or other
  misc_feature (295)..(295): n is a, c, g, or t
tcagacgcgatcgacacgaccggtgctcgatttagtatagacatcagggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccactcccctgcactggatccagcggtnacgttacttgttttaagntgtctctggtatcagcaacaccaggcaaacgccccaaatcatctatttangtatgtacaaataacgtccggaccctcgtacgggtttctctatcgtcttctcctgctacctagtctgctactccgcctccctgacctactctcgtggcctcagctagaacgacgtacgcgttagtatttacttactacggacacgacactaatattaattacgttcgtttacctacgttcgggtacgttcgggacgggtacggtaaccgtaggtcgtaccgtaccgtaggtaccacgtacccgaacgccgtcccgtccccgtccggtactaccgtcctaccgttccccc

SEQ ID NO: 299392 - DNA, 525 bp, Homo sapiens
  misc_feature: GZ8MTXP02G8UGN.45.75.G09.1.454.CMB.2.raw
  modified_base (239)..(239): a, c, t, g, unknown or other
  misc_feature (239)..(239): n is a, c, g, or t
  modified_base (315)..(315): a, c, t, g, unknown or other
  misc_feature (315)..(315): n is a, c, g, or t
  modified_base (358)..(358): a, c, t, g, unknown or other
  misc_feature (358)..(358): n is a, c, g, or t
  modified_base (375)..(375): a, c, t, g, unknown or other
  misc_feature (375)..(375): n is a, c, g, or t
  modified_base (397)..(397): a, c, t, g, unknown or other
  misc_feature (397)..(397): n is a, c, g, or t
  modified_base (423)..(423): a, c, t, g, unknown or other
  misc_feature (423)..(423): n is a, c, g, or t
tcagacgcgatcgacacgaccggtgctcgatttagtatagacatcagggggggtctcaggaggcagcgctctcgggacgtctccaccatggcctgggctctgctattcctcaccctcctcactcaggacacagggtcctgggcccagtctgccctgactcagcctgcctccgtgtctgggtctcctggacagtcgatcaccatctcctgcactggaaccagcagtgatgttgggattanaaccttgtctctggtaccaacagcacccaggcaaacgcccccaaactcatgatttatgaggcagtaagcggccctnaggggtttctaaatcgcttctctcggctccaagtctggcaacncggcctcctgacaatcnctgggctccaggctgaggacgnggctgattatactgctgctcatatgnaggtagtagtacgtttggtgttcggaggacgggaccaaggcctagaccgttactacggtacgacgcccgaaggctacgcccccgtcggtccacgttctcccg

SEQ ID NO: 299393 - DNA, 723 bp, Homo sapiens
  misc_feature: GZ8MTXP02I5N9V.45.75.G09.1.454.CMB.2.raw
  modified_base (291)..(291): a, c, t, g, unknown or other
  misc_feature (291)..(291): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctcctgtctgggtctcctggacagtcgatcaccatcccctgcactggactccaggcggtgacgttactgttttaagatgtctctgtatcagcacaccagcaaacgccccaaatcatcatttangtatgtacaatactcggcctcgtagggttcacatcgtcttctctcgctacagtctcggactacgtaccggtccctaccctacgaccctatcctacgtcgggtcccttacccgaggtccttaaggaaacggaaccggtagggtaccgtttaggtaaacttttaacgttaaacgttcggtaccgtaaacggaacctaaaccggtaaatttaaacgtttaagtttttaacgggtttaccgttttacccccggtaacggtttacgggggtttaaacggtttcccggggacggggtaaaaccgggggtaccttaaaacgggttcggtaaccccggttaccgttaacgggtacctaccggtaaccccgaacggtcccgtacccggtacccccggttccgggtaccttaaccccgttccgtttaccgtttacccccccg

SEQ ID NO: 299394 - DNA, 589 bp, Homo sapiens
  misc_feature: GZ8MTXP02JYQDB.45.75.G09.1.454.CMB.2.raw
  modified_base (248)..(248): a, c, t, g, unknown or other
  misc_feature (248)..(248): n is a, c, g, or t
  modified_base (308)..(308): a, c, t, g, unknown or other
  misc_feature (308)..(308): n is a, c, g, or t
  modified_base (442)..(442): a, c, t, g, unknown or other
  misc_feature (442)..(442): n is a, c, g, or t
  modified_base (453)..(453): a, c, t, g, unknown or other
  misc_feature (453)..(453): n is a, c, g, or t
tcagacgcgatcgacacgaccggtgctcgatttagtatagacatcagggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatccccctgcactggactccagcggtgacgttacttgtttttaagtntgtctcctggtatcagcaacaccagacaaacgcccccaaatcatccatttactgatgtanaataatccggtccctgtacggggtttctctatccgtcttctccgtggctaccgaagtctaggcagtacccggccttcccgtgaccatcctcgtgggcctccgaggtctagaagacggagcttagatttattacngtccagaccanatattattagttcgtttaccagttcgggttattccgggacggtacggtacaaggttcgaccgttaccgtacggtaccgacgtcccgaacggtccgccgtacccccgcggttcctaccgttcctaccgtttaccccc

SEQ ID NO: 299395 - DNA, 527 bp, Homo sapiens
  misc_feature: GZ8MTXP02GWHC2.45.75.G09.1.454.CMB.2.raw
  modified_base (297)..(297): a, c, t, g, unknown or other
  misc_feature (297)..(297): n is a, c, g, or t
tcagacgcgatcgacacgaccggtgctcgatttagtatagacatcagggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgtttactgtttttaagatgtctcctggtatcagcaacacccaggcaaacgcccccaaatcatcatttangatgtcaaataatcggcctcgtaggggtttctcatcgcttctccgtgtctccaagtctggctagtaccggcctccctgaccatctcgtcgggcctccgaggcctaggaaacgacgacggctagtattatactgccagcacatatattagtgttccagtcggtattcggacggacggactagttgaccgtcgtagtcacgccaagctcgccccgtgtcactctcgtccccg

SEQ ID NO: 299396 - DNA, 586 bp, Homo sapiens
  misc_feature: GZ8MTXP02HHW60.45.75.G09.1.454.CMB.2.raw
  modified_base (339)..(339): a, c, t, g, unknown or other
  misc_feature (339)..(339): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttacttgttttaagattgtctctgtatcagcacaccaggcaaacgcccccaaactcatcatttatgtatgtacaataatccggccctcgtagggtttctcatcgcttcncctgctcagtctggacagtaccggcctccctgacctatctcgtcgggtctcccgaggctaggaacgacgaggctagtaattattacgtgcaagtctaactattattattagttacgtttaccgaacgttcgggtaagtttcggggacggtaacgggtaacctaaggttcgaccggtaccgtaggtaccacggacccgaaggtcccgtcgtcccccgtcggtccctacgttccgttccgttccccccg

SEQ ID NO: 299397 - DNA, 602 bp, Homo sapiens
  misc_feature: GZ8MTXP02HJHSN.45.75.G09.1.454.CMB.2.raw
  modified_base (227)..(227): a, c, t, g, unknown or other
  misc_feature (227)..(227): n is a, c, g, or t
  modified_base (260)..(260): a, c, t, g, unknown or other
  misc_feature (260)..(260): n is a, c, g, or t
  modified_base (295)..(295): a, c, t, g, unknown or other
  misc_feature (295)..(295): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtnatgttgggattataaccttgtctctgtaccaanagcaccaggcaaacgcccccaaatcatgtatttangaggcagtaagcggcctgtagggtttctaatcgtcttctctggccctcaagtctaggcaaccgacgtcctcccgtagacctaatccgtcgcgggtcctaccgaggtcctgacgggacggagggtctagtatttaattacgtgtctgtccttacgtattagtgacggtaggtagttagttacggtttggtggttccggacggggtaggaccgtaaggtccgtacggacccgttccgtaagggtccacggaccccgtaaggtcccgtcccgcccccgttcggccctaccgttccgtccgtttccccccg

SEQ ID NO: 299398 - DNA, 625 bp, Homo sapiens
  misc_feature: GZ8MTXP02IZDQ2.45.75.G09.1.454.CMB.2.raw
tcagacgcgatcgacacgaccggtgctcgatttagtatagacatcaggggagctctgggagaggagcccagcactgggattccgaggtgtttccattcagtgatctgcactgaacacagaggactcgccatggagtttgggctgagctgggttttccttgttgctattttaaaaggtgtccagtctgaggagcagctggtggagtcgtgggggaggcttgggtccgaggcccgggggggtccctcgagactcgtcgtgtgcagcctctggattcaccgtcagtggcacgtcttccgtgagcgtcggggtccgccgaggcctaccggaggggaacgggccgtgggaggtgggtctcgtaagttaaatttttagaccgaggcacgagcgtactacgcgagtacgttaccggttaaggccgtattccaccatcctaccaagacgaactaattaccgaaggaactacggttgtttactagaaactacgaaaccacccgtagaccgacccggaagaccgacggtactactaagttactacgtgacgacgagacggtaactaccgaaacccgacgaaacccggaaataaacttaacctaacaaactacgtaacgtacgacggtacgtacgg

SEQ ID NO: 299399 - DNA, 673 bp, Homo sapiens
  misc_feature: GZ8MTXP02GCQ54.45.75.G09.1.454.CMB.2.raw
tcagacgcgatcgacacgaccggtgctcgatttagtatagacatcaggggagctctgggagaggagcccagcactgggattccgaggtgtttccattcagtgatctgcactgaacacagaggactcgccatggagtttgggctgagcttgggttttccttgttgtctaattttaaaaggtgtccagtctgaggagcagcgtggtggagtcggtgggggaggtcgttgggtccgacgggcccgggggggtccctcgagactcgtcgtgtgcacgcctctggtacttcaccgtcagtggcagtccttcctgacgtcgtcgggtcccgccgacggcctcccggaggggaacgggccgtgggaggtggggtctacgtaagtttaaagtttttacgaaccgtaggtacaacgacggtacgtaaccttacgcgtaacgtaacgtttaccgggttaaacgggcccgtacgtttaccaacccgtaatccctaaccgaagaactaactaacgttaccgaaaggtaactacggttgttactagaaaattcgaaactacccgtagaccgaccggagacacggtctactaacttagtacgtgtcgacgaaggacacgtaccgaaaccgacggaaaacccgagtaaactaacgaaactaacacgtacggtactacgggacgtacgg

SEQ ID NO: 299400 - DNA, 616 bp, Homo sapiens
  misc_feature: GZ8MTXP02H5MLE.45.75.G09.1.454.CMB.2.raw
tcagacgcgatcgacacgaccggtgctcgatttagtatagacatcagggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggactccagcggtgacgtttacttgtttttaaagtattcgtctccgttggtatcagcaaccaccaggaccaaacgcccccaaatcatcctatttatgtatgtacaaataacgtcggccctgtacggggtttcacgtatccgtcttctccctggtcctacgaagttctaggactacgtccggcctcccctgaccctactctcgtcgctccgagtcgtagaagacgagtctagtatttatactgaactgacataatagttagtttagttcgtttaccacgttcgggttacgttcggggcgggtaacggtaccgtaaggttcggaccttaccggtacggtaccgtacgtacccgaaggttcccgccgtccccgttacggtctacccgttcgttacccgttcccccg

SEQ ID NO: 299401 - DNA, 669 bp, Homo sapiens
  misc_feature: GZ8MTXP02IWATL.45.75.G09.1.454.CMB.2.raw
tcagacgcgatcgacacgaccggtgctcgatttagtatagacatcaggggagctctgggagaggagcccagcactgggattccgaggtgtttccattcagtgatctgcactgaacacagaggactcgccatggagtttgggctgagctgggttttccttgttgctattttaaaaggtgtccagtctgaggagcagctggtggagtcgtgggggaggcgttggtccaggccgggggggtccctcgagactctcgtgtgcagcctctggattcaccgtcagtggcagcttcctgacgcgtgggtccgccaggcctacccgaggggaacgggcccgtgggtaggtgggtctcgtagttaagtttttagaccgaggtcacgagtcgtaactacgcgtagtacgtttaccggtaaacgggccgtaatttccgaacctactcctcccgaagacgaaacctaattacccgaacggtaaaccgtacggtttacgtttacctttaagaaaacttcggaaaaccctaccccgttaggaaccgaaaccccgggaaggaccgaaccgggtacttaccgtaattaacttacgtgttacgacgtagagactaccgaacccgaacgaacccgaaagtaaacgttcctaaacgtaacctacgtaacgtacgtacggtacgtacgg

SEQ ID NO: 299402 - DNA, 640 bp, Homo sapiens
  misc_feature: GZ8MTXP02IPJNG.45.75.G09.1.454.CMB.2.raw
tcagacgcgatcgacacgaccggtgctcgatttagtatagacatcaggggagctctgggagaggagcccagcactgggattccgaggtgtttccattcagtgatctgcactgaacacagaggactcgccatggagtttgggctgagctgggttttccttgttgctattttaaaaggtgtccagtctgaggagcagctggtggagtcgtgggggaggtcttgggtccgaggccgggggggtccctcgagactctcgtgtgcagcctctggacttcaccgtcagtggcagcttcctgagctgggtccgccaggcctaccgaggggaacggcctgggaggtgggtctcgtaagttaaatttttagaccgtaggacacgagcgtaactacgcaagtactttccggttaaagggcccgtattccacattcaccaagacgactaaagttaccaaggtaaactacggttcgtttacttaagaaaattacgaaaccacccgtagaacgacccgaaggaccacggtctactaattacttacgtgtacggacgagtaaggactaaccggaaaacccgacggaaaacccggaaagtaaacttaacctaaacgaaaccttaacgtaacggtaactacgggtaacgtaccggg

SEQ ID NO: 299403 - DNA, 631 bp, Homo sapiens
  misc_feature: GZ8MTXP02HZUZQ.45.75.G09.1.454.CMB.2.raw
  modified_base (291)..(291): a, c, t, g, unknown or other
  misc_feature (291)..(291): n is a, c, g, or t
  modified_base (447)..(447): a, c, t, g, unknown or other
  misc_feature (447)..(447): n is a, c, g, or t
tcagacgcgatcgacacgaccggtgctcgatttagtatagacatcaggggagctctgggagaggagcccagcactgggattccgaggtgtttccattcagtgatctgcactgaacacagaggactcgccatggagtttgggctgagctgggttttccttgttgctaattttaaaaggtgtccagtctgaggagcagctggtggagtcgtgggggagcttggtccgaggcccgggggggtccctgagactctcgtgtgcagcctctggattcaccgtcagtggcagcttccngagcgtgggtcccgccgaggcctccgaggggacggccgtgggagtgggtcctgtagttaatttttagaccaggtacacgagcgtactacgcagtattccgtaagggcctaattcacctatcctccagacgacaattaccaaggaactacgggtttntttactagaaactacgaaacctaccgtagaccgacccggaaggaccgaccgtactactaattacttacgtgtacgacgagaacgtaaccgacccggaaacccgaaccgggtaaacccgtaaaagtaaaccttaaccgtaaacctaaaccgttacgtaacggtacggtacgggttaccggtacgg

SEQ ID NO: 299404 - DNA, 638 bp, Homo sapiens
  misc_feature: GZ8MTXP02I8NUJ.45.75.G09.1.454.CMB.2.raw
  modified_base (382)..(382): a, c, t, g, unknown or other
  misc_feature (382)..(382): n is a, c, g, or t
tcagacgcgatcgacacgaccggtgctcgatttagtatagacatcagggggctctgggagaggagcccagcactgggattccgaggtgtttccattcagtgatctgcactgaacacagaggactcgccatggagtttgggctgagctgggttttccttgttgctattttaaaaggtgtccagtctgaggagcagctggtggagtcgtgggggaggcttggtccgagggcccgggggggtccctcgagactctcgtgtgcagcctctggattcaccgtcagtggcagcttcctgagtccgtgggtcccgcgaggcctccgaaggggaacggccgtgggagtgggtctcgtagttatttagacaggtcacgagcgtactacgcngtacttcggtaagggccagttcacctatctccagacgactaatacccgagtacgacggttgtttactagaaactagaaaccacccgtaggaacgaaccccggaggaaccaacggtctactaatacgttactggtcgacgaagagtaacaccggaaacccccaaaggacccccgggaaaataaacgtttaccaaaaccgtaaaccgtaaacgttaaccggggtaattacggggaacccggtttacggtaaccggggg

SEQ ID NO: 299405 - DNA, 619 bp, Homo sapiens
  misc_feature: GZ8MTXP02JZ8UR.45.75.G09.1.454.CMB.2.raw
  modified_base (248)..(248): a, c, t, g, unknown or other
  misc_feature (248)..(248): n is a, c, g, or t
  modified_base (302)..(302): a, c, t, g, unknown or other
  misc_feature (302)..(302): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggactccaggcggtgacgtttacttgttttaagntgtctctggtatcagcaacacccaggacaaacgcccccaaactcatctatttangtatgtacaaataactccggcccctcgtacggggtttctctactcgtctttctcccgtgcctactaagtctggactacgtaccggccctaccctgacctatcctcgtcggcctccgagctagaagtacgaggctagtattacttactgcagacactattattagttagttcgttaccgtacgttcgggtacgttacgggacgggtaacgggtaaccgtaagggttccggacccgttaccggtacggtaccgaccggtacccgaacggtccgtcccggtaccccgttcggtacctccgttccgtcccggtttcccccg

SEQ ID NO: 299406 - DNA, 554 bp, Homo sapiens
  misc_feature: GZ8MTXP02JTFCU.45.75.G09.1.454.CMB.2.raw
  modified_base (245)..(245): a, c, t, g, unknown or other
  misc_feature (245)..(245): n is a, c, g, or t
tcagacgcgatcgacacgaccggtgctcgatttagtatagacatcagggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggactccagcggtgacgtttactgttttaagntgtctctggtatcagcacacccaggcaaacgcccccaaactcatcatttatgtatgtcaataatcgcctcgtagggttctcatcgcttctcctgctcagtctggcatacggcctcccgtgacatctcgtcgggctccgagctagaagacgagctgtaagttattactgcagctacatatagttgttcgtttacagttcggttagttcggcgggaacggtaccgtaggttacgtaccgtaccgttaagggtccacggtacccaacgggtctccgtcccccgttcggtacctccgtcgtccgtttcccccg

SEQ ID NO: 299407 - DNA, 612 bp, Homo sapiens
  misc_feature: GZ8MTXP02JQOC6.45.75.G09.1.454.CMB.2.raw
  modified_base (291)..(291): a, c, t, g, unknown or other
  misc_feature (291)..(291): n is a, c, g, or t
  modified_base (293)..(293): a, c, t, g, unknown or other
  misc_feature (293)..(293): n is a, c, g, or t
  modified_base (330)..(330): a, c, t, g, unknown or other
  misc_feature (330)..(330): n is a, c, g, or t
tcagacgcgatcgacacgaccggtgctcgatttagtatagacatcaggggagctctgggagaggagcccagcactgggattccgaggtgtttccattcagtgatctgcactgaacacagaggactcgccatggagtttgggctgagctgggttttcctgttgctattttaaaaggtgtccagtctgaggagcagctggtggagtcgtgggggagcttggtccgaggccgggggggtccctcgagactctcgtgtgcagcctctggattcaccgtcaggtggcagcttccgngngcgtcggccgcgcggcgtacggagggacggcgtgggnggtggtctagtagtttacgtttacgaccgtagacacgagtcgtacgacgcgtacgtacgttaccggtacggccgtactaccacctactcctacgaagacgtaactaacgtaccgaacggtaacgtacggttagttactaagtaaacgtacgaaaccgtaccgtagaccgaccggacgaccgacgtactatacttacttacgtgacgacgagacgaccgaccgaaccgacgaaccgtaataactaaccgtaacgtaactacgtacgtacgtacggtacggtcg

SEQ ID NO: 299408 - DNA, 549 bp, Homo sapiens
  misc_feature: GZ8MTXP02H7JII.45.75.G09.1.454.CMB.2.raw
  modified_base (244)..(244): a, c, t, g, unknown or other
  misc_feature (244)..(244): n is a, c, g, or t
  modified_base (318)..(318): a, c, t, g, unknown or other
  misc_feature (318)..(318): n is a, c, g, or t
  modified_base (378)..(378): a, c, t, g, unknown or other
  misc_feature (378)..(378): n is a, c, g, or t
  modified_base (385)..(385): a, c, t, g, unknown or other
  misc_feature (385)..(385): n is a, c, g, or t
tcagacgcgatcgacacgaccggtgctcgatttagtatagacatcaggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgtttttaagtntgtctcctggtatcagcaacacccaggcaaagcccccaaactcatcatttatgatgtcaaataatcggcccctnaggggtttctcatcgcttctcctgctccaagtctggcatacggcctccctgaccatctcnggctccngctgaagacgaggctgattattactgtcagctaacatattattagtgtttaccacgtcggttattcggtacgggacgggtacaaaggtttcgaccgttccgtacggtcgaacgcccgaacggccgtccgcccccgtcggtccctacgtccgttcgttccccccg

SEQ ID NO: 299409 - DNA, 641 bp, Homo sapiens
  misc_feature: GZ8MTXP02GD3R3.45.75.G09.1.454.CMB.2.raw
tcagacgcgatcgacacgaccggtgctcgatttagtatagacatcaggggagctctgggagaggagcccagcactgggattccgaggtgtttccattcagtgatctgcactgaacacagaggactcgccatggagtttgggctgagctggtttcctgttgctatttaaaggtgtccagtctgaggagcagctggtggagtcgtgggggaggcttgggtccgacggccgggggggtccctcgagactctcggtgtgcagcctcgtggtattccaccgtcaggtggcagtccttccgtgagcgtcgggtccgccaggctaccggaggggaacgggccgtgggacggtgggtctcgtaagtttaaacgtttttagaccgtaggacacgagtcgtactacgcgagtacgttaccggtaagggcctattaccgacctatcctaccaagacaactaaacttccgaaaggtaacctacgggtttacgtttactaagtaaaacgtacgaaacccgtacccgtaggaaccgaacccgggaagaacccgacggtactacgtactagttacgtgcgacgagacgtacaccgaaacgtaccgaaccggaaataaacttcaaacaactacgtacggtacgtcggaccgtacggg

SEQ ID NO: 299410 - DNA, 638 bp, Homo sapiens
  misc_feature: GZ8MTXP02IG3JJ.45.75.G09.1.454.CMB.2.raw
  modified_base (272)..(272): a, c, t, g, unknown or other
  misc_feature (272)..(272): n is a, c, g, or t
  modified_base (289)..(289): a, c, t, g, unknown or other
  misc_feature (289)..(289): n is a, c, g, or t
tcagacgcgatcgacacgaccggtgctcgatttagtatagacatcagggggctctgggagaggagcccagcactgggattccgaggtgtttccattcagtgatctgcactgaacacagaggactcgccatggagtttgggctgagcgtggttttctgtgctatttaaagtgtcagtctgaggagcagctggtggagtcgtgggggaggcttgggtccgaggtccggggggtccctcgagacgtctcgtgtgcagcctctggattcgaccgtnagtggcagcttcctggngcgtcggtccgcgcggcgtcgaggacggcgtggaggtggtcgtacgtagttaagtttagtacgacgacgacgacgtacgtacgtacgacgtacgtacgttacggttaacggtaccgtactactacctactacctacgacgaacgtaactaacgtaccgtaacgtaacgtacggttacgtttacgttacgtaaagtaacgtaaccgtaccgtacgacgaaccggaacggacgacgtacgtactaactacttacgtagtagacgacgacgacgaccgaaaccgaacgaaaccgtaaacgtaaactaactaacgtaacgtaacgtacgtaacgtacggtacgtacggtacgg

SEQ ID NO: 299411 - DNA, 565 bp, Homo sapiens
  misc_feature: GZ8MTXP02G2H62.45.75.G09.1.454.CMB.2.raw
  modified_base (391)..(391): a, c, t, g, unknown or other
  misc_feature (391)..(391): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgtttttaagatgtctcctggtatcagcaacacccaggcaaacgcccccaaactcatcatttatgatgtacaataatcggccctcgtaggggtttctcatcgctttctcctggctcagtctaggcactacggcctccctgaccatctctggctccgngctagaagacgagctagtattatctagcagcacatatattagtcttactacgtacggtattcgggacggaacggtaccgtaaaggttcgtaccggttaccgtacggttacgacgtcccgaaacggtcctcggtccccccgtcgggttaccaccttccgttccgtttcccccccg

SEQ ID NO: 299412 - DNA, 744 bp, Homo sapiens
  misc_feature: GZ8MTXP02HLFVM.45.75.G09.1.454.CMB.2.raw
  modified_base (294)..(294): a, c, t, g, unknown or other
  misc_feature (294)..(294): n is a, c, g, or t
tcagacgcgatcgacacgaccggtgctcgatttagtatagacatcagggggctctgggagaggagcccagcactgggattccgaggtgtttccattcagtgatctgcactgaacacagaggactcgccatggagtttgggctgagctgggttttccttgttgctattttaaaggtgtccagtctgaggagcagctggtggagtcgtgggggaggcttggtccgagggcccggggggtccctcgagactcgtcgtgtgcagcctcgtggattccgaccgtcagtgcagtcttccngacgcgtcgggtcccgccgaggcctccggaggggaacggtccgtggggaggttcggggtcttacgtaagttttaaagtttttacggtacgacgggtactacgtacggtaccgttaactaccgacgtacggtaacgtttacccgggtttaaacgggggccccttaatttacccgaacctactcccgtacccgaagtaacgaaacctaattcccgaaaaggaaccgttacggttactttaccgttagaaaacttcgaaaaccctacccgttaggaaccgaacccccggaaagggacccgaaaccggtcttaacttaagttacttaaccgtggtacgacgtaaaggacgtaacgtaacccggaaaacccaacgggaaacccgtaaaagtaaacctttaccaaaacctaaacgttacgtaaacggtacttacgggacgttacggtaaccggggg

SEQ ID NO: 299413 - DNA, 542 bp, Homo sapiens
  misc_feature: GZ8MTXP02JSCC6.45.75.G09.1.454.CMB.2.raw
  modified_base (297)..(297): a, c, t, g, unknown or other
  misc_feature (297)..(297): n is a, c, g, or t
  modified_base (327)..(327): a, c, t, g, unknown or other
  misc_feature (327)..(327): n is a, c, g, or t
  modified_base (351)..(351): a, c, t, g, unknown or other
  misc_feature (351)..(351): n is a, c, g, or t
  modified_base (367)..(367): a, c, t, g, unknown or other
  misc_feature (367)..(367): n is a, c, g, or t
  modified_base (377)..(377): a, c, t, g, unknown or other
  misc_feature (377)..(377): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgtttttaagtatgtctctggtatcagcaacacccaggcaaacgcccccaaatcatcatttangatgtcaataatcggcctctaggggtttcncatcgtcttctcctggctcagtcnggcacgtcggcctccngaccatctcnggtcctcaggctgaagacgagctgtattatctgcagcacatattattgtcgtttccgacgttcgggtagttcgggacggaggtaccgtaaagttcggaccgttccgtaggtccacggcccaagggccgtccgcccccgtacggtcctaccgtctacgtttccccc

SEQ ID NO: 299414 - DNA, 628 bp, Homo sapiens
  misc_feature: GZ8MTXP02HA2MD.45.75.G09.1.454.CMB.2.raw
  modified_base (246)..(246): a, c, t, g, unknown or other
  misc_feature (246)..(246): n is a, c, g, or t
  modified_base (382)..(382): a, c, t, g, unknown or other
  misc_feature (382)..(382): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggactccagcggtgacgttacttgttttaagntgtctctggtatcagcaacacccaggcaaacgcccccaaactcatctatttatgatgtacaattaatcggccctgtaggggtttctcatcgcttctcctgcctcaagtctggacacgtaccgcctccctagacctntccttcgtcgggtctccgaggtctaggaacgacgagggtcctagtaatttacgttacgttagccgtaagctaactaagttaattaagtttacgttacgttttacccgtaaccgggttaggtttaccgggtacggggtacgggtaacggtaaccgtacggttacccggttaccgtacggttaacgccgaccgtaaccggcgtccgtcccccgtaccgtcgtacctccgtaccgttccccgttacccc

SEQ ID NO: 299415 - DNA, 602 bp, Homo sapiens
  misc_feature: GZ8MTXP02GW8TP.45.75.G09.1.454.CMB.2.raw
tcagacgcgatcgacacgaccggtgctcgatttagtatagacatcaggggagctctgggagaggagcccagcactgggattccgaggtgtttccattcagtgatctgcactgaacacagaggactcgccatggagtttgggctgagctgggttttccttgttgctattttaaaaggtgtccagtctgaggagcagctggtggagtcgtgggggagcttggtccgaggccggggggtccctcgagactctcgtgtgcagcctctggattcaccgtcagtggcagcttcctgagcgtggtccgccaggcctccgaggggaggcctgggagtgggtctcgtagttaatttttagaccgaggcacgagtcgtacctacgcagtacttaccggttaaggggcctagtttccacctatcctacccagaacgacaattccgaaggtaactacgggttgtttacctaggaaaactcgaaaccacccgtagacgaaccccggaggaacccacggctactaatattacgtgtagcgagagaactaccggaacccacggaaccccggaaataaacgtaactaacgaacttacgtacggtatacggacgtacgg

SEQ ID NO: 299416 - DNA, 634 bp, Homo sapiens
  misc_feature: GZ8MTXP02I0M4H.45.75.G09.1.454.CMB.2.raw
  modified_base (310)..(310): a, c, t, g, unknown or other
  misc_feature (310)..(310): n is a, c, g, or t
  modified_base (462)..(462): a, c, t, g, unknown or other
  misc_feature (462)..(462): n is a, c, g, or t
tcagacgcgatcgacacgaccggtgctcgatttagtatagacatcagggggctctgggagaggagcccagcactgggattccgaggtgtttccattcagtgatctggactgaacacagaggactcgccatggagtttgggctgagctgggttttccttgttgctattttaaaaggtgtccagtctgaggagcagctggtggagtcgtgggggaggctttggtcccgagggcccgggggggtccctcgacgactctcgtgtgcagcctctggattcaccgtcaggtggcagcttcctgagctcggggtccnccgaggcctcgaggggaacgggcctagggagtcggggtctcgtagttaaattttttagacaggcccacagtcgtaactacgacagtagtttccgtaaggggcctattcccaacattcctaccagagacaaattccgaaggaacaccgggttntttccttagaaatgaaaccaccctgaacggacccgaggaccacggcctcgtaatacttaactggtagacgagaacgactaccgaaacccgacgaaaccccggaaagtaaaacttccgtaaacctaaactacgttaacggtactacgggacgtaccggtacggggaaacccgg

SEQ ID NO: 299417 - DNA, 720 bp, Homo sapiens
  misc_feature: GZ8MTXP02HP2VF.45.75.G09.1.454.CMB.2.raw
  modified_base (508)..(508): a, c, t, g, unknown or other
  misc_feature (508)..(508): n is a, c, g, or t
tcagacgcgatcgacacgaccggtgctcgatttagtatagacatcaggggggagaggagcccagcactgggattccgaggtgtttccattcagtgatctgcactgaacacagaggactcgccatggagtttgggctgagctgggttttccttgttgctattttaaaaggtgtccagtctgaggagcagctggtggagtcgtgggggaggcttgggtccaggcccggggggtccctcgagactctcgtgtgcagcctctggacttcaccgtcagtggcacgcttcctgagcgtcgggtccccgccgaggcctacccggaaggggaacggggcccgtggggaggttcggggtctacgtaaggtttaaagttttttagaaccgtaggctaacgacggtaccgtaacctacgctaaggtacgtttaccggttaacggggcctaatttaccaccctaattccctacaacggacgaaacctaacgttaccgaaagggtaacctaccggggtttntttttaccgtaaagtaaaagttcggaaaacccacccgttaggaaacccgacccggaaggtaccacggtcttaaccgtattaacgtttacgtgtcgacgaagaacgtactaccggaaaaccccgaaaggaaaccccggtaaaagtaaaacctttccgaaaactaccttaacggaacgttagtacggtacgaggtacggggacaacgggacccg

SEQ ID NO: 299418 - DNA, 562 bp, Homo sapiens
  misc_feature: GZ8MTXP02GEUNQ.45.75.G09.1.454.CMB.2.raw
  modified_base (295)..(295): a, c, t, g, unknown or other
  misc_feature (295)..(295): n is a, c, g, or t
tcagacgcgatcgacacgaccggtgctcgatttagtatagacatcagggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgtttttaagatgtctctggtatcagcaacaccaggcaaacgcccccaaactcatcatttangatgtcaataatcggccctgaggggtttctcatcgcttctcctgctcaagtctggctatacggccctcctgacctatctctgggcttccgagctagaagacgaggctgatttactacgtgcagacacattatagttaacgtgtttaccacgttcggggttattcggggacggacggggtaacctagggtttacgaccggttacctacggtcacggtcccaaggggtctacccggtcccctcgggtacctctccgtcgttaccccccg

SEQ ID NO: 299419 - DNA, 679 bp, Homo sapiens
  misc_feature: GZ8MTXP02IJNVJ.45.75.G09.1.454.CMB.2.raw
  modified_base (316)..(316): a, c, t, g, unknown or other
  misc_feature (316)..(316): n is a, c, g, or t
  modified_base (342)..(342): a, c, t, g, unknown or other
  misc_feature (342)..(342): n is a, c, g, or t
tcagacgcgatcgacacgaccggtgctcgatttagtatagacatcaggggagctctgggagaggagcccagcactgggattccgaggtgtttccattcagtgatctgcactgaacacagaggactcgccatggagtttgggctgagctgggttttccttgttgcttatttaaaaggtgtccagtctgaggagcagctggtggagtcgtgggggagcgttggtccgaggccggggggtccctcgagactctcgtgtgcagcctcgtggtactcaccgtcagtggcagcttccgtgagcgtcggtccgccgacggccnccggaaggggaacgggtccgtagggnggtcgggtctacgtaaggtttaaactttttaggaccgtaggaccacgacggtaccgttaacgtaccggctaaggttaacgtttacccgggttaaacggggacccgttacgttacccaaccgtacttcctacccgaagacgaacctaaacgttaccgaaacggtaacgtacggttgtttactaagtaaactcgaactaccgtagacgaccggaagacgacggtactacgtattattacgtgtacgcgtaagacacgtaccgaaaccgacgaaaccccggtaaagaaacgttaacctaacgtaaaccgtacgtaacggtacgtacggtaaccgtacggg

SEQ ID NO: 299420 - DNA, 781 bp, Homo sapiens
  misc_feature: GZ8MTXP02JO7O0.45.75.G09.1.454.CMB.2.raw
  modified_base (243)..(243): a, c, t, g, unknown or other
  misc_feature (243)..(243): n is a, c, g, or t
  modified_base (297)..(297): a, c, t, g, unknown or other
  misc_feature (297)..(297): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacttactgtttttaanatgtctctggtatcagcaacaccaggaccaaacgcccccaaatcatctatttangtatgtacaataactccggacccttcgtacgggttttctactacttccgtctttctcccgttacggccttacccgtaaggtttccgtacggtaccgtaaccgttaacccgggtccccttacccccgtttagaacccgttaacttcccgttaccggttaccgggggtcccttacccggacgggtacccgttaaggggaaacggtacggtacggtacgttaggtaaactttacttacgtacggactacggtaccctaattaattaacgtttagtttaaacgtttcgtttaccccggtaacgtttaccgggggtttaacggtttaccgggggacggggtaaccgggttaaaccggttaaacgggttaccggtaaccccggttacgtaacgggttaccgaaacccggtcccgtaaaccgggtcccgttaccccggtccccccggtttacgggtaccctaccgtttcccccgttcccgtttaccccccg

SEQ ID NO: 299421 - DNA, 571 bp, Homo sapiens
  misc_feature: GZ8MTXP02GDW6A.45.75.G09.1.454.CMB.2.raw
  modified_base (244)..(244): a, c, t, g, unknown or other
  misc_feature (244)..(244): n is a, c, g, or t
  modified_base (294)..(294): a, c, t, g, unknown or other
  misc_feature (294)..(294): n is a, c, g, or t
  modified_base (325)..(325): a, c, t, g, unknown or other
  misc_feature (325)..(325): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctcctgtctgggtctcctggacagtcgatcaccactcccctgcactggatccagcggtgacgttactgttttaagntgtctctggtatcagcaacaccaggcaaacgccccaaactcatcatttangatgtacaataactcggccctgagggtttcnctatcgtcttctccgtggcctcaagttctaggctactaccggcccttccctagaccctattccgtcgtcggggccttacccgagctaggaaacgtacgaggctagtattagtactgctagacactatattattaagttcgtttacacggttcggtaagttcgggacggtacggacctaggttcgaccgttcgacggtcacgtccgaaggcctccgaccccgtcggtctacgtccgtcgttcccccg

SEQ ID NO: 299422 - DNA, 596 bp, Homo sapiens
  misc_feature: GZ8MTXP02I8M7U.45.75.G09.1.454.CMB.2.raw
  modified_base (298)..(298): a, c, t, g, unknown or other
  misc_feature (298)..(298): n is a, c, g, or t
  modified_base (329)..(329): a, c, t, g, unknown or other
  misc_feature (329)..(329): n is a, c, g, or t
  modified_base (339)..(339): a, c, t, g, unknown or other
  misc_feature (339)..(339): n is a, c, g, or t
  modified_base (348)..(348): a, c, t, g, unknown or other
  misc_feature (348)..(348): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttacttgtttttaagatgtctcctggtatcagcaacaccaggcaaacgcccccaaactcatcatttangatgtcaaatatcggccctcgtagggtttcncatcgcttcnctgctcatntggcagtccgcctccctgaccctatctcgtcggctccgaggctaggaagacgagctagtattatctagcagtacactattattagtttaacgttgtttacccgacgttcgggttacgttccggggacgggtaacgggtaacccgtaaggtttaccggacccggttaccgttaacggtccgaaccggtcccgaaaggtcccgttacccgcccccggtcggtacctaccgttccgtccggtttccccccg

SEQ ID NO: 299423 - DNA, 654 bp, Homo sapiens
  misc_feature: GZ8MTXP02GLRET.45.75.G09.1.454.CMB.2.raw
  modified_base (245)..(245): a, c, t, g, unknown or other
  misc_feature (245)..(245): n is a, c, g, or t
  modified_base (285)..(285): a, c, t, g, unknown or other
  misc_feature (285)..(285): n is a, c, g, or t
  modified_base (295)..(295): a, c, t, g, unknown or other
  misc_feature (295)..(295): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgtttttaagnttgtctctggtatcagcaacacccagcaaacgccccaaancatcatttangatgtacaaataatccggacctcgtagggtttctctactcgtcttctcccgtgcctactaacgtctacggactaacgtccggcctcccgtacgaccctaattccttcgtcgggtctcccgaaggtctaggaaagacgacggctagtaattaattacgtgacagtacaactaattaattaagtttaacgttcgttaaccctacggttaccgggttaacgtttccggggtacggaaacgggggttaacctaaaacgggtttcgaaacccggtttaccgtaacggtaccgaaccggacccctaaacgggccttcccggccccccgttaggtacccacccgttccgttaccggtttccccccg

SEQ ID NO: 299424 - DNA, 524 bp, Homo sapiens
  misc_feature: GZ8MTXP02FH8DK.45.75.G09.1.454.CMB.2.raw
  modified_base (250)..(250): a, c, t, g, unknown or other
  misc_feature (250)..(250): n is a, c, g, or t
  modified_base (314)..(314): a, c, t, g, unknown or other
  misc_feature (314)..(314): n is a, c, g, or t
  modified_base (369)..(369): a, c, t, g, unknown or other
  misc_feature (369)..(369): n is a, c, g, or t
tcagacgcgatcgacacgaccggtgctcgatttagtatagacatcagggggttctcaggaggcagcgctctcgggacgtctccaccatggcctgggctctgctattcctcaccctcctcactcagggcacagggtcctgggcccagtctgccctgactcagcctgcctccctgtctgggtctcctggacagtcatcaccatcccctgcactggatccagcggtgacgttactgtttttaagatgtctccnggtatcagcaacacccaggcaaagcccccaaatcatcatttatgatgtcaataatcggcccctnaggggtttctcatcgcttctcctggctccagtctggcataccggcctcctgaccnctctctgctccagctgaagacgaggctgtattattactgcagcacatatattagtgttctacgtcggtagttcggcggagggacgaacgtacgtaccgtccgtacgtcgacgacccgaacggccgtcgccccgtccggtccacctctcttccccc

SEQ ID NO: 299425 - DNA, 582 bp, Homo sapiens
  misc_feature: GZ8MTXP02H6ZSW.45.75.G09.1.454.CMB.2.raw
  modified_base (241)..(241): a, c, t, g, unknown or other
  misc_feature (241)..(241): n is a, c, g, or t
tcagacgcgatcgacacgaccggtgctcgatttagtatagacatcagggggggtctcaggaggcagcgctctcgggacgtctccaccatggcctgggctctgctattcctcaccctcctcactcagggcacagggtcctgggcccagtctgccctgactcagcctgcctcctgtctgggtctcctggacagtcgatcaccatcccctgcactggatccagcggtgacgttatgttttaagntgtctctggtatcagcaacaccaggacaaacgccccaaatcatcattatgatgtacaataatcggcctgtaggggttctcatcgcttctccctggtctccaaggttcgtacgactacgtaccgcctcctacgactacgtctcgtcgacgtcgacgtacgacgaagacgacgtacgtagtattacgttacgtacgacgacgacgactaataattagttacgttacgttacgtacgtacggtacggtacggtacggtaacggtacgtacgtacgtaccgtacgtacgtacgtacgaccgacgtaaccgtccgtcccgtccgtaccgtacctccgtccgtcccg

SEQ ID NO: 299426 - DNA, 569 bp, Homo sapiens
  misc_feature: GZ8MTXP02IQ73V.45.75.G09.1.454.CMB.2.raw
  modified_base (392)..(392): a, c, t, g, unknown or other
  misc_feature (392)..(392): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgtttacttgtttttaagtatgtctcctggtatcagcaacaccaggcaaacgcccccaaactcatcatttatgatagtacaataatcggccctcgtagggtttctcatcgcttctctgcctacagtctgacatacggcctccctgaccctatctcgtggctcgngctgaagacgagctgtattatactgacagacctatatattaacttagtttcgtttacctacggttcgggttaagttcgggacggaacgggtactaaggtttcgaccgttacgtacgtcgtaccgacccgaacggtccgtccgtccccgttcgtacgtaccttcgtccgtttcccccg

SEQ ID NO: 299427 - DNA, 710 bp, Homo sapiens
  misc_feature: GZ8MTXP02IPIA5.45.75.G09.1.454.CMB.2.raw
tcagacgcgatcgacacgaccggtgctcgatttagtatagacatcaggggggagaggagcccagcactgggattccgaggtgtttccattcagtgatctgcactgaacacagaggactcgccatggagtttgggctgagcttgggttttccttgttgctattttaaaaggtgtccagtctgaggagcagctggtggagtcgtgggggaggcttgggtccgaggcccggggggtccctcgagactctcgtgtgcagcctcgtggattcgaccgtcaggtggcagtcttcctgagcgtcgggtccgccaggcctccgaggggaacggccgtggagtcggggtctacgtagtttaatttttagacgaggcacacgccgtactacgctagtacgttaccggtacggggcctacttccgaccctataccgtaccaagacgaaactaacgttaccgaaagggtaaccgtacggtttacgtttaccgttaagaaaagttaccggaaaacctacccgttaggaaacccggtaacccggaacggaacccgtaccgggtaccttacgttaaacttacgttacgttggtaggaccgtaagagtaaccgtaccggaaaacccgacggaaacccgggaaaataaacttacgtaaaacctaaccgttaacgtaacggtaacgtacgggaaccgttcggtacggggaccgaaaccggtaaccccg

SEQ ID NO: 299428 - DNA, 579 bp, Homo sapiens
  misc_feature: GZ8MTXP02GK4GD.45.75.G09.1.454.CMB.2.raw
  modified_base (296)..(296): a, c, t, g, unknown or other
  misc_feature (296)..(296): n is a, c, g, or t
  modified_base (429)..(429): a, c, t, g, unknown or other
  misc_feature (429)..(429): n is a, c, g, or t
  modified_base (446)..(446): a, c, t, g, unknown or other
  misc_feature (446)..(446): n is a, c, g, or t
tcagacgcgatcgacacgaccggtgctcgatttagtatagacatcaggggggagaggagcccagcactgggattccgaggtgtttccattcagtgatctgcactgaacacagaggactcgccatggagtttgggctgagctgggttttccttgttgctattttaaaaggtgtccagtctgaggagcagctggtggagtcgtgggggaggcttgggtccaggcccgggggggtccctcagactctcgtgtgcagcctctggattcaccgtcagtggcagcttcctgagctgggtccnccaggctccgaggggaacggcctggagtgggtctcgtagttaatttttagacgtaggcacacgcgtactacgcagacttaccgttaggggccattccaccatctccaagagacaaacttccaaggaacagttntttctagaaatgaaacnccctagacgacccgaggacacggactactatattactgtagcgagagactaccgaaacccaggaacccgaaagaaacttacgaacaactacgtaacgtagtacggacgtcgtacggggaccgaacgggacccg

SEQ ID NO: 299429 - DNA, 722 bp, Homo sapiens
  misc_feature: GZ8MTXP02G20IN.45.75.G09.1.454.CMB.2.raw
  modified_base (297)..(297): a, c, t, g, unknown or other
  misc_feature (297)..(297): n is a, c, g, or t
tcagacgcgatcgacacgaccggtgctcgatttagtatagacatcaggggggagaggagcccagcactgggattccgaggtgtttccattcagtgatctgcactgaacacagaggactcgccatggagtttgggctgagctgggttttccttgttgctattttaaaaggtgtccagtctgaggagcagctggtggagtcgtgggggaggcttggtccgaggccggggggtccctcgagactctcgtgtgcagcctctggattcaccgtcagtggcagcttcctgagcgtcgggtccnccgaggcctccgaggggacggccgtggaggtgggtctcgtaggtttaacttttagacgaggcacgacgtcgtactacgctagtacttacggttagggcctattccgacctagtcctaccaaggtacgaactaaacgtttcccgaaaggtaaaccgtacgggtttagtttaccgttaaggaaaacgttcgaaaacccgtaccccgttaggaacccgtaaaccccggagggaacccaccgggtaccttactaacgttacttaccgtaggtcggaccgtaggaacgtacgttaacccggaaaccccgaaaggggaaacccccggtaaaaggtaaaacctttacccggtaaaactaaaccgttaaccgtaacggttaacgtacgggtaaccgtccggtacgggggacccgtaaacgggggtaacccccg

SEQ ID NO: 299430 - DNA, 649 bp, Homo sapiens
  misc_feature: GZ8MTXP02JE9R6.45.75.G09.1.454.CMB.2.raw
  modified_base (332)..(332): a, c, t, g, unknown or other
  misc_feature (332)..(332): n is a, c, g, or t
  modified_base (379)..(379): a, c, t, g, unknown or other
  misc_feature (379)..(379): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctccctgtctgggtctcccggacagtcgatcaccactcccctgcactggactccgaggcggtgtacgtttacttgttttaagtatgtctcgtggtatcagcaacaccaggcaaacgccccaactcatcatttatgatgtacaatatccggcctcgagggtttcntatcgtctctctcgcctactagtctcggactaactccggccctaccncgtaccctagtctcgtggcctccgaggctagaaacggtacgagtccgtagtaacgttacttactcggacacgactaactaattaattaagttaacgtttacgtttaccgtaaccggttcggggttaacgttccggggacgggtaaacgggtaccgtaacggttccgtaacccggttacgtaacggtaccacgggtacccgtaacggtcctaacccggtccccctacgggtaccctaccgttcccggtttacccgtcccccttaacccccg

SEQ ID NO: 299431 - DNA, 626 bp, Homo sapiens
  misc_feature: GZ8MTXP02IXN5Z.45.75.G09.1.454.CMB.2.raw
  modified_base (240)..(240): a, c, t, g, unknown or other
  misc_feature (240)..(240): n is a, c, g, or t
  modified_base (287)..(287): a, c, t, g, unknown or other
  misc_feature (287)..(287): n is a, c, g, or t
  modified_base (300)..(300): a, c, t, g, unknown or other
  misc_feature (300)..(300): n is a, c, g, or t
tcagacgcgatcgacacgaccggtgctcgatttagtatagacatcagggggctctgggagaggagcccagcactgggattccgaggtgtttccattcagtgatctgcactgaacacagaggactcgccatggagtttgggctgagctgggttttccttgttgctattttaaaaggtgtccagtctgaggagcagctggtggagtctgggggaggcttggtccaggcccggggggtccctnagactctcgtgtgcagcctctggattcaccgtcagtggcagcttccngacgctgggtccnccgaggctccgaggggacggccgtggagtgggtctcgagttattttagacaggcacagcgtactacgcagtacttaccggttaagggcccgtattccgaacctatcctaccagacgaacaagtttcccaaggaacctacgggttgtttacttagtaaactacgaaaccacccgttagacgacccgtagggaacccaccgggtacctactaagttacttacgtagtcgacgtagacgtactaccggaaacccgacggaacccggaaaagtaacttactaacctaaaccttacgtaaccggtagtacgggtacgtacggtaccggggg

SEQ ID NO: 299432 - DNA, 766 bp, Homo sapiens
  misc_feature: GZ8MTXP02G39EU.45.75.G09.1.454.CMB.2.raw
  modified_base (295)..(295): a, c, t, g, unknown or other
  misc_feature (295)..(295): n is a, c, g, or t
tcagacgcgatcgacacgaccggtgctcgatttagtatagacatcaggggagctctgggagaggagcccagcactgggattccgaggtgtttccattcagtgatctgcactgaacacagaggactcgccatggagtttgggctgagctgggttttccttgttgctattttaaaaggtgtccagtctgaggagcagctggtggagtcgtgggggagcgttggtccgaggcccggggggtccctcgagactcgtcgtgtgcagccctcgtggattcaccgtcagtggcagtcttccngacgcgtcgggtccgccgaggcctaccggaggggaacggccgtgggaggtggtctacgtagttaatttttagaccgtagcacgagtcgtactacgcagtacgttaccggtaagggcctagttccacctactctaccgagaacgaactaacttaccgaaggtaaccgtacgggtttacgtttacgttaacgtaaaacgttccgtaaaaccctacccgttacggaaacccggtaaccccgggtaaacgggaacccgaccgggtaccttaaccgtttaaacgttaacgtttaaaccgtgggtaacggtaaccggttaaacggaaacggtaaccgttaaacccccggaaaaccccggtaaccgggaaaacccccggtaaaacggttaaaaaccgttaacccgttaaaacccgtaaaacccgttaaaccggttaaccggttaaacggttaaccgggtacccggtttaaacccgggg

SEQ ID NO: 299433 - DNA, 693 bp, Homo sapiens
  misc_feature: GZ8MTXP02I3372.45.75.G09.1.454.CMB.2.raw
  modified_base (288)..(288): a, c, t, g, unknown or other
  misc_feature (288)..(288): n is a, c, g, or t
  modified_base (301)..(301): a, c, t, g, unknown or other
  misc_feature (301)..(301): n is a, c, g, or t
tcagacgcgatcgacacgaccggtgctcgatttagtatagacatcagggggctctgggagaggagcccagcactgggattccgaggtgtttccattcagtgatctgcactgaacacagaggactcgccatggagtttgggctgagctgggttttccttgttgctattttaaaggtgtccagtctgaggagcagctggtggagtcgtgggggaggcgttggtccgaggccgggggggtccctcgagactctcgtgtgcagcctctggattcaccgtcagtgcagcttcngagcgtgggtccnccgaggctaccgagggacgggcctggaggtgggtctcgtaagttaattttagacacggcacgagcgtactaccgcagtactttccgggtaaagggccgtaattccgaacctacttcctacccaaggaacgaacctaaacgttcccgaaacgggaaccgtaacgggtttcgtttaccgtttaacgaaaagttacggaaaaccctaccccggttagaaaccggaacccccggaagggaaacccaccgggtacttacgttaacgtaactttaaccgtggtacgacgtaaggaaggtacgtaacccggaaaacccgaacgggaaccccggtaaaataaacgtttaccaaacgtaaaccttaacgtaacggtagtacgggaacgttcggtacggggg

SEQ ID NO: 299434 - DNA, 618 bp, Homo sapiens
  misc_feature: GZ8MTXP02HH6MP.45.75.G09.1.454.CMB.2.raw
  modified_base (333)..(333): a, c, t, g, unknown or other
  misc_feature (333)..(333): n is a, c, g, or t
  modified_base (413)..(413): a, c, t, g, unknown or other
  misc_feature (413)..(413): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcacgtggatccaggcggtgtacgtttacttgtttttaagtattgtctcctggtatcagcaacaccaggcaaacgccccaaatcatctatttatgatgtcaaatagtcgccctgtagggtttcnctatcgtcttctcctcgctcagtctggcagtaccgcctcctgacctatcctcgtcggcctccgacgctaggaacgtacgnggtactagtacgtttatacgtgactacgcaacttataatttaacgttacgtttacgtttcctaccggttacgggtacgtttccgggggacggtaagggtaacccgtagggtttacgacccgttacggtacggtaccgtacggacccgaacggtccgtaccggtcccccgtcggttacctacccgttccgtttccctttacccccg

SEQ ID NO: 299435 - DNA, 542 bp, Homo sapiens
  misc_feature: GZ8MTXP02FOO5P.45.75.G09.1.454.CMB.2.raw
  modified_base (261)..(261): a, c, t, g, unknown or other
  misc_feature (261)..(261): n is a, c, g, or t
  modified_base (351)..(351): a, c, t, g, unknown or other
  misc_feature (351)..(351): n is a, c, g, or t
  modified_base (389)..(389): a, c, t, g, unknown or other
  misc_feature (389)..(389): n is a, c, g, or t
  modified_base (392)..(392): a, c, t, g, unknown or other
  misc_feature (392)..(392): n is a, c, g, or t
  modified_base (409)..(409): a, c, t, g, unknown or other
  misc_feature (409)..(409): n is a, c, g, or t
  modified_base (455)..(455): a, c, t, g, unknown or other
  misc_feature (455)..(455): n is a, c, g, or t
tcagacgcgatcgacacgaccggtgctcgatttagtatagacatcaggggagctctgggagaggagcccagcactgggattccgaggtgtttccattcagtgatctgcactgaacacagaggactcgccatggagtttgggctgagctgggttttccttgttgctatttaaaggtgtccagtctgaggagcagctggtggagtcgtgggggaggcttggtccaggccgggggggtccctcagactctcgtgtgcagcctcnggattcaccgtcagtggcagcttcctgagctgggtccgcaggctccgagggaaggcctggagtgggtctcagtaatttttagacaggcanagcgtactacgcagattccgttaagggctatcacatcncanacgacatccagacagtnttactagaaatgacacctgacgaccgagacaggctcgtatattacngtgcgtagacgactaccgaaaccgacggaacccgaagtaaaacttaacgaactaaactaacgtaccgtaagtcggacgtttacgggg

SEQ ID NO: 299436 - DNA, 581 bp, Homo sapiens
  misc_feature: GZ8MTXP02IEU1F.45.75.G09.1.454.CMB.2.raw
  modified_base (295)..(295): a, c, t, g, unknown or other
  misc_feature (295)..(295): n is a, c, g, or t
  modified_base (420)..(420): a, c, t, g, unknown or other
  misc_feature (420)..(420): n is a, c, g, or t
  modified_base (428)..(428): a, c, t, g, unknown or other
  misc_feature (428)..(428): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacaggatcgtgggccctttctgccctgactcagcctgcctccgtgtctgggtctcctggacagtcgatcaccatggcctgcactggaaccaacagtgatgttgggtatttttagttgtctcctggtaccaacaacacccggcgaacgccccaaactaatcattanaggacactaagcggccgtcggggttcaagtcgtcttctctcggtctccaagtctggcaaccgacggccctcctgactaatctcgtcgggactccgaggtcctcgaggacgagctgtattatttcngttgcttntatatgacgaggacagctacggttgggtcggttcggacgggaggaccgtgggttcgtaccgtcgtaaggtcgacggtaccgacggtccttccgccccgtcgtcctccttccgtccgttccccgtcccttcccgtcgtaccgtactccggtccg

SEQ ID NO: 299437 - DNA, 596 bp, Homo sapiens
  misc_feature: GZ8MTXP02JDJZ1.45.75.G09.1.454.CMB.2.raw
  modified_base (246)..(246): a, c, t, g, unknown or other
  misc_feature (246)..(246): n is a, c, g, or t
  modified_base (300)..(300): a, c, t, g, unknown or other
  misc_feature (300)..(300): n is a, c, g, or t
  modified_base (334)..(334): a, c, t, g, unknown or other
  misc_feature (334)..(334): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttacttgtttttaagnttgtctctggtatcagcaacacccaggacaaacgcccccaaactcatcatttangatgtacaataactcggccctcgtaggggtttcnctatcgcttctcctggcctacaagttctacggactacgtaccgggcccttcccgtacgacctactccgtcgtcggggcctcccgaggctaggaaacgtacgacggtctagtattactactggcagctacgattatattgttctttaccgacgttacgggttagttcgggacgggacggtaaccgtaggttacgtaaccgtcgtaacggtcaacggcccgaaggccgtccggtcccgtcggcctacgttcctcgtttaccccc

SEQ ID NO: 299438 - DNA, 655 bp, Homo sapiens
  misc_feature: GZ8MTXP02H3WLO.45.75.G09.1.454.CMB.2.raw
tcagacgcgatcgacacgaccggtgctcgatttagtatagacatcaggggagctctgggagaggagcccagcactgggattccgaggtgtttccattcagtgatctgcactgaacacagaggactcgccatggagtttgggctgagctgggttttccttgttgctattttaaaaggtgtccagtctgaggagcagctggtggagtcgtgggggaggcttgggtccgaggccggggggggtccctcgaggactcgtcggtgtgcacgctctggattcaccgtcaggtggcagtccttcctgagcgtcgggtccgcgacggcctccggaggggaacgggccgtagggacggtgggtcctcgtaagtttaaagtttttagaccgaggaccacgacgtcgtactacgctagtactttaccggttaaggccgtattccactatcctaccagtacgacaaacttaccgaaggtaacgtacggttgtttacgttaggaaacttcgaaaccctacccgttagaaccggaacccggaggaacccgacggacttactagttaacttacgtgtacgcgagagtactaccgaaacccacgaaacccggaataaaccttaactaaccgaaaacttacggtaacggtacgtacgggaaccgttccgggg

SEQ ID NO: 299439 - DNA, 546 bp, Homo sapiens
  misc_feature: GZ8MTXP02JCLGE.45.75.G09.1.454.CMB.2.raw
  modified_base (297)..(297): a, c, t, g, unknown or other
  misc_feature (297)..(297): n is a, c, g, or t
  modified_base (511)..(511): a, c, t, g, unknown or other
  misc_feature (511)..(511): n is a, c, g, or t
tcagacgcgatcgacacgaccggtgctcgatttagtatagacatcagggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgtttttaagtatgtctcctggtatcagcaacacccaggcaaacgccccaaactcatcatttangatgtacaataatcggccctcgtacggggtttctcatcgcttctcctgcctcaagtctggcataccggccttccctgaccatctctcgggctccaggctgaaagcgaggctagtattatactgcagcaacatactaattagtcgttaccacgttcgggtattcgggcggtagggaaccaaggttcgaccgtcgtaggtccacgcccgaaggtcncgtccccctcggtcctacgtcgtccgtttcccccg

SEQ ID NO: 299440 - DNA, 639 bp, Homo sapiens
  misc_feature: GZ8MTXP02GWX98.45.75.G09.1.454.CMB.2.raw
  modified_base (292)..(292): a, c, t, g, unknown or other
  misc_feature (292)..(292): n is a, c, g, or t
  modified_base (306)..(306): a, c, t, g, unknown or other
  misc_feature (306)..(306): n is a, c, g, or t
  modified_base (458)..(458): a, c, t, g, unknown or other
  misc_feature (458)..(458): n is a, c, g, or t
  modified_base (529)..(529): a, c, t, g, unknown or other
  misc_feature (529)..(529): n is a, c, g, or t
tcagacgcgatcgacacgaccggtgctcgatttagtatagacatcagggggggagaggagcccagcactgggattccgaggtgtttccattcagtgatctgcactgaacacagaggactcgccatggagtttgggctgagctgggttttccttgttgctattttaaaaggtgtccagtctgaggagcagctgggtggagtcgtgggggaggcttgggtccgagggcccggggggtccctcgagactcgtcgtgtgcagcctcgtggacttcaccgtcagtggcagtcttccngagcgtcgggtccnccgaggcctaccggaggggacggccgtgggaggttcgggtctcgtagtttaattttagacgaggcacgacgcgtactacgacagtacgttaccggtagggcctattccacctatctacagacgactaactcccgaaggtaaccgtacggttntttacgtagaaactacgaacctaccctaggaccgacccggaggaccgacgggtctacgtattacgttacgnggtacgacggagtacgactaaccggaacccgaacgaacccgaaagtaacctactaaacgaacttacgtaagtacgtacggtacgtcggtacggggacctaaacgggaccc

SEQ ID NO: 299441 - DNA, 653 bp, Homo sapiens
  misc_feature: GZ8MTXP02F8NUH.45.75.G09.1.454.CMB.2.raw
  modified_base (295)..(295): a, c, t, g, unknown or other
  misc_feature (295)..(295): n is a, c, g, or t
  modified_base (297)..(297): a, c, t, g, unknown or other
  misc_feature (297)..(297): n is a, c, g, or t
tcagacgcgatcgacacgaccggtgctcgatttagtatagacatcaggggagctctgggagaggagcccagcactgggattccgaggtgtttccattcagtgatctgcactgaacacagaggactcgccatggagtttgggctgagcgtgggttttcctgttgctattttaaaaggtgtccagtctgaggagcagctggtggagtcgtgggggaggcttgggtccgaggcccgggggggtccctcgagactctcgtgtgcagcctctggattcaccgtcagtggcagccttccgngngcgtcggccgcgaggcctccggagggacggcgtgggaggtggtctagtaagttagttttagaccgagacacgacgtccgtacgtacgcgtagtacgttaccggtaacggtccgtacttaccacctactcctaccgagaacgaactaacgtaccgaacgtaacgtacggttagtttacgttaagaaacgtacgaaacctacccgtacgaaccgaacccggacggtaccgaccggtactactaacttacgttacgtgtacgacggaagacgtaaccgtaccgaaaccgaacggaaacccgaaagtaaacttaaccgtaaactaaaccgttacgtaacggtacgtacggtaacgtacgg

SEQ ID NO: 299442 - DNA, 591 bp, Homo sapiens
  misc_feature: GZ8MTXP02JZWCM.45.75.G09.1.454.CMB.2.raw
  modified_base (244)..(244): a, c, t, g, unknown or other
  misc_feature (244)..(244): n is a, c, g, or t
  modified_base (326)..(326): a, c, t, g, unknown or other
  misc_feature (326)..(326): n is a, c, g, or t
tcagacgcgatcgacacgaccggtgctcgatttagtatagacatcagggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgttttaagtntgtctctggtatcagcaacaccaggcaacgcccccaactcatcatttatgatgtacaataatccggcctcgtaggggtttcnctatcgtcttctcctgctcaagtctaggctagtaccggtcctccctagaccactctcgtgggcctccgacggtctagaacgacgaaggcgtagtatttattacgtagcagcaacatattattagttcgtttacctacggttcgggtacgttcggggacgggtaaggtaccgtaaggtacggtacccgttacgtacggtcaccggtacccgaacggtccgtacccgtaccccgttccggtacctccgttcgttcccggttcccccg

SEQ ID NO: 299443 - DNA, 502 bp, Homo sapiens
  misc_feature: GZ8MTXP02FF5EL.45.75.G09.1.454.CMB.2.raw
  modified_base (226)..(226): a, c, t, g, unknown or other
  misc_feature (226)..(226): n is a, c, g, or t
  modified_base (347)..(347): a, c, t, g, unknown or other
  misc_feature (347)..(347): n is a, c, g, or t
  modified_base (359)..(359): a, c, t, g, unknown or other
  misc_feature (359)..(359): n is a, c, g, or t
  modified_base (395)..(395): a, c, t, g, unknown or other
  misc_feature (395)..(395): n is a, c, g, or t
  modified_base (403)..(403): a, c, t, g, unknown or other
  misc_feature (403)..(403): n is a, c, g, or t
  modified_base (412)..(412): a, c, t, g, unknown or other
  misc_feature (412)..(412): n is a, c, g, or t
  modified_base (491)..(491): a, c, t, g, unknown or other
  misc_feature (491)..(491): n is a, c, g, or t
  modified_base (495)..(502): a, c, t, g, unknown or other
  misc_feature (495)..(502): n is a, c, g, or t
tcagacgcgatcgacacgaccggtgctcgatttagtatagacatcagggggatggtgatcgactgtcctgggcccagtctgccctgactcagcctgcctccctgtctgggtctcctggacagtcgatcaccatcccctgcactggatccagcggtgacgtttactgtttttaagatgtctcctggtatcagcaacacccaggcaaagcccccaaatcatcatttangatgtacaataatcggccctgaggggtttctcatcgcttctctggctccaagtctggcaatacggcctcctgaccatctctggggctccgaggctgaagacgaggctgattatatgcagcncatatattagtntttacacgtcgggtattcggcggagggacagtgacncctagtcngaccaagcncgcccctggtccactctgttccccacctcctctcgatccgtcgtcctggacggcggtcgtcgggacacgggacgcctanaagnnnnnnnn

SEQ ID NO: 299444 - DNA, 694 bp, Homo sapiens
  misc_feature: GZ8MTXP02F1OF6.45.75.G09.1.454.CMB.2.raw
tcagacgcgatcgacacgaccggtgctcgatttagtatagacatcagggggctctgggagaggagcccagcactgggattccgaggtgtttccattcagtgatctgcactgaacacagaggactcgccatggagtttgggctgagctgggttttccttgttgctatttaaaggtgtccagtctgaggagcagctggtggagtcgtgggggaggcgttggtccgaggcccgggggggtccctcgagactctcgtgtgcagcctctggattcaccgtcagtggcagccttccgtgagcgtgggtcccgccaggcctccgagggaaggccgtggagtggtctcgtaagttaattttagtacaggtcacgagcgtactacgacagtacttaccggtaagggcccgtattacacctatccctaccgaagtacgaacctaaagttcccgaaaggtaaccgtacgggtttcgtttacgttaagtaaacgtacgaaaccctaacccgttacggaaccggaacccccggaagggaaccctacccgggtacttaccgtaattaacttaaccgtggttacggaccgtaaaggacgacgttacccggaaaacccgtaacgggtaaccccgaaaagtaaccttaactaaaccgtaaaccttaacggttaaccggtaagtacgggtaaccgttcgggtaacccggggg

SEQ ID NO: 299445 - DNA, 601 bp, Homo sapiens
  misc_feature: GZ8MTXP02HAUKV.45.75.G09.1.454.CMB.2.raw
  modified_base (376)..(376): a, c, t, g, unknown or other
  misc_feature (376)..(376): n is a, c, g, or t
tcagacgcgatcgacacgaccggtgctcgatttagtatagacatcaggggagctctgggagaggagcccagcactgggattccgaggtgtttccattcagtgatctgcactgaacacagaggactcgccatggagtttgggctgagcgtggtttctgtgctatttaaaggtgtccagtctgaggagcagctggtggagtcgtgggggaggcttgggtccgaggcccgggggggtcccctcgaggactcgtcgtgtgcagcctcgtggattcaccgtcagtggcagccttcctgagcgtcgggtccgccgaggcctccggaggggaacgggccgtgggagtcggggtctgtaagttaatttttagaccaggtcacgngcgtacacgcagtacttaccggtaagggccattccacctatctccgagtagacaagttcaaggacgtacggttagttacttagaaactcgaaacctacccgagaccgacccgacggaccgtacggactacgtatattactgcgacgagacgacgtaccgaacccacggaacccgaagtaaacctaacgtaacaaacgttacgaacggttacacggtacgtaccgg

SEQ ID NO: 299446 - DNA, 796 bp, Homo sapiens
  misc_feature: GZ8MTXP02JNZGF.45.75.G09.1.454.CMB.2.raw
  modified_base (232)..(232): a, c, t, g, unknown or other
  misc_feature (232)..(232): n is a, c, g, or t
  modified_base (269)..(269): a, c, t, g, unknown or other
  misc_feature (269)..(269): n is a, c, g, or t
  modified_base (281)..(281): a, c, t, g, unknown or other
  misc_feature (281)..(281): n is a, c, g, or t
tcagacgcgatcgacacgaccggtgctcgatttagtatagacatcagggggctctgggagaggagcccagcactgggattccgaggtgtttccattcagtgatctgcactgaacacagaggactcgccatggagtttgggctgagcgtggtttcctgtgctatttaaagtgtccagtctgaggagcagctggtggagtcgtggggagcttggtccaggccggggggtccctnagactctcgtgtgcagcctctggattccacgtctagnggcagcttccgngcgcgtcggccgcgacggcgtacggagggacggtcgtaggtggttcggtcttacgttaagttttaagtttacggacgtaccgacgtaacgtacgtaccgtacgacgtacgtacggttaccgtttaaccgggtaaccgggtaccttacgttacccgtaccctacgttcccgtaacgtaaacggtaaccgaaacttaaccgttacccgaaacggttaaccgttacggtttacgtttaaccgtaaagtaaaccgttaaccgaaaccccgttaacccggtaacgggtaaccccggaacccgggtacgggtaaacccgtaacggttaccttaacgttaacgttacgtttacgtacggtacggaacggtaacggtaaaccgtaaccggtaaaccccggaaaaccggtaaacccgggtaaaacccggtaaaacttaaaccgttaaccgtaaaaacccgttaaccgttaaacgggttaaccggttaacggtaccgggttaaaccgggttacgggaacccgggg

SEQ ID NO: 299447 - DNA, 555 bp, Homo sapiens
  misc_feature: GZ8MTXP02HEM27.45.75.G09.1.454.CMB.2.raw
  modified_base (225)..(225): a, c, t, g, unknown or other
  misc_feature (225)..(225): n is a, c, g, or t
  modified_base (245)..(245): a, c, t, g, unknown or other
  misc_feature (245)..(245): n is a, c, g, or t
  modified_base (257)..(257): a, c, t, g, unknown or other
  misc_feature (257)..(257): n is a, c, g, or t
  modified_base (260)..(260): a, c, t, g, unknown or other
  misc_feature (260)..(260): n is a, c, g, or t
  modified_base (283)..(283): a, c, t, g, unknown or other
  misc_feature (283)..(283): n is a, c, g, or t
  modified_base (293)..(293): a, c, t, g, unknown or other
  misc_feature (293)..(293): n is a, c, g, or t
  modified_base (326)..(326): a, c, t, g, unknown or other
  misc_feature (326)..(326): n is a, c, g, or t
  modified_base (382)..(382): a, c, t, g, unknown or other
  misc_feature (382)..(382): n is a, c, g, or t
  modified_base (439)..(439): a, c, t, g, unknown or other
  misc_feature (439)..(439): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctcctgtctgggtctcctggacagtcgatcaccatcccctgcatggatccagcggtntacgttattgttttaaagtntgtctcgtgtancanacaacaccagacaaacacccaancatatattanatatataactaatactccgacctgtaggtttcnctactcgtcttctccgtcgtcctacgtagtctagactacgtaccgtcctaccgtanaactactctcgcgctacgagcgtaggagacgagactagtattatactgtctgtctanagtatagtagtagtagttagttgttggtcggtacgggacggtacggacgagtcgtacgtaccgtacgtacgtacgacgaaccgtacgccgtcccgtcccgtacgtaccgtactccg

SEQ ID NO: 299448 - DNA, 578 bp, Homo sapiens
  misc_feature: GZ8MTXP02G8M75.45.75.G09.1.454.CMB.2.raw
  modified_base (228)..(228): a, c, t, g, unknown or other
  misc_feature (228)..(228): n is a, c, g, or t
  modified_base (244)..(244): a, c, t, g, unknown or other
  misc_feature (244)..(244): n is a, c, g, or t
  modified_base (424)..(424): a, c, t, g, unknown or other
  misc_feature (424)..(424): n is a, c, g, or t
  modified_base (464)..(464): a, c, t, g, unknown or other
  misc_feature (464)..(464): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggactccagcggtnacgttactgttttaanatgtctctggtatcagcaacaccaggcaaacgcccccaaactcatctatttatgatgtacaaatactcggcctcgtaggggtttctcatccgcttctccgtgctcaagtctgcagtacgccctccgtgacctatctcgtggctccgagtcgtagaacgacgaggtctagtattacttagngactagcatatattattagtcgtttactacgtacgggttnttcgggacgggtacgggtaaccgtaggttacgaccggttccgtaacggtccgaacggtcccgaaacggtccgtccggcccccgtcggtaccgtacctcccgtccgtttcccccg

SEQ ID NO: 299449 - DNA, 829 bp, Homo sapiens
  misc_feature: GZ8MTXP02GC34D.45.75.G09.1.454.CMB.2.raw
tcagacgcgatcgacacgaccggtgctcgatttagtatagacatcaggggagctctgggagaggagcccagcactgggattccgaggtgtttccattcagtgatctgcactgaacacagaggactcgccatggagtttgggctgagcgtggtttcctgtgctatttaaaggtgtccagtctgaggagcagctggtggagtcgtgggggagcgttggtccgagggcccggggggtccctcgagactcgtcgtgtgcacgcctcgtggattcaccgtcaggtgcagtcttccgtgacgcgtcgggtccgccgacggcctaccggaggggaacgggtccgtagggacggttgggtctacgtaaggtttaaagtttttacggaaccgtagggtaccaacgtacgggtaccgttaaccgttaacggaccgtaaggttaaaccggtttacccggggttaaaacgggggccccgttaaagtttaccccaaacccgtagttaccccgttaacccgaaaggtaaaccgtaaacccgtaaaaccgtttaaccccgaaacggggttaaaaccttaaccgggggttttacgttttaacccgttaaagggtaaaaacctttacccggaaaaccccgttcccccggttaaacggaaaccccgggaaccccgggtaaacggaaacccgtaacccgggttacttacgtaaactttaacgtttcggtacggttacgacggtaaagaacggtaccgaacccggaaaccctaaccgggaaacccggtaaataacttaacctaaaccgtaacttaaacccggtaggtacgtaacggtaccggtacgggg

SEQ ID NO: 299450 - DNA, 650 bp, Homo sapiens
  misc_feature: GZ8MTXP02GX3HM.45.75.G09.1.454.CMB.2.raw
  modified_base (265)..(265): a, c, t, g, unknown or other
  misc_feature (265)..(265): n is a, c, g, or t
  modified_base (384)..(384): a, c, t, g, unknown or other
  misc_feature (384)..(384): n is a, c, g, or t
tcagacgcgatcgacacgaccggtgctcgatttagtatagacatcaggggagctctgggagaggagcccagcactgggattccgaggtgtttccattcagtgatctgcactgaacacagaggactcgccatggagtttgggctgagctgggttttccttgttgctattttaaaaggtgtccagtctgaggagcagctggtggagtcgtgggggaggcttgggtccgaggcccggggggtccctcgagactctcgtgtgcagcctntggattcaccgtcagtggcagcttccgtgagcgtggtccgcgaggctccgaggggacgggcctgggagtgggtctacgtagttaagtttttagaccgaggcacgacgtcgtaacgtacncgaagtacgttaccggtaacgggccgtattccacctagtcctaccgagacgactaacgttaccgaaggaacctacgggttatttacgtagtaaaacgtcgaaaaccctacccgttagaaccggtaacccggaaggaacccgtacggtacttaacgtaattaacgttacgtggtacgacggtaacgagtaacgtacccgaaaaccgtacgaacccggaataaaccgtctaaacgtaaactaccgtagtacgtacggtacgtaccggg

SEQ ID NO: 299451 - DNA, 611 bp, Homo sapiens
  misc_feature: GZ8MTXP02IQDSH.45.75.G09.1.454.CMB.2.raw
  modified_base (275)..(275): a, c, t, g, unknown or other
  misc_feature (275)..(275): n is a, c, g, or t
  modified_base (289)..(289): a, c, t, g, unknown or other
  misc_feature (289)..(289): n is a, c, g, or t
  modified_base (306)..(306): a, c, t, g, unknown or other
  misc_feature (306)..(306): n is a, c, g, or t
  modified_base (402)..(402): a, c, t, g, unknown or other
  misc_feature (402)..(402): n is a, c, g, or t
tcagacgcgatcgacacgaccggtgctcgatttagtatagacatcagggggctctgggagaggagcccagcactgggattccgaggtgtttccattcagtgatctgcactgaacacagaggactcgccatggagtttgggctgagctgggttttccttgttgctattttaaaaggtgtccagtctgaggagcagctggtggagtcgtgggggaggcttggtccgaggccgggggggtccctcagactctcgtgtgcagcctctggattcaccgtnagtggcagcttccngacgtcgtcggggtccnccgaggcctaccggagggaacgggcctgggagtgggtctcgagttattttagacaggcacagcgtactacgcagtcttcggtaagggccatccacnctctcagacgactaacttcgaagtactacggttacgtttctagaaatacggaaacccaccgtagacgaacccgtggaaccacgggtctacttaatacttacgtgtacgacgaagagtaactaccggaaacccgaacggaacccggaaaacgtaaacttaccaacgtaaaccgttactaaaccggtagtacggtacgtcggtaaccgggg

SEQ ID NO: 299452 - DNA, 541 bp, Homo sapiens
  misc_feature: GZ8MTXP02FG976.45.75.G09.1.454.CMB.2.raw
tcagacgcgatcgacacgaccggtgctcgatttagtatagacatcaggggagctctgggagaggagcccagcactgggattccgaggtgtttccattcagtgatctgcactgaacacagaggactcgccatggagtttgggctgagctgggttttccttgttgctattttaaaaggtgtccagtctgaggagcagctggtggagtctgggggaggcttggtccagccggggggggtccctcagactctcgtgtgcagcctctggattcaccgtcagtggcagcttcctgagctgggtccgccaggctccaggggaagggcctgggagtggggtctcagtaattttttagaccaggcacagcgtactacgcagattccgttaagggccattcaccatctccagagacaattccaggaacacggtgttcttgaaatgaacaccctgagacccgaggacacggctactatattactgtgcgagagactcgaaacccagacccggaagaaaacttctaacaactactacggtatacggacgtcgg

SEQ ID NO: 299453 - DNA, 643 bp, Homo sapiens
  misc_feature: GZ8MTXP02F1P2O.45.75.G09.1.454.CMB.2.raw
  modified_base (246)..(246): a, c, t, g, unknown or other
  misc_feature (246)..(246): n is a, c, g, or t
  modified_base (307)..(307): a, c, t, g, unknown or other
  misc_feature (307)..(307): n is a, c, g, or t
  modified_base (474)..(474): a, c, t, g, unknown or other
  misc_feature (474)..(474): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctccctgtctgggtcctcctggacagtcgatcaccatcccctgcactggatccagcggtgacgttacttgtttttaanatgtctctggtatcagcaacacccgaggaccaaaccgacccccaaactcaatctaatttanagactagtacaaattaacgtccggcccctaggtacggggtttcctcactcgtcttctccgtcggcctaccgaagttctaggactacgtacccggccctcccgtacgaccctattcctcgtcgggtcctaccggagtcaaggaacgacggagtctagtacttattacngacagacactaattattagttacgttgttaccacggtttacggacgttccgggagggtaacggtaccgtaaggttccggaaacccggttcgtaaacggtcgacccgaccggtacgcccgttacccgtacccccgtacggttaaccttcccgtacccgttcccgtccccg

SEQ ID NO: 299454 - DNA, 803 bp, Homo sapiens
  misc_feature: GZ8MTXP02I8UT2.45.75.G09.1.454.CMB.2.raw
  modified_base (247)..(247): a, c, t, g, unknown or other
  misc_feature (247)..(247): n is a, c, g, or t
  modified_base (301)..(301): a, c, t, g, unknown or other
  misc_feature (301)..(301): n is a, c, g, or t
tcagacgcgatcgacacgaccggtgctcgatttagtatagacatcagggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggactccaggcggtgtacgttacttgttttaagntgtctctgtatcagacaacaccaggacaaacgaccccaaactcatactatttangatgtactaaataacgtccggtccctacggtacggggtttcctactacgttccgtctttccgttcccgtcggtcctacccgtaaacgttcgtacgggtaacctacggttacccggtccccttaccccgttacgaaccctaacgttcccgttccggtccggggtacccttacccggacgggtaccgtaacggaaacggaaccgggtacgggtacttaagttaaactttacgttaaccgttacggaccaaacggtaccctaaacttaatttaactttaaagtttacgtttacgttttaacccgtacgggtttacggggtttacggtttaccgggggacggggtaaaccggggttaacccgttaaagggtttaccgggtaccccggtttaaccggttaacgggttaccgaaacccggtaccccggtaaacggtcccgttaccccggtccccccggtttacgggtacccttacccggtttcccgtttccccggtttaacccccccg

SEQ ID NO: 299455 - DNA, 537 bp, Homo sapiens
  misc_feature: GZ8MTXP02HO0GY.45.75.G09.1.454.CMB.2.raw
  modified_base (224)..(224): a, c, t, g, unknown or other
  misc_feature (224)..(224): n is a, c, g, or t
  modified_base (254)..(254): a, c, t, g, unknown or other
  misc_feature (254)..(254): n is a, c, g, or t
  modified_base (265)..(265): a, c, t, g, unknown or other
  misc_feature (265)..(265): n is a, c, g, or t
  modified_base (356)..(356): a, c, t, g, unknown or other
  misc_feature (356)..(356): n is a, c, g, or t
  modified_base (488)..(488): a, c, t, g, unknown or other
  misc_feature (488)..(488): n is a, c, g, or t
  modified_base (494)..(494): a, c, t, g, unknown or other
  misc_feature (494)..(494): n is a, c, g, or t
  modified_base (526)..(526): a, c, t, g, unknown or other
  misc_feature (526)..(526): n is a, c, g, or t
  modified_base (528)..(528): a, c, t, g, unknown or other
  misc_feature (528)..(528): n is a, c, g, or t
  modified_base (530)..(537): a, c, t, g, unknown or other
  misc_feature (530)..(537): n is a, c, g, or t
tcagacgcgatcgacacgaccggtgctcgatttagtatagacatcaggggatggtgatcgactgtcctgggcccagtctgccctgactcagcctgcctccctgtctgggtctcctggacagtcgatcaccatcccctgcactggatccagcggtgacgttactgtttttaagatgtctcctggtatcagcaacaccaggcaaacgccccaaatcatctatttangatgtacaatatcggccctgtagggtttcncatcgcttctntggctaccaagtctggactaacgtaccggccctcctgaccattctcgtcgggctccgaggctaggaaagacgaggtctagtatttattacngacacgcactattaattagtttagttcgtttaccgaagtttcgggtagttccgggacggaaggactaggttcgaccgttcgtagtcacgaccgaaggtcctccgcccctggtcactcgtctccccacctccncgtacnctcgcgtcgtgcgtcggctggaccgaggccanangnnnnnnnn

SEQ ID NO: 299456 - DNA, 509 bp, Homo sapiens
  misc_feature: GZ8MTXP02FID9S.45.75.G09.1.454.CMB.2.raw
tcagacgcgatcgacacgaccggtgctcgatttagtatagacatcagggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgtttttaagatgtctctggtatcagcaacacccaggcaaagcccccaaactcatcatttatgatgtcaataatcggccctcaggggtttctcatcgcttctcctggctcaagtctggcatacggcctccctgaccatctctgggctcccaggctgaaagacgaggctgattatactgcagcacatatattagtgtttctactcggtattcgcggagggacaagttgacgtcctacgtcacgccaacggctgcccctccggtcactctcttccccc

SEQ ID NO: 299457 - DNA, 722 bp, Homo sapiens
  misc_feature: GZ8MTXP02GHW71.45.75.G09.1.454.CMB.2.raw
  modified_base (266)..(266): a, c, t, g, unknown or other
  misc_feature (266)..(266): n is a, c, g, or t
  modified_base (279)..(279): a, c, t, g, unknown or other
  misc_feature (279)..(279): n is a, c, g, or t
  modified_base (292)..(292): a, c, t, g, unknown or other
  misc_feature (292)..(292): n is a, c, g, or t
  modified_base (294)..(294): a, c, t, g, unknown or other
  misc_feature (294)..(294): n is a, c, g, or t
  modified_base (303)..(303): a, c, t, g, unknown or other
  misc_feature (303)..(303): n is a, c, g, or t
  modified_base (309)..(309): a, c, t, g, unknown or other
  misc_feature (309)..(309): n is a, c, g, or t
tcagacgcgatcgacacgaccggtgctcgatttagtatagacatcagggggctctgggagaggagcccagcactgggattccgaggtgtttccattcagtgatctgcactgaacacagaggactcgccatggagtttgggctgagctgggttttccttgttgcttattttaaaaggtgtccagtctgaggagcagctggtggagtcgtgggggaggcttggtccgagggccgggggggtccctcgagactctcgtgtgcagcctcnggtattcaccgtnagtgcagcttccngngctgggccncaggcnccgagggaggcctggagtggtctcgtaagttaagttttagacacggcacgagtcgtactacgacagtacgttacggttaaacgggccgtattaccgacctattcccgtaccaaaggagaaacctaacttacccgaaacggtaaacctacgggtttacgtttaccgttaagaaaacgtttacgaaaacccgtaaccccgttaggaaaccggaacccccggaacgggaaccaacccgggtaccttacttaaacgttaaactttaacgtggtcggaaccgtaaggacgtaaacgtaacccgaaaaccccggaacgggtaaaacccccggtaaaagtaaaaccgtttaccaaaaccgtaaaaccgtttaaccgtaaacggggttaacttacgggaaacggttccgggtaaacggggg

SEQ ID NO: 299458 - DNA, 786 bp, Homo sapiens
  misc_feature: GZ8MTXP02FYWYS.45.75.G09.1.454.CMB.2.raw
  modified_base (278)..(278): a, c, t, g, unknown or other
  misc_feature (278)..(278): n is a, c, g, or t
  modified_base (290)..(290): a, c, t, g, unknown or other
  misc_feature (290)..(290): n is a, c, g, or t
tcagacgcgatcgacacgaccggtgctcgatttagtatagacatcaggggggagaggagcccagcactgggattccgaggtgtttccattcagtgatctgcactgaacacagaggactcgccatggagtttgggctgagctgggttttcctgttgctatttaaaggtgtccagtctgaggagcagctggtggagtcgtgggggaggcttggtccaggcccgggggggtccctcgagactctcgtgtgcagcctctggatcaccgtcagtgcagctcgngagcgtggtccnccgaggctccgagggacggccgtggaggtgggtctacgtagttaagtttttacgacgaggctacgacgtcgtactacgactagtaacgtttacccgggttaagggggccctaatttaccaaccctattccctacccgaagggtaaacaacctaaacgttacccgaaagggtaaaccctacggggtttacgtttacctttaaggaaaacttacgaaaacccgtaccccgttagggaaacccgaacccccgggaaagggacccaaccggggttaccttaccgttaaaggttacttttaacgtcggggttacgaccgggaaagtaacggtaaccgttaacccggaaaacccccgtaacgggaaaaccccgggtaaaaacggttaaaactttacccgtaaaaccaaaaccgtttaacccggtaaacggggttaacgttaaccgggggtacccggtaccgggttaacggggaacccccgggtaaaacgggtaaccccccgg

SEQ ID NO: 299459 - DNA, 715 bp, Homo sapiens
  misc_feature: GZ8MTXP02HRE75.45.75.G09.1.454.CMB.2.raw
  modified_base (250)..(250): a, c, t, g, unknown or other
  misc_feature (250)..(250): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctccctgtcgtgggtctcctggacagtcgatcaccatcccctgcactggactccaggcggtgtacgttacttgtttttaagnttgtctctggtatcagcaacaccagcaaacgccccaaactcatctatttatgtatgtacaaatatccggcctgtaggggtttctcatcgtcttctctggtcctacgaacgtctcggacacgtaccggccctcccgtacgaacctctcgtccgtcggtcctcccggagccgtagaaggtacggaggtactagtaagtttacttacacgttcgagtacctaatatttaattaagtttacgtttacgtttacccggtacggtttacggggttaacgtttccgggggaacgggggtaaccgggtaacccgttaaggggtttaccggttaaacccggttcccggtttaaacggtccccggtaaaccggacccccgggtaaaaccgggttccccgtacccgggttacccccccggtttacggggttaccccttacccggtttccccgtttacccggttttcccccccccgg

SEQ ID NO: 299460 - DNA, 638 bp, Homo sapiens
  misc_feature: GZ8MTXP02IVLP8.45.75.G09.1.454.CMB.2.raw
  modified_base (246)..(246): a, c, t, g, unknown or other
  misc_feature (246)..(246): n is a, c, g, or t
  modified_base (256)..(256): a, c, t, g, unknown or other
  misc_feature (256)..(256): n is a, c, g, or t
  modified_base (260)..(260): a, c, t, g, unknown or other
  misc_feature (260)..(260): n is a, c, g, or t
  modified_base (285)..(285): a, c, t, g, unknown or other
  misc_feature (285)..(285): n is a, c, g, or t
tcagacgcgatcgacacgaccggtgctcgatttagtatagacatcaggggggggtctcaggaggcagcgctctcgggacgtctccaccatggcctgggctctgcaattcctcaccctcctcactcagggcacagggtcctgggcccagtctgccctgactcagcctgcctccctgtctgggtctcctggacagtcgatccaccatcccctgcactggatccagcggtgtacgttattgttttaagntgtctctgtntcancaacaccaggcaaacgccccaaacncatctatttatgatgtacaaatatccgcctacgtacgggtttctcactcgtcttctccgtcgtctaccgaagtcgtcggtacacgtaccgtccctacccgtacaccctatcctcgtcgggcctcgagtcgtaggaagacgagtcgtagtattacgtactggactacactataattaattagtttacgttaccgtttaccgttacggttacgggttacgtaccggggtacgggtaacgggtaaaccgtacggtttacggtacccggtacggtacggttaccgaaccgtacccgttaacggcccgttacccggtccccgttaccggtcctaccgtttccgtcccggtttcccccg

SEQ ID NO: 299461 - DNA, 573 bp, Homo sapiens
  misc_feature: GZ8MTXP02GM45A.45.75.G09.1.454.CMB.2.raw
tcagacgcgatcgacacgaccggtgctcgatttagtatagacatcagggggggtctcaggaggcagcgctctcgggacgtctccaccatggcctgggctctgctattcctcaccctcctcactcagggcacagggtcctgggcccagtctgccctgactcagcctgcctcctgtctgggtctctggacagtcgatcacatcccctgcactggatccagcggtgacgttacttgtttttaagatgtctctggtatcagcaacaccaggcaaacgccccaaactcatcatttatgatgtacaataatcggcctcgtagggtttctcatcgcttctctgctcaagtctggcacgtaccgcctcctgaccatctcgtgtctccgagctagaacgacgagtctgtaattactactgacagcaacattattattagttactttaccgtacgttacgggtagtttcgggcggtaacgggtaactaacggttcgaaccggttcgtaacggttccgaacgtaccccgaaggtccgtccgtacccccgtcgtaccgtaacgttcccgttacctttaccccccg

SEQ ID NO: 299462 - DNA, 575 bp, Homo sapiens
  misc_feature: GZ8MTXP02HYY6E.45.75.G09.1.454.CMB.2.raw
  modified_base (247)..(247): a, c, t, g, unknown or other
  misc_feature (247)..(247): n is a, c, g, or t
  modified_base (451)..(451): a, c, t, g, unknown or other
  misc_feature (451)..(451): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctccctgtctgggtctctggacagtcgatcaccatcccctgcactggatccagcggtgtacgttacttgtttttaagtntgtctctggtatcagcaacaccaggacaaacgcccccaaactcatctatttatgtatagtacaataactcggtaccctcgtacggggtttctcgtatccgtcttctccgtggcctcaacgtctcggactacgtaccggccctccctcgtaccatcttcgtggacctccgagctacgaaagtacgaggctagatttatactgccngactactattagtattagtcttactacgtcggtagttcggacgggtacggtacgtagttcggacctcgtacgtcgacgaccgaaggtcctaccgtccccgtacggtcacctctccgttcccccg

SEQ ID NO: 299463 - DNA, 524 bp, Homo sapiens
  misc_feature: GZ8MTXP02I6A9Q.45.75.G09.1.454.CMB.2.raw
  modified_base (227)..(227): a, c, t, g, unknown or other
  misc_feature (227)..(227): n is a, c, g, or t
  modified_base (244)..(244): a, c, t, g, unknown or other
  misc_feature (244)..(244): n is a, c, g, or t
  modified_base (420)..(420): a, c, t, g, unknown or other
  misc_feature (420)..(420): n is a, c, g, or t
  modified_base (436)..(436): a, c, t, g, unknown or other
  misc_feature (436)..(436): n is a, c, g, or t
  modified_base (438)..(438): a, c, t, g, unknown or other
  misc_feature (438)..(438): n is a, c, g, or t
  modified_base (450)..(450): a, c, t, g, unknown or other
  misc_feature (450)..(450): n is a, c, g, or t
  modified_base (465)..(465): a, c, t, g, unknown or other
  misc_feature (465)..(465): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtnacgttactgttttaagntgtctctggtatcagcaacaccaggcaaagccccaaactcaatcaatttatgatgtacaaataatacggccctacgaggggtttctcatcgcttctcctggtcctaccaagtctaggacagtacggtccctccctgaccactctccgtgggcctacccaggctagaaagacgaggntagtattatactgcananatatatatagtnttctacgtgtagtgngacgacgtagtacgtacgtactacgacgacgacgacgcgtcgccgtcgctactctctcc

SEQ ID NO: 299464 - DNA, 705 bp, Homo sapiens
  misc_feature: GZ8MTXP02G0PWR.45.75.G09.1.454.CMB.2.raw
tcagacgcgatcgacacgaccggtgctcgatttagtatagacatcagggggctctgggagaggagcccagcactgggattccgaggtgtttccattcagtgatctgcactgaacacagaggactcgccatggagtttgggctgagctgggttttccttgttgctattttaaaaggtgtccagtctgaggagcagctggtggagtcgtgggggaggcgttgggtccagggcccgggggggtccctcgagactctcggtgtgcagcctcgtggattccgaccgtcagtggcagcttcctgagcgtcggggtccgccgaggcctccgaaggggacgggccgtgggacgtggggtctcgtaagtttaagtttttagacacgggcaacgtacggacgttactacggcagtacgtttacccgggttaaacggggcccgtagttcccacctaacttctacccaaagacaaaccgtaaacttacccgaaaagggtaaccgtaacgggttcgtttacgtaggaaaattacgaaacctacccgtagaaccggaacccgaggaacaccggtctaccgtatacgttacgtgtagaccggaagacgtactacccgaaacccgaacggtaaaccccggaaaagtaaaactttcccgtaaaacaaacccgttaaacgtaccggttaacgttacgggtaacccgtacgggtaacccggggg

SEQ ID NO: 299465 - DNA, 608 bp, Homo sapiens
  misc_feature: GZ8MTXP02F73XY.45.75.G09.1.454.CMB.2.raw
  modified_base (244)..(244): a, c, t, g, unknown or other
  misc_feature (244)..(244): n is a, c, g, or t
  modified_base (293)..(293): a, c, t, g, unknown or other
  misc_feature (293)..(293): n is a, c, g, or t
  modified_base (359)..(359): a, c, t, g, unknown or other
  misc_feature (359)..(359): n is a, c, g, or t
  modified_base (378)..(378): a, c, t, g, unknown or other
  misc_feature (378)..(378): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgttttaagntgtctctggtatcagcaacaccaggcaaacgccccaaatcatcatttangatgtacaataactcggcctgtagggtttctaactcgtcttctcgtcgctccagtctggaccaacncggcctcctagacctatcncgtcgggctcgaggctaggacggacgaggctaggtaatttacgttacgtcgtctgtaccttcgtaattagtacggtaccgtaagggttacgttaaggttacgttttcggggtacggttcggggacgggtaacgggtacgtaaggtcgtaccgaccggttaccgtacggtaccgacggtacccgaacgggtcctaccggtcccccgttggtacctacgttccgtttccccg

SEQ ID NO: 299466 - DNA, 667 bp, Homo sapiens
  misc_feature: GZ8MTXP02HJ943.45.75.G09.1.454.CMB.2.raw
  modified_base (227)..(227): a, c, t, g, unknown or other
  misc_feature (227)..(227): n is a, c, g, or t
  modified_base (246)..(246): a, c, t, g, unknown or other
  misc_feature (246)..(246): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctcctgtctgggtctcctggacagtcgatcaccatcccctgcatggactccgagcggtntacgttacttagttttaantgtctcctggtatcagcaacaccaggacaaacgacccaactcactactatttatagtatagtacaagtaactccggtacccctacggttacgggtttctacgtacgttaccgtcctttcttaccgtcgtaccgtaccgtaacgttcgttacggtaacctaccgtacccgggtcccttacccgtaccgtacccgtactccgtcgtccggtcctacccggagtaccgtaacggaaacgtacggacggtctaacggttaattacgttacgtacgtacacggtactactagttattaagttcgttacgttaccgcgttacggtacggttacggacggtaacgtacgtacggtacgtccgtacggtacgtacgaccgtaccgacgtaaccgtcccgcccgtacgactccgtccgtcctttaccccg

SEQ ID NO: 299467 - DNA, 822 bp, Homo sapiens
  misc_feature: GZ8MTXP02G0K7E.45.75.G09.1.454.CMB.2.raw
  modified_base (265)..(265): a, c, t, g, unknown or other
  misc_feature (265)..(265): n is a, c, g, or t
  modified_base (277)..(277): a, c, t, g, unknown or other
  misc_feature (277)..(277): n is a, c, g, or t
tcagacgcgatcgacacgaccggtgctcgatttagtatagacatcagggggctctgggagaggagcccagcactgggattccgaggtgtttccattcagtgatctgcactgaacacagaggactcgccatggagtttgggctgagctgggttttccttgttgctattttaaaaggtgtccagtctgaggagcagctggtggagtcgtgggggaggtcttgggtccgaggccgggggggtccctcgagactctcgtgtgcagcctntggatcaccgtnagtggcagcttcctgacgtcgtcgggtccgccgaggcctccgaaggggacggccgtgggtaggtgggtctacgtagtttaatttagtacgacggtcacgagtcgtactacgactagtacttaccgggttaagggaccgtattacgaacctacttcctacccgaaggtaacctaacgaaactttcccgaaacgggtaaaccgttaccggggtttagttttacccgttaaaaggaaacgtttaccgggaaaacccctccccgttaagggaaaccgggtaacccccgggaaagggggtaaaccccgaaccccggggttaccgttaaaccctttaagtttaaaacccgttttggaacgggtttccggaaccggtaaaaggtacgggtaaaccttaaacccccgggggaaaacccctaaaggggaaaacccccccggggttaaaaagtaaaacccttttaccggtaaaaccgttaaaaccccgttaaacccgtttaaaagggggtactttaaccgggggaaaaccgttttcccggggtaaacccgggggg

SEQ ID NO: 299468 - DNA, 726 bp, Homo sapiens
  misc_feature: GZ8MTXP02GV7SL.45.75.G09.1.454.CMB.2.raw
  modified_base (280)..(280): a, c, t, g, unknown or other
  misc_feature (280)..(280): n is a, c, g, or t
  modified_base (295)..(295): a, c, t, g, unknown or other
  misc_feature (295)..(295): n is a, c, g, or t
tcagacgcgatcgacacgaccggtgctcgatttagtatagacatcaggggagctctgggagaggagcccagcactgggattccgaggtgtttccattcagtgatctgcactgaacacagaggactcgccatggagtttgggctgagctgggttttccttgttgctattttaaaaggtgtccagtctgaggagcagctggtggagtcgtgggggaggtcttgggtccgaggcccgggggggtccctcgagactctcgtgtgcagcctgtggattcaccgtnagtggcagccttccngagcgtcgggtccgccgaggcctaccgaaggggacgggccgtgggagtgggtctacgtaagttaaagtttttacgaaccgaggaccaacgaggtaccgtacgtacgcgaacgtaacgtttacccgggttaaaggggcccgtaacttccgacctatcctaccgaagaacgaactaaacgttacccgaacggtaaaccgtaccgggtttagttttaccgttaaggtaaaacttaccggtaaaacccgtaccccgttaagggaacccggaaccccggggaacggaacccgtaaccgggtaccttacttaaagttacttaccgtagtacggacgtaaggagtaaccgtaaccggaaaccccgaacgggaaaccccgtaaagtaaaccttaacgtaacaaacgttacgtaacggttacgtaccggtacgtaccggg

SEQ ID NO: 299469 - DNA, 646 bp, Homo sapiens
  misc_feature: GZ8MTXP02JKNXC.45.75.G09.1.454.CMB.2.raw
  modified_base (311)..(311): a, c, t, g, unknown or other
  misc_feature (311)..(311): n is a, c, g, or t
  modified_base (449)..(449): a, c, t, g, unknown or other
  misc_feature (449)..(449): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccactcccctgcactggatccaggcggtgtacgtttactgtttttaagtatgtctcgtggtatcagcaacaccaggacaaacgccccaaactcatctatttatgtatgtanaatactccgtccctacgttcgggtttctctacgtccgtctttctccgtcggcctaccagtcgtacggaccacgtacccggtcccttacccgtacgaacctcttcgtcgtcgggacctccgtaggctaggaaacgacgnggtactgttattaacttcgtagccaagacctataattatttaagtttcgttacgtttccgttacggtacgggttacgttacgggacgggaacggtaccttaaggtcgtacccgtacgtacgggttaccaacggtacccgtaacggtccgtacccgtccccgtacggtacctaccgttaccgttcccgtttacccccc

SEQ ID NO: 299470 - DNA, 880 bp, Homo sapiens
  misc_feature: GZ8MTXP02GRHSB.45.75.G09.1.454.CMB.2.raw
tcagacgcgatcgacacgaccggtgctcgatttagtatagacatcaggggagctctgggagaggagcccagcactgggattccgaggtgtttccattcagtgatctgcactgaacacagaggactcgccatggagtttgggctgagctgggttttccttgttgctatttaaaggtgtccagtctgaggagcagctggtggagtcgtgggggaggcgttggtccaggcccggggggtcctcgagactctcgtgtgcagcctctggatcaccgtcagtggcagcttcctgacgcgtcgggtcccgccgaggcctaccgaggggaacgggccgtagggaggttgggtcttacgtaaggttaaagttttttacgaacccgtaggggacctaacgtacggtaccggttaaccgttaacggccgtaaacgggtaaccgttttaccccggggtttaaaacgggggtccccgtaacgtttacccgaaaccccgtaagttacccttacccgaaacgaacggtaaaccctaaacccgttttaccccgaaaacggggtaaacccgtaaaccggggtttttacggttttaacccgttaaggttaaaaaacgttccgggtaaaaaccccttaacccccgttagggaaacccgggtaaacccccgggtaaacgggaaacccgaacccggggtaccttaaccttaaacgtttaaccgtttaaccgtttaggtacgggttaaaccgaaacgggtaaacgtaaccggttaacccggaaaaccccgttaaccgggaaaaccccgggtaaacggtaaaaacctttaaccggtaaaaccgtaaaaccttaaacggtttaaacccgggtaacggtttaacgggaccggtttaacccggggg

SEQ ID NO: 299471 - DNA, 615 bp, Homo sapiens
  misc_feature: GZ8MTXP02F0BUZ.45.75.G09.1.454.CMB.2.raw
  modified_base (235)..(235): a, c, t, g, unknown or other
  misc_feature (235)..(235): n is a, c, g, or t
  modified_base (281)..(281): a, c, t, g, unknown or other
  misc_feature (281)..(281): n is a, c, g, or t
  modified_base (293)..(293): a, c, t, g, unknown or other
  misc_feature (293)..(293): n is a, c, g, or t
tcagacgcgatcgacacgaccggtgctcgatttagtatagacatcagggggtagaggagcccagcactgggattccgaggtgtttccattcagtgatctgcactgaacacagaggactcgccatggagtttgggctgagctgggttttccttgttgctattttaaaggtgtccagtctgaggagcagctggtgagtctgggtaggctttgggtcccaggcccgggggttcccctnagactctcgtgtgcagcctctggattcacgtcagtggcagcttccngagctgggtccncgaggctccgaggggaacggcctgggagtggtctcgagttaatttttagacaggcacagcgtacacgcagacgttcgttaggccgattcaccatctccaagtagacaattcccaaggaaacacggttgttacttaagaaaacttcgaaaccacccgtgacggaccccgaggaccacgggctactagtattacgtggtcgacggaagacgaacgtacccgaaaacccgacggaaaccccggaaaataaaactttacaaacctaaacttaccgtaaccggtatacgggaaccgtcgtacgggggacccaaacggggaacccccg

SEQ ID NO: 299472 - DNA, 659 bp, Homo sapiens
  misc_feature: GZ8MTXP02FRXRJ.45.75.G09.1.454.CMB.2.raw
  modified_base (245)..(245): a, c, t, g, unknown or other
  misc_feature (245)..(245): n is a, c, g, or t
  modified_base (298)..(298): a, c, t, g, unknown or other
  misc_feature (298)..(298): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatccaccatcccctgcactggatccagcggtgacttactgtttttaagntgtctctggtatcagcaacaccaggacaaacgcccccaaatcatctaatttangtatgtacaataacgtccggcctgtagggttctcatcgcttctctcgctctaagtcgtcggacacgtaccgcctccctacgaccctagtcctagtcgggtcctaccgaggtctaggaacggacggacggtacttagtaagttacgttactgacccgagtacctaaacctagttaattaacgtttacgttacgtttacctaacggtttcgggtacgttccggggacgggtaacgggtaccgtaacggtttaccggtacccggttacgtaacgggttaccgaaccggtacccgtaaacggtccggtaccccgtaccccgttccgggtaacccttccgtaacccgtttcccggtttaccccccg

SEQ ID NO: 299473 - DNA, 611 bp, Homo sapiens
  misc_feature: GZ8MTXP02HB6SF.45.75.G09.1.454.CMB.2.raw
  modified_base (294)..(294): a, c, t, g, unknown or other
  misc_feature (294)..(294): n is a, c, g, or t
  modified_base (296)..(296): a, c, t, g, unknown or other
  misc_feature (296)..(296): n is a, c, g, or t
  modified_base (305)..(305): a, c, t, g, unknown or other
  misc_feature (305)..(305): n is a, c, g, or t
  modified_base (368)..(368): a, c, t, g, unknown or other
  misc_feature (368)..(368): n is a, c, g, or t
  modified_base (524)..(524): a, c, t, g, unknown or other
  misc_feature (524)..(524): n is a, c, g, or t
tcagacgcgatcgacacgaccggtgctcgatttagtatagacatcagggggctctgggagaggagcccagcactgggattccgaggtgtttccattcagtgatctgcactgaacacagaggactcgccatggagtttgggctgagctgggttttccttgttgcttattttaaaaggtgtccagtctgaggagcagctggtggagtcgtgggggaggcttggtccgagggccggggggtccctcgagactctcgtgtgcagcctgtggacttcgaccgtcgagtggcagcttccngngcgtggccncgaggctccgagggacggccgtggaggtcggtctacgtaagttaagttttagacaggcaacgngtacgtacacgcgtagtacttcggtaaacggccgtattcgacctatcctaccaagacgacaacttccgaaaggtaacctacgggtttacgttactagtaaactacgaaaccctccgtaggaccgacccgaggacacggtctacgttatacgttacnggtcacgtagacgtacaccgaaaccgaacggaaccgaaataacttacgaactaactacgttacggatacggacgttacggaccgggg

SEQ ID NO: 299474 - DNA, 688 bp, Homo sapiens
  misc_feature: GZ8MTXP02HBERG.45.75.G09.1.454.CMB.2.raw
tcagacgcgatcgacacgaccggtgctcgatttagtatagacatcaggggggagaggagcccagcactgggattccgaggtgtttccattcagtgatctgcactgaacacagaggactcgccatggagtttgggctgagctgggttttccttgttgctattttaaaaggtgtccagtctgaggagcagctggtggagtcgtgggggaggcttggtccaggccggggggtccctcagactctcgtgtgcagcctctggattcaccgtcagtgcagcttcctgagcgtgggtccgccgaggcctccgaggggaaggccgtggagtggggtctcgtagttaagtttttagacaggtacacgacgtcgtactacgactagtacttaccggttaaggggcctaagttaccaacctagttcctaccgaagtacgaacctaaacgttacccgaaagggtaaacacgggttacttttaccgtaagtaaaagttcgaaaaccgtacccgtaggaaccggaacccgaagggtaaccgacggtacttacgtaatacttacgtgtacgacgaagtacgaacgtaccggaaacccgaggaaaaccccggtaaaagtaaaaccttaccgtaaaacctaaccgttaacgtaacggtacgttacggacggtacggtacggggaaccgaaacggggtaacccccg

SEQ ID NO: 299475 - DNA, 705 bp, Homo sapiens
  misc_feature: GZ8MTXP02IID60.45.75.G09.1.454.CMB.2.raw
  modified_base (249)..(249): a, c, t, g, unknown or other
  misc_feature (249)..(249): n is a, c, g, or t
  modified_base (294)..(294): a, c, t, g, unknown or other
  misc_feature (294)..(294): n is a, c, g, or t
  modified_base (305)..(305): a, c, t, g, unknown or other
  misc_feature (305)..(305): n is a, c, g, or t
tcagacgcgatcgacacgaccggtgctcgatttagtatagacatcagggggggtctcaggaggcagcgctctcgggacgtctccaccatggcctgggctctgctattcctcaccctcctcactcagggcacagggtcctgggcccagtctgccctgactcagcctgcctcctgtctgggtctcctggacagtcgatcaccatcccctgccactggactccgaggcggtgtacgtttattgtttttaagntgtctcctggtatcagacaacacccaggacaaacgacccccaaancactcatttangtatagtacaaatacgtccggtacccttacgtaggggtttcctctaacttccgttcttccttccgtcggtccttaccgtaagttcgtacggaacctaaccggttacccggcccttaccccggtactacccgtattccgtcgtcggggtccctccggacggtcgtagaaacggcgaacggtcttagtaattacttacgtagaccgtaagacctaataacttagttaaacgtttcggttacgtttacccgtacggttacggggttacggtttaccgggggacggtaacggggtaaacctaaacggggttccgacccggttacgtacggtcgtaaccggacccgtaacgggccgttacccgtcccggttaccggtacctaccgtttccgtcccgtttcccccg

SEQ ID NO: 299476 - DNA, 790 bp, Homo sapiens
  misc_feature: GZ8MTXP02GV1PA.45.75.G09.1.454.CMB.2.raw
tcagacgcgatcgacacgaccggtgctcgatttagtatagacatcagggggctctgggagaggagcccagcactgggattccgaggtgtttccattcagtgatctgcactgaacacagaggactcgccatggagtttgggctgagctgggttttccttgttgcttaattttaaaaggtgtccagtctggaggagcagctggtggaggtcgtgggggaggtcgttgggtccgacggggcccgggggggtccctcgacgtaccttcgtcggtgtgcacgcctcgtggacttccgaccgtcaggtcgcagtcttccgtgacgtcgtcgggtcccgccgacggtccgtaccggaaggggacgggtccgtgggtacggttcggggtccttacgtaaagtttaaacgtttttacggacgtacggaccaacgacgtaccgttaacgtaccgacgtaggtaaccgtttacccggggttaaacggggtcccgtaacttaccaacctacgttccctaccgaaagtaacgaacctaaacgttacccgaaaggtaaacccgttacggtttcgttttaacgtaaacgtaaaacgttaccgaaaaccctacccgtaggaacccgaacccggaggacccgacggtactacgtaattacgttacgtgtacgacgtaacggacgaactaacccggaaacccgaacgggtaaaccccggtaaaataaacctttaccgtaaaaccgtaaaccggttaaccgttaaacgggtaaccgtacggggtaacccggttacgggtaacccggggg

SEQ ID NO: 299477 - DNA, 583 bp, Homo sapiens
  misc_feature: GZ8MTXP02FGVN1.45.75.G09.1.454.CMB.2.raw
  modified_base (245)..(245): a, c, t, g, unknown or other
  misc_feature (245)..(245): n is a, c, g, or t
  modified_base (299)..(299): a, c, t, g, unknown or other
  misc_feature (299)..(299): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccactccctgcactggatccagcggtgtacgttactgttttaagntgtctctgtatcagcaacaccaggaccaaaccgcccccaaactcatctatttangatgtactaataacgtccggtccctacgtacggggtttctctactcgtcttcgtccgtcggtcctacgaagtcgtacggactacgtaccggcccttcctcgacctatcctcgtcggctccgagctagaagcgagtctagtattactactgacagcactaattatatttacgtcgttccgtacgttcgggtacgtcggggacggaacggtacgtagtcgtaccgtcgtacgtacgaccgccgtaacgccgtccgccccgtacgtcctcgtccgtccgttaccccc

SEQ ID NO: 299478 - DNA, 539 bp, Homo sapiens
  misc_feature: GZ8MTXP02JNF74.45.75.G09.1.454.CMB.2.raw
  modified_base (295)..(295): a, c, t, g, unknown or other
  misc_feature (295)..(295): n is a, c, g, or t
  modified_base (360)..(360): a, c, t, g, unknown or other
  misc_feature (360)..(360): n is a, c, g, or t
  modified_base (390)..(390): a, c, t, g, unknown or other
  misc_feature (390)..(390): n is a, c, g, or t
tcagacgcgatcgacacgaccggtgctcgatttagtatagacatcagggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgtttttaagtatgtctcctggtatcagcaacaccaggcaaagcccccaaatcatcatttangatgtcaataatcggcctcgagggtttctcatcgcttctcctgctcaagtctgcagtacgctccngaccatctctggctcccgagctagagacgnggctgtattactatgctagctacatatagttacgtgtttaccacgttcggtagttcgggaccgaggggaccctagggttacaccggtccgtacggtccacggtcccgaaggcctcggccccgtacggtcctactccgttcgttcccccg

SEQ ID NO: 299479 - DNA, 638 bp, Homo sapiens
  misc_feature: GZ8MTXP02GJQXP.45.75.G09.1.454.CMB.2.raw
  modified_base (241)..(241): a, c, t, g, unknown or other
  misc_feature (241)..(241): n is a, c, g, or t
  modified_base (287)..(287): a, c, t, g, unknown or other
  misc_feature (287)..(287): n is a, c, g, or t
  modified_base (303)..(303): a, c, t, g, unknown or other
  misc_feature (303)..(303): n is a, c, g, or t
  modified_base (524)..(524): a, c, t, g, unknown or other
  misc_feature (524)..(524): n is a, c, g, or t
tcagacgcgatcgacacgaccggtgctcgatttagtatagacatcagggggctctgggagaggagcccagcactgggattccgaggtgtttccattcagtgatctgcactgaacacagaggactcgccatggagtttgggctgagctgggttttccttgttgctattttaaaaggtgtccagtctgaggagcagctggtggagtcgtgggggagtcttggtccgaggccggggggtccctnagactctcgtgtgcacgcctctggatcgacgtcagtgcagcttccngacgcgtcgggtcccnccgaggctaccgaagggaaggcccgtggagtcgggtctacgtaagttaatttttacgacacggtacaacgagcgtaactacgacaggtacttaccggttaaggggacctattcaacgtatcgtccaagagaactataccgagaacctaggtcgttactaagaacagtaaaccaacccgtgaaacggaccgaagggacaaccggtctactaatacttaacgngtacgcgaaggacaagtacccggaaaaccacgaaacccgggaaaataaacgttacctaaaactaaaacgtaaccgttaaaggtaaccgtaggtaaacggtacggtaacccgggg

SEQ ID NO: 299480 - DNA, 665 bp, Homo sapiens
  misc_feature: GZ8MTXP02GBBE9.45.75.G09.1.454.CMB.2.raw
  modified_base (257)..(257): a, c, t, g, unknown or other
  misc_feature (257)..(257): n is a, c, g, or t
  modified_base (324)..(324): a, c, t, g, unknown or other
  misc_feature (324)..(324): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctccctgtctgggtctccgtggacagtcgatccaccactcccctgccacgtggactccgaggcggtagtactttagttagtttttaagnttcgtctcgtggtatcagacaaccaccgaggaccaaaccgaccccaaactcatactatttatgagtntactaatacgtccggtaccctacgtacggggtttacctacgtactccgtcttactccgtcgtacctacgtaacgtcgtacggtacacgtacccgtccctacccgttacgacctactccgtcgtcgggacctaccgacgctacggaaacgtacggacggtactaggttattacgtcgtacgactacactaatattaattagtttacgttacgtttacgtacgttagggtacggttacgggacggtaacgggtacttaacggtaccggtacccgtacgttacggaccgtaccgccgaaccgtccgtccccgtcccgtcgcccgtacctccgttcccgtccccg

SEQ ID NO: 299481 - DNA, 604 bp, Homo sapiens
  misc_feature: GZ8MTXP02IFHEM.45.75.G09.1.454.CMB.2.raw
  modified_base (191)..(191): a, c, t, g, unknown or other
  misc_feature (191)..(191): n is a, c, g, or t
  modified_base (226)..(226): a, c, t, g, unknown or other
  misc_feature (226)..(226): n is a, c, g, or t
  modified_base (244)..(244): a, c, t, g, unknown or other
  misc_feature (244)..(244): n is a, c, g, or t
  modified_base (256)..(256): a, c, t, g, unknown or other
  misc_feature (256)..(256): n is a, c, g, or t
  modified_base (295)..(295): a, c, t, g, unknown or other
  misc_feature (295)..(295): n is a, c, g, or t
  modified_base (358)..(358): a, c, t, g, unknown or other
  misc_feature (358)..(358): n is a, c, g, or t
tcagacgcgatcgacacgaccggtgctcgatttagtatagacatcagggggggtctcaggaggcagcgctctcgggacgtctccaccatggcctgggctctgctattcctcaccctcctcactcagggcacagggtcctgggcccagtctgccctgactcagcctgcctccctgtctgggtctcctggacngtcgatcaccatcccctgcactggatccagcggtnacgttactgtttttaagntgtctcctggtntcagcaacaccaggcaaacgcccccaaatcatcatttangatgtacaatatcgcctgaggggtttcaatcgtcttctctcggctcctaagtctcggacaacncgggtccctcctagaaccaatcctcgttcgggcccttccggaggtacgtaggaacggacgtagtcttagtaactttattacgtgtcgtcgtactacgtatacgtacggtacgtaaggttagttacgtttacggtttgggttacggtacgggacgggtaacggtacgtacggtccgtacgtaccgttacgtacgtcgaccgaccgtaacgtcccgtaccgtccccgtcgtacctacgttccgtcccg

SEQ ID NO: 299482 - DNA, 704 bp, Homo sapiens
  misc_feature: GZ8MTXP02GS035.45.75.G09.1.454.CMB.2.raw
  modified_base (246)..(246): a, c, t, g, unknown or other
  misc_feature (246)..(246): n is a, c, g, or t
  modified_base (304)..(304): a, c, t, g, unknown or other
  misc_feature (304)..(304): n is a, c, g, or t
  modified_base (312)..(312): a, c, t, g, unknown or other
  misc_feature (312)..(312): n is a, c, g, or t
  modified_base (361)..(361): a, c, t, g, unknown or other
  misc_feature (361)..(361): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctcctgtctgggtctcctggacagtcgatcaccatcccctgcacgtggactccagcggtgtacgttacttgttttaanatgtctctgtatcagcaaccaccgaggaccaaaccgaccccaaatcattctaatttangtatgtanaaataacgtccggcctacggtaggggtttcctctaactccgtactttcnccgtcgtcctaccgaagtcgaggtacacgtcccgcccttaccgtacgtacctacgttcgtcgtcgggtcctacgacggtacgtaagaaacgggacgtaaccgggttcttaaagttaacgtttacgtacgtacgtactaacgtactaagttaattaacgtttaacgtttacgttaccgtttaccgtaacgggtttacgggttacgggttacggggaacgggtaaacggtaaccgttaacggttaccggtacccggttacggtacggtaaccgaccggtaaccggtaccgtcccgtacccggtccccgttacggtaccgtccgtttacccgttacccgttccccg

SEQ ID NO: 299483 - DNA, 736 bp, Homo sapiens
  misc_feature: GZ8MTXP02HKK88.45.75.G09.1.454.CMB.2.raw
tcagacgcgatcgacacgaccggtgctcgatttagtatagacatcagggggctctgggagaggagcccagcactgggattccgaggtgtttccattcagtgatctgcactgaacacagaggactcgccatggagtttgggctgagctgggttttccttgttgctattttaaaaggtgtccagtctgaggagcagcgtggtggagtcgtgggggaggtcgttgggtccgagggccggggggtccctcgagactctcgtgtgcagcctcgtggattcaccgtcagtggcagcttcctgagcgtggtccgcgaggctccgagggaacggccgtggagtggtctcgaagttaattttagacaggtaccacgagtcgtactacgcagtacgttaccggtaaacgggccgtaattccgacctactcctaccgaagaacgtaacctaaactttacccgaaagggtaaaccgtacgggtttacgttttcgttaaacgaaaagtttaccgaaacccgtaaccccgttaggaacccgaaaccccgggaagggaacccgtaacgggtaccttacgttaacgtttacgttaaaccgtgtacggaccggtaaggaacgtacgtaacccggaaaacccctaacgggtaaaacccccgggtaaaataaaacgtttacccaaaacccgtaaacgttaaccgttaaaacgggttaacgtaccggggtaaccggtttaccggtaaacccggggg

SEQ ID NO: 299484 - DNA, 648 bp, Homo sapiens
  misc_feature: GZ8MTXP02JELAT.45.75.G09.1.454.CMB.2.raw
  modified_base (561)..(561): a, c, t, g, unknown or other
  misc_feature (561)..(561): n is a, c, g, or t
tcagacgcgatcgacacgaccggtgctcgatttagtatagacatcaggggagctctgggagaggagcccagcactgggattccgaggtgtttccattcagtgatctgcactgaacacagaggactcgccatggagtttgggctgagcgtggttttcctgttgctatttaaaaggtgtccagtctgagagcagctggtggagtcgtgggggagcgttggtccgaggccggggggtccctcgagactctcgtgtgcagcctgtggattccaccgtcaggtggcagtccttcctgacgccgtggggtcccgccgaggccgtaccgaaggggaacgggccgttaggggaggtgggtctacgtaagttaaatttttacgacgtaggctacgagcgttaacacgcgagtacgttaccggtaggaccgactttaccacctatctacccgaagacgtaaacaaacgttacccgaaggtaaaccacggtttacgtttactaagtaaaacttacgaaacctacccgttagaaccgacccggaggaccacggtctagtaactattacgtagngtacgagacgacgtaaccgaaccgacgaaacccggtaataaaacgttcaaacgtaacgttacgtaacggtactcggtaacgtccggg

SEQ ID NO: 299485 - DNA, 593 bp, Homo sapiens
  misc_feature: GZ8MTXP02IJYLX.45.75.G09.1.454.CMB.2.raw
  modified_base (208)..(208): a, c, t, g, unknown or other
  misc_feature (208)..(208): n is a, c, g, or t
  modified_base (247)..(247): a, c, t, g, unknown or other
  misc_feature (247)..(247): n is a, c, g, or t
  modified_base (263)..(263): a, c, t, g, unknown or other
  misc_feature (263)..(263): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctcctgtctgggtctcctggacagtcgatcaccatccccngcactggatccaggcggtgacgttacttgtttttaagtntcgtctcgtgtatcanacaacaccagacaaccgaccccaaactcactatatttatgtatgtactaaatacgtccgtcctacgtacggttctctactctcttctccgtcgtcctactagtcgtacgactacgtccgtccctccgtacgacctactcgtcgtcgtctccgagtcgtagaacgacgagtctagtacttagtactacgacacgtactaactattaattagttacgttacgttacgtacgttcggtacggttcgggacgggtaacgtacgtacgtcgtaccgtacgtacgtcgaccgtaccgacgtccgtccgtcccgtcgtcctacgttccgtcgtcccg

SEQ ID NO: 299486 - DNA, 725 bp, Homo sapiens
  misc_feature: GZ8MTXP02F18D7.45.75.G09.1.454.CMB.2.raw
  modified_base (316)..(316): a, c, t, g, unknown or other
  misc_feature (316)..(316): n is a, c, g, or t
  modified_base (424)..(424): a, c, t, g, unknown or other
  misc_feature (424)..(424): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcaggacacagggtcctgggcccagtctgccctgactcagcctgcctccgtgtctgggtctcctggacagtcgatcaccatcctctgcactggaaccagcagtgtagttggttagggatttaataaccttgtcttccgtggtaaccaacacgaccaccgacggaccaaaccgacccccaaactcatgtattanggaggcagtaacgcgtcctgtagggtttctagtcgtcttctcgtcggctcgaagtctcggaccaacgccggccctccgacgactactcgtcgtgggcctcgaggtcgnggacggacggtagcgttagtagtttaacgtcgtcgtacgttgtaccttacgtagttacgtacgggtaaccgttaagggttaagtttacggggttttaccgggtttagggggttccgggtttaccgggggaacgggggttaaaccgggaaccgtaaaccgggtaccggttcccggggtaaaaccccggttccggttaaaccgggttaccgaacccggttacccggaaccggttccccggtacccccgggttccccccggttaccggttaccctttaccccggttacccggttttaccccccg

SEQ ID NO: 299487 - DNA, 628 bp, Homo sapiens
  misc_feature: GZ8MTXP02JITJ5.45.75.G09.1.454.CMB.2.raw
  modified_base (305)..(305): a, c, t, g, unknown or other
  misc_feature (305)..(305): n is a, c, g, or t
  modified_base (357)..(357): a, c, t, g, unknown or other
  misc_feature (357)..(357): n is a, c, g, or t
  modified_base (608)..(608): a, c, t, g, unknown or other
  misc_feature (608)..(608): n is a, c, g, or t
tcagacgcgatcgacacgaccggtgctcgatttagtatagacatcagggggctctgggagaggagcccagcactgggattccgaggtgtttccattcagtgatctgcactgaacacagaggactcgccatggagtttgggctgagctgggttttccttgttgctattttaaaaggtgtccagtctgaggagcagctggtggagtctgggggaggcttggtccgaggccgggggggtccctcgagactctcgtgtgcagcctcgtggattcaccgtcaggtggcaggcttcctgagcgtgggtccncaggctccgaggacggcctggagtgggtctcgagttatttagacaggcacgngcgtactacgcagtacttccggtaagggcctagttccaacgatcccgtaccaggacgaactattcccgaaggtaaaccgacgggttattttcgtaacgtaaaattacggaaaccctacccgttacggaaccgacccggagggtaaccaacgggtcttactaatacttaccgtaggtgaccgtaggacgttacgacccgaaaccgacggtaaccccggaaaagtaacttacgaacaaacgttacgaacggtntacggacgtcgtaacggggg

SEQ ID NO: 299488 - DNA, 680 bp, Homo sapiens
  misc_feature: GZ8MTXP02IOR3O.45.75.G09.1.454.CMB.2.raw
  modified_base (293)..(293): a, c, t, g, unknown or other
  misc_feature (293)..(293): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctcctgtctgggtctctggacagtcgatcaccatcccctgcactggactccagcgtgacgttactgttttaagatgtctcctggtatcagcaacaccagcaaacgccccaaactcatctatttangatgtacaatactccggcccttcgtacgggtttctctagtcgtcttctccgtcggcctcaagtcgtacggactacgtaccgccctcccgtacgaccctagtctcgtcgggtcctacccgtaggctaggaaacgtacggacggtctagtaacttatacgtacgacagactactaattattaacgtttacgttcgtttaccgtaacggtttacgggttacggtttaccggggacgggtaacgggttaacccgttaaaacgggtttccggtaacccggtttaccgtaacgggttacccgtaacccggaaccccgtaaacgggtcccgttaccccggtacccccgttcgggtaacccttaccggtttaccgtttacccgggtttccccccg

SEQ ID NO: 299489 - DNA, 695 bp, Homo sapiens
  misc_feature: GZ8MTXP02I335V.45.75.G09.1.454.CMB.2.raw
  modified_base (250)..(250): a, c, t, g, unknown or other
  misc_feature (250)..(250): n is a, c, g, or t
  modified_base (310)..(310): a, c, t, g, unknown or other
  misc_feature (310)..(310): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctcctgtctgggtctcctggacagtcgatcaccactcccctgcactggatccgaggcggtgtacgtttacttgtttttaagnttgtcctcgtggtactcagcaacaccaggacaaaccgaccccaaactcatactatttacngtatgtactaaataacgcggtccctacgtacggggtttctacgacttccgtccttctccgtcgtcctaccgtagttccgtggacctacgtccggtaccctccctacgacctactccgtcgtcggcctaccgaggtcgaagaacgagtacggacttgtaacgttatacgtagacacgacctattattaattacgtttaacgtttcgttaaaccgtcggttaccggggttacgtaccgggggtacgtaacggggttaaccgtaaaagggttcccggaccgtttaacggttacggtaccgtaaaccggacccgtaaacgggtccccgttccccggtaccccggttccgggtacccttaccttcccggttaaccccgtttacccccccg

SEQ ID NO: 299490 - DNA, 839 bp, Homo sapiens
  misc_feature: GZ8MTXP02I1VKL.45.75.G09.1.454.CMB.2.raw
tcagacgcgatcgacacgaccggtgctcgatttagtatagacatcagggggggagaggagcccagcactgggattccgaggtgtttccattcagtgatctgcactgaacacagaggactcgccatggagtttgggctgagctgggttttccttgttgcttattttaaaaggtgtccagtctgaggagcagctggtggagtcgtgggggaggcttgggtccgagggcccggggggtccctcacgactctcgtgtgcagcctctggacttcaccgtcaggtcggcagtcttccgtgacgtccgtgggtccccgcccgaggtccgtccggaaggggaacgggcccgtgggaggttcggggtccttacgtaagttttaaagttttttacggaaccgtaggtaccaacgtacggtaccgtaacgtaaccgaccgtaagttaaccgtttacccgggtaagggggtcccgttaaactttacccgaacccttaacgtccgttaacccgaaacggaaacgtaacctaaaccgttaccccgaaaggggtaaacccgtacgggtttacgtttttaccgttaaaggtaaaacgtacggaaaccccgtacccgtacgggaaacccggaaccccgggaaacggaacccggtaccgggttaccctttaacttaaacgtttaacttaaccggttggtacggtacggaaacggtaagacccgttaaccggaaaacccccgaaacgggtaaaaccccgggaaaaagttaaaacccgtttacaaaaccgttaacctaaacgttaaccgggtagtacgggtaccggtcggttaccggggaccgtaaaaccggggacccg

SEQ ID NO: 299491 - DNA, 661 bp, Homo sapiens
  misc_feature: GZ8MTXP02FUXEN.45.75.G09.1.454.CMB.2.raw
  modified_base (253)..(253): a, c, t, g, unknown or other
  misc_feature (253)..(253): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccactcccctgcacgtggactccagtctgtgtacgtttacttgtttttaagtnttcgtctccttggtatcagcaaccaccaggacaaacgaccccaaactcatctatttatgatgtactaataacgccgtcccgtacgtacggggtttctcgtatcgtcttccgtctcggactccgtagtcgttcgacaaacgtccggtcctcccctagtacctatcctcgtcgggtctccgacgcgtagaacgcgaggtctgtaacttactagtcgacgacgactaactaattattaagtttacgttactttcccgtaggttaccgggtaagttccggggtacggggtaaacgggtaccgttaaaggttaccggtaaacccgttcggttacgggtaaccgtaccggacccgtaacggtcccgtaacccggtcccccgtacggttcctaacccgtttcccgtttcccccgg

SEQ ID NO: 299492 - DNA, 616 bp, Homo sapiens
  misc_feature: GZ8MTXP02FUEC9.45.75.G09.1.454.CMB.2.raw
  modified_base (252)..(252): a, c, t, g, unknown or other
  misc_feature (252)..(252): n is a, c, g, or t
  modified_base (450)..(450): a, c, t, g, unknown or other
  misc_feature (450)..(450): n is a, c, g, or t
tcagacgcgatcgacacgaccggtgctcgatttagtatagacatcagggggggggtctcaggaggcagcgctctcgggacgtctccaccatggcctgggctctgctattcctcaccctcctcactcagggcacagggtcctgggcccagtctgccctgactcagcctgcctccctgtctgggtctccgtggacagtcgatcaccactcccctgcactggactccgagcggtgtacgtttacttgtttttaantgttctcctggtatcacgacaacaccaggacaaacgacccccaaatcatctatttatgatgtacaatactcgcctcgtagggtttctcatcgtcttctcgtcgctacagtctcggactacgtccgcctccgtacacctagtcctcgtacggctaccgagctagaagacgagtacgtagtattagttacgtagacgtanacctaatattaatttacgttacgttacgtttccacggttacggggttacgtccgggacggggtaacgtaccggtaggttccggaccgttacgtacggtacgtaaccgacccgtaacggtcccgtcccgtacccgtacggtaccctacgtcccgtaccggttccccc

SEQ ID NO: 299493 - DNA, 628 bp, Homo sapiens
  misc_feature: GZ8MTXP02FX4D5.45.75.G09.1.454.CMB.2.raw
  modified_base (249)..(249): a, c, t, g, unknown or other
  misc_feature (249)..(249): n is a, c, g, or t
  modified_base (303)..(303): a, c, t, g, unknown or other
  misc_feature (303)..(303): n is a, c, g, or t
  modified_base (307)..(307): a, c, t, g, unknown or other
  misc_feature (307)..(307): n is a, c, g, or t
  modified_base (309)..(309): a, c, t, g, unknown or other
  misc_feature (309)..(309): n is a, c, g, or t
  modified_base (441)..(441): a, c, t, g, unknown or other
  misc_feature (441)..(441): n is a, c, g, or t
  modified_base (461)..(461): a, c, t, g, unknown or other
  misc_feature (461)..(461): n is a, c, g, or t
  modified_base (466)..(466): a, c, t, g, unknown or other
  misc_feature (466)..(466): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctcctgtctgggtctcctggacagtcgatcaccactcccctgcactggactccgagcggtgtacgttacttagttttaagntgtctcgtggtactcagcaacaccaggacaaaccgccccaaatcatctatttangatnanaatagccggtcctgtaggtttctcactcgtcttcgtcctcggtccctacgtacgtcgtcggaactacgtccggaccctccgtagtaccctagttcctcggtcgggccttacccgaggtccaggaacggacgnggtcttaagtacttataccngacanactatattacgttattcgttaccgttcgtacgggttacggtacggtacgggacggtaacggtaccgttacggttacggtaccgttacggtaccggaccgaccggtacccgtacgtcccgtcccgtcccgtacgtacctacccgttcccgtacccttaccccc

SEQ ID NO: 299494 - DNA, 642 bp, Homo sapiens
  misc_feature: GZ8MTXP02JCSXS.45.75.G09.1.454.CMB.2.raw
  modified_base (248)..(248): a, c, t, g, unknown or other
  misc_feature (248)..(248): n is a, c, g, or t
  modified_base (300)..(300): a, c, t, g, unknown or other
  misc_feature (300)..(300): n is a, c, g, or t
  modified_base (334)..(334): a, c, t, g, unknown or other
  misc_feature (334)..(334): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccgagcggtgtacgttacttgttttaagtntgtctctggtatcagcaacaccaggacaaacgccccaaatcatactatttangatgtacaatactccggtacctcgtagggtttcnctactcgtcttctcctcggtcctaccgtaagtctacggactacgtccggcccttcccgtacgaccctacgttctcgtacggtccttaccgacggcgtaggaacgacgacggtctagtattacgtacgtagacgacgactacgtaattattacgttacgttcgttaccgtacggttacggttacggtacggggtacggtaacggtaacgttacggtacggtaaccgttacgtacggtaccgaaccgtaccggtaacgtcccgtacccgtacccgttcgtaccttccgtttcccgtcccggtttcccccg

SEQ ID NO: 299495 - DNA, 747 bp, Homo sapiens
  misc_feature: GZ8MTXP02HKQPA.45.75.G09.1.454.CMB.2.raw
  modified_base (305)..(305): a, c, t, g, unknown or other
  misc_feature (305)..(305): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctcctgtctgggtctcctggacagtcgatcaccactcccctgcactggactccagcggtgtacgttacttgttttaagtatcgtctctggtactcgagacaacaccaggacaaaccgcccccaaatcatctatttangatgtacaatacgtccggtccttacggtagggtttcctctacgttccgtactttcgtccgtcggacctaccgaagttcgtacggactacgtaccggtcccttacccgacgtaccctacgtccgttaccggtcggggtacctacccggtaggtacggttaggaaacggtacggtacgggtacttaacggttaattacgtttacgaggtacgtaacggtaccttaataacgtttaacgtttaacgtttacggtttaccgtttaaccgtaccgggtttacggggtttaacggttaccggggaacggggttaaacggtacccgttaaacggggttccgtaacccggttaccggttaacggacccgtaccggtaacccgtaacggggtcccctcccgggtacccccgttcggtacccttacccgttcccgttacccggtttaccccc

SEQ ID NO: 299496 - DNA, 582 bp, Homo sapiens
  misc_feature: GZ8MTXP02HC1GQ.45.75.G09.1.454.CMB.2.raw
  modified_base (305)..(305): a, c, t, g, unknown or other
  misc_feature (305)..(305): n is a, c, g, or t
  modified_base (381)..(381): a, c, t, g, unknown or other
  misc_feature (381)..(381): n is a, c, g, or t
  modified_base (408)..(408): a, c, t, g, unknown or other
  misc_feature (408)..(408): n is a, c, g, or t
  modified_base (454)..(454): a, c, t, g, unknown or other
  misc_feature (454)..(454): n is a, c, g, or t
tcagacgcgatcgacacgaccggtgctcgatttagtatagacatcagggggctctgggagaggagcccagcactgggattccgaggtgtttccattcagtgatctgcactgaacacagaggactcgccatggagtttgggctgagctgggttttccttgttgctattttaaaaggtgtccagtctgaggagcagctggtggagtctgggggaggcgttggtccgaggcccgggggggtccctcgagactctcgtgtgcagcctctggattcaccgtcagtggcagtcttcctgagcgtgggtccnccgaggcctccgaggggacggccgtggaggtggggtctcgtaagttaattttagacacgtcacagcgtactacgcngacgttacggtagggcctattacaacntctacagagactagtccaggaccacggttgttactagaatgaaccnccgtagacgacccggagtaaccgacgctacgtatactacgtgtgacgagacgtactaccgaaacccacggaaccgaaacgtaacttacgaacctaacgtacgtacggtatcggacgttacggacgggg

SEQ ID NO: 299497 - DNA, 508 bp, Homo sapiens
  misc_feature: GZ8MTXP02FOS5R.45.75.G09.1.454.CMB.2.raw
tcagacgcgatcgacacgaccggtgctcgatttagtatagacatcaggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgtttttaagtatgtctcctggtatcagcaacaccaggcaaagcccccaaactcatcatttatgatgtcaataatcggccctcaggggtttctcatcgcttctcctggctcaagtctggcatacggcctcctgaccatctctgggctccgaggctgaagacgaggctagattatactgcagcacatatattagtgtttcacttcggtattcggcgagggaccagttgaccgtctaggtcacgcccaaggctcgccctcggtcactctacgttcccc

SEQ ID NO: 299498 - DNA, 649 bp, Homo sapiens
  misc_feature: GZ8MTXP02GI481.45.75.G09.1.454.CMB.2.raw
  modified_base (312)..(312): a, c, t, g, unknown or other
  misc_feature (312)..(312): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccactcccctgcactggactccgagcggtgtacgtttacttgtttttaagatgtctcgtggtatcagcaacaccaggaccaaaccgaccccaaatcatactatttatgtatntaactaataacgtccggacccttacggtacgggtttctactactcgtcttcgtccgtcggacctacgaacgttcgtacggaactaccgtcccggtcccttcccgtacgaccctactccgtcggtacgggtcctacccgagtccgtaaggaaacgacggacggtacttagtaattacgtactaggacagtacctaatattaacgttattacgttacgtttacgtacggttacggtacgttacggggacggtaacggtacgtaggtccgtaccgtcgtaacggtcaaccgtccgaacgtcccgtaccgtcccgtcggacctacgtccttccgtaccccc

SEQ ID NO: 299499 - DNA, 596 bp, Homo sapiens
  misc_feature: GZ8MTXP02JUE5P.45.75.G09.1.454.CMB.2.raw
  modified_base (204)..(204): a, c, t, g, unknown or other
  misc_feature (204)..(204): n is a, c, g, or t
  modified_base (250)..(250): a, c, t, g, unknown or other
  misc_feature (250)..(250): n is a, c, g, or t
  modified_base (352)..(352): a, c, t, g, unknown or other
  misc_feature (352)..(352): n is a, c, g, or t
  modified_base (379)..(379): a, c, t, g, unknown or other
  misc_feature (379)..(379): n is a, c, g, or t
  modified_base (436)..(436): a, c, t, g, unknown or other
  misc_feature (436)..(436): n is a, c, g, or t
  modified_base (443)..(443): a, c, t, g, unknown or other
  misc_feature (443)..(443): n is a, c, g, or t
  modified_base (445)..(445): a, c, t, g, unknown or other
  misc_feature (445)..(445): n is a, c, g, or t
  modified_base (454)..(454): a, c, t, g, unknown or other
  misc_feature (454)..(454): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacgagggtcctgggcccagtctgccctgactcagcctgcctccctgtctgggtctcctggacagtcgatcaccntcccctgcactggaactccgagcggtgtacgttacttgttttaagntgtctctggtatcagcaacaccaggacaaacgccccaaactcatctattatgatgtacaatactcggcctacgtagggttctcactcgtcttctccgtgtcnctaagtcgcgcaccaccggtcctaccngactaactctcgtcgggtacctcgaggtctggaaggcgaggctagtattacttacgngtcgtcncnctagtacgngtgtaggttaagttacgttaggttggttcggtacgggtacgggaacggtacgtacggaccgtaccgtaccgtaccgtacggtacccgaccggtaacccgtacggtcccgtcccggtaccccgtccggtacctacccgtcccg

SEQ ID NO: 299500 - DNA, 832 bp, Homo sapiens
  misc_feature: GZ8MTXP02GADVB.45.75.G09.1.454.CMB.2.raw
tcagacgcgatcgacacgaccggtgctcgatttagtatagacatcagggggctctgggagaggagcccagcactgggattccgaggtgtttccattcagtgatctgcactgaacacagaggactcgccatggagtttgggctgagctgggttttccttgttgctattttaaaaggtgtccagtctggaggagcagcgtggtggagtcggtgggggaggtcgttcgggtccgacgggcccgggggggtccctcgacgtactcgtcggttgtcgcacgtcctcgtggtacttccgaccgtcgagtgggcacgtcttccgtggacgcgtcgggtcccgccggacggccgtccggaaggggaacgggtccggtgggtagggtcgggtaccttacgtaaggtttaatttttaacggtacgtacggggtccgacgacggtaccggttacgtaacggtacgtacggttaccggtttacccggttaaaggggtcccgtagttacccgtaccgtacgttaccctacgaaacgtaacggaaacctaaacgttacccggaaacggtaaaccgttacgggtttacgtttttaccgaaagtaaacgttacgaaacccgttacccgtaacgggaccgtaaacccgggacgggtaaccgtaccgtacgttaccgtaaagtttacgtacgttacggacgacggttaaacggaacgtaccggtaacccgaaaacccggtaccgggaaaacccgtaaaaacggttaactttaaacccaaaacgtaaaacccggttaaaacgttaccgggttacgtaaaccgggtaccggttacggggtaaaccccggggg

SEQ ID NO: 299501 - DNA, 796 bp, Homo sapiens
  misc_feature: GZ8MTXP02JBMBH.45.75.G09.1.454.CMB.2.raw
  modified_base (261)..(261): a, c, t, g, unknown or other
  misc_feature (261)..(261): n is a, c, g, or t
tcagacgcgatcgacacgaccggtgctcgatttagtatagacatcagggggctctgggagaggagcccagcactgggattccgaggtgtttccattcagtgatctgcactgaacacagaggactcgccatggagtttgggctgagctgggttttccttgtgctatttaaaggtgtccagtctgaggagcagctggtggagtcgtgggggaggcttggtccgaggcccgggggggtccctcgagactctcgtgtgcagcctntggattcaccgtcagtggcagtcttacctgacgtcgtcgggtcccgccgaggcctaccggaggggaacgggcccgtagggaagggttcggggtctacgtaaggtttaaactttttaaggtacgtacggtaccaacgtacggtaccgttaacgtacgcgacggttacgtttaacccggggttaaacgggacccgtaacttaccgaacctagttccctacccgaaggaacgtaaactaaacgttccccgaaaaggtaacccgttacgggtttcgttttaacgtaaacggtaaaattaccggaaaaccctaccccggttagggaacccggaaaccccgggtaggaaacccccgtaacggggcccttaaacttaagttaaccgtttaccggtaggttaccggtacgaaacgggacggtaaaccgttaaccccgggaaaaccccgaacgggaaaacccccggggtaaaaagttaacttaacccgtaaacgtaaacttaaccggttacggtagtaccggtacgtacgggtaaacccggggg

SEQ ID NO: 299502 - DNA, 578 bp, Homo sapiens
  misc_feature: GZ8MTXP02IYZJS.45.75.G09.1.454.CMB.2.raw
  modified_base (246)..(246): a, c, t, g, unknown or other
  misc_feature (246)..(246): n is a, c, g, or t
  modified_base (297)..(297): a, c, t, g, unknown or other
  misc_feature (297)..(297): n is a, c, g, or t
  modified_base (326)..(326): a, c, t, g, unknown or other
  misc_feature (326)..(326): n is a, c, g, or t
  modified_base (337)..(337): a, c, t, g, unknown or other
  misc_feature (337)..(337): n is a, c, g, or t
  modified_base (397)..(397): a, c, t, g, unknown or other
  misc_feature (397)..(397): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctcctgtctgggtctcctggacagtcgatcaccatcccctgcactggactccagcggtgacgttacttgtttttaagntgtctctggtatcagcaacaccagacaaacgccccaaactcatctatttangatgtacaatactcgccctgtaggtttcnctatcgcttcnctgctacagtctgcataccgcctcctagaccatcgtcgtcggctccgagctagaagacgngtctagtacttatctgacagactatattattacgttagtcgttacacggttacggtacgttacgggacggaacgggtaacctaacggttccggtaccgttaccgtacggtaccgaccggtcccgtaaggtcccgtcccgtccccggttcggtaccctcgttcccgttccggtttccccccg

SEQ ID NO: 299503 - DNA, 720 bp, Homo sapiens
  misc_feature: GZ8MTXP02JP17E.45.75.G09.1.454.CMB.2.raw
  modified_base (253)..(253): a, c, t, g, unknown or other
  misc_feature (253)..(253): n is a, c, g, or t
tcagacgcgatcgacacgaccggtgctcgatttagtatagacatcagggggggggtctcaggaggcagcgctctcgggacgtctccaccatggcctgggctctgctattcctcaccctcctcactcagggcacagggtcctgggcccagtctgccctgactcagcctgcctcctgtctgggtctccgtggacagtcgatccaccactcccctgcactggactccgagcggtgtacgtttacttgttttaagtntcgttctcgtggtatcagacaaccaccgaggaaccaaaccgacccccaaactcatacgtatttactatatagtaactaactacgtccggtccttacggttacgggtttcctactacgttccgtctttcgtccgtcggtaccttacctaacggttcgtaacggacctaccggtacccggtccctaccctcgtaacctacgttccgtcgtccgggtcctaccggtaggtacgtaggaacgtacggtacgtacttaggttaactttacgttactacgacgtacacctaagttatttaacgttacgtttacgtttacgttaccgttacgggttacggggtttacggtacggggtaacggggtaacggtaccggttaacggttccggtaccggttacgttaacggaccgacggacccgtacgtccgtcccgtacccgtcggtaccctaccgttcccgtcccggtttcccccg

SEQ ID NO: 299504 - DNA, 626 bp, Homo sapiens
  misc_feature: GZ8MTXP02IBBVW.45.75.G09.1.454.CMB.2.raw
  modified_base (252)..(252): a, c, t, g, unknown or other
  misc_feature (252)..(252): n is a, c, g, or t
  modified_base (345)..(345): a, c, t, g, unknown or other
  misc_feature (345)..(345): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccactcccctgcatggatccgaggcggtgtacgtttactttagttttaagtnttgtctccgttggtatcagcaaccaccaggaccaaaccgccccaactcatactatttatgtatgtactaatactccgtcctgtacgggtttcnctctcgtctctcgtacgtcctctagtctaggactacgtacccgtcctcccgtactacctactctcgtacgtcacgcgctaacgaacgtacgaggtcttagtacttactcgactcgacactaattattattatttacgttactttaccgtacggttcgggtttacgtcggggtaacgggtacgggtaaccgttacggttccggaccgttacggtacggtaccgaccgtacgacggtcccgtccgtccccggtcggtaccctccgttccgttaccgttccccc

SEQ ID NO: 299505 - DNA, 685 bp, Homo sapiens
  misc_feature: GZ8MTXP02FHDZY.45.75.G09.1.454.CMB.2.raw
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccactccctgcactggatccagcggtgtacgttactgtttttaagatgtctctggtatcagacaacaccagacaaacgccccaaactcatactatttatgatagtactaaataacgtccggtacccgtcgtacggggtttctactacgtcgtcttctccgtcgtcctacaagtctgactactccggcctacctgacctatcctcgtcgggtcctccgaggtcgtagaacgtacgacgggtactagttatttacgtacgttacgacagtacctaatattaagtttagttacgtttaccgtttaccgtacggttacggggttacgttaccgggggacggggtaaccggtaaaccggttaaaacggttcccgggtaaaccggtttacccggtaacggtaccgtaacccggacccgtaaaccgggtcccgtccccggtacccccggtacccgggtacctacccggtttccttccccggtttaccccccg

SEQ ID NO: 299506 - DNA, 705 bp, Homo sapiens
  misc_feature: GZ8MTXP02FK981.45.75.G09.1.454.CMB.2.raw
  modified_base (266)..(266): a, c, t, g, unknown or other
  misc_feature (266)..(266): n is a, c, g, or t
tcagacgcgatcgacacgaccggtgctcgatttagtatagacatcagggggctctgggagaggagcccagcactgggattccgaggtgtttccattcagtgatctgcactgaacacagaggactcgccatggagtttgggctgagctgggttttccttgttgctattttaaaaggtgtccagtctgaggagcagctggtggaggtcgtgggggaggcttggtccgagggcccgggggggtccctcgagactctcgtgtgcagcctntggattcaccgtcagtggcagcttcctgacgcgtcgggtcccgcgaggctccggaaggggacgggccgtgggaggtcggggtcttacgtaagttaagtttttacggactagggacctaacgacggccgttaacacggactacggtaatttacccgggttaaaggggcccgtaatttaccaacccgtattaccctaccgaaggaacgtaactaacttacccgaagggtaaacctacgggttacgtttaccgtagtaaaacttacgtaaacctaacccgtagaaccggtaacccggaacggaacaaccggacttacgtaattaacttacgtagtacgacggtaagacgtactaccgaaaccgaacgaacccgggaaaactaaacgttactaaacctaacgttaaccgtacggttaacgtacggtacggtcggtaaccgggg

SEQ ID NO: 299507 - DNA, 733 bp, Homo sapiens
  misc_feature: GZ8MTXP02HYJOQ.45.75.G09.1.454.CMB.2.raw
  modified_base (555)..(555): a, c, t, g, unknown or other
  misc_feature (555)..(555): n is a, c, g, or t
  modified_base (652)..(652): a, c, t, g, unknown or other
  misc_feature (652)..(652): n is a, c, g, or t
tcagacgcgatcgacacgaccggtgctcgatttagtatagacatcaggggggagaggagcccagcactgggattccgaggtgtttccattcagtgatctgcactgaacacagaggactcgccatggagtttgggctgagcttgggttttccttgttgcttattttaaaaggtgtccagtctgaggagcagcgtgggtggacggttcggtggggggaggtcgtttcgggtcccggacgggtcccggggggggttcccctcgaggtaccgttccgtcggtcggtgccacggtcccttcgtacgggtaactttcccgacccggtcaggtggccgtgcctttcccgtggcgtccggtcggggtccccggacccgacgggtccccttaccggggaagggggaaaccggggtcccgtggggtacgggttcgggggttccttacgttaaaggtttttaaaacgttttttacggaaacgtagggactacggtaaccgtacgtaaacctacgactaggtacgtttaccggttaggggccttagtaccaccgtactcctacgaanacgtacaacttacgaagaacgtgtttacgttcgtaagaactcgacctacggtacgacggacccgtaggaccagggtacacttatattcgtagacggngagacgactaccgaaccgaacgaacgtaaataactacgaactaacgtagtaacgtagtacgacgtcggacggacaacggcc

SEQ ID NO: 299508 - DNA, 610 bp, Homo sapiens
  misc_feature: GZ8MTXP02FKMAW.45.75.G09.1.454.CMB.2.raw
  modified_base (244)..(244): a, c, t, g, unknown or other
  misc_feature (244)..(244): n is a, c, g, or t
  modified_base (257)..(257): a, c, t, g, unknown or other
  misc_feature (257)..(257): n is a, c, g, or t
  modified_base (266)..(266): a, c, t, g, unknown or other
  misc_feature (266)..(266): n is a, c, g, or t
  modified_base (293)..(293): a, c, t, g, unknown or other
  misc_feature (293)..(293): n is a, c, g, or t
tcagacgcgatcgacacgaccggtgctcgatttagtatagacatcagggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcgtgacgttactgttttaagntgtctctggtatnagcacaccnggcaaagcccccaaatcatcattttangatgtacaatactccgccctgtagggttctctctctcttctcctcgctctacgtcgtgactactaccgtccctcctacgacctactctcgtcgggtacctccgacggtgacgaaaggacggaggtacgtagtattaacgtttacgcgtcacgtacaactaattagttacgtttacgtttacggttacccttacggtacgggttacggttacgggtacgggacggggtaaccgtaacggttacgtacccggtccgtacggtacgacgaccgacggccgtccgtacccccgtccggtctacctccgttcccgtcccccg

SEQ ID NO: 299509 - DNA, 615 bp, Homo sapiens
  misc_feature: GZ8MTXP02I4TYF.45.75.G09.1.454.CMB.2.raw
  modified_base (248)..(248): a, c, t, g, unknown or other
  misc_feature (248)..(248): n is a, c, g, or t
  modified_base (301)..(301): a, c, t, g, unknown or other
  misc_feature (301)..(301): n is a, c, g, or t
  modified_base (353)..(353): a, c, t, g, unknown or other
  misc_feature (353)..(353): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgccactggactccagcggtgtacgttacttgttttaagntgtctctggtatcagcaacaccgaggacaaacgccccaaatcactctatttangatgtacaatacgtcgcctgtaggtttctcatcgtcttctctcgctcagtcncgactacgtcgcctcctacgacctatccgtcgtacgggccttcgaaggtctaacggaaagtacggaagggtccttaggtaactttagttactcgacgtaacgactaactaattattaaacgttcgtttacgtttactacggttcgggttagttcgggacggtacggtaactaacggttcgacccgttacacggttaccacggtacccgtaacgtccgtacccgtccccgttacggtaccaccgttccgttacgtttcccccg

SEQ ID NO: 299510 - DNA, 743 bp, Homo sapiens
  misc_feature: GZ8MTXP02G7LIR.45.75.G09.1.454.CMB.2.raw
  modified_base (255)..(255): a, c, t, g, unknown or other
  misc_feature (255)..(255): n is a, c, g, or t
  modified_base (401)..(401): a, c, t, g, unknown or other
  misc_feature (401)..(401): n is a, c, g, or t
  modified_base (465)..(465): a, c, t, g, unknown or other
  misc_feature (465)..(465): n is a, c, g, or t
  modified_base (527)..(527): a, c, t, g, unknown or other
  misc_feature (527)..(527): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcaggcacagggtcctgggcccagtctgccctgactcagcctgcctcctgtctggtctcctggacagtcgatcaccactccccgtgactacgtggactccgaggtcggtcgtacgtttacttgtttttaagnttgttcctcgtggtactcgacgaccaaccgaccccgaaggacccaaaaccgaccccctaaaactccaattagtaattttacgagggtaacggacgtaaaggtaacgccggtcccttaggtacgggttttacaacgtccgtctttcncgtcgtcccctacgtaacgttcgcggaccaaccggtacccgcctccgtaacgactacgttccgngtccgggtcctaaccgcggtccgtaggaccgggaacgtgtacggttataactttaagtcgancccgttagtactaccggtattgacgtaggttaaacggtttagtaaggttttacggtttcgggtcggttaaccgggggtacgggacgggtaaaaccctgggtaaccgtccggttaccggttacgtacggttaaccgaacccggtccggttaacggccccgtccccgttacccccgggttacgttacccgttaccggtttcccgtttacccgtccccc

SEQ ID NO: 299511 - DNA, 825 bp, Homo sapiens
  misc_feature: GZ8MTXP02H25B0.45.75.G09.1.454.CMB.2.raw
  modified_base (234)..(234): a, c, t, g, unknown or other
  misc_feature (234)..(234): n is a, c, g, or t
  modified_base (240)..(240): a, c, t, g, unknown or other
  misc_feature (240)..(240): n is a, c, g, or t
  modified_base (288)..(288): a, c, t, g, unknown or other
  misc_feature (288)..(288): n is a, c, g, or t
tcagacgcgatcgacacgaccggtgctcgatttagtatagacatcaggggagctctgggagaggagccagcactgggattccgaggtgtttccattcagtgatctgcactgaacacagaggactcgccatggagtttgggctgagctgggttttccttgttgctattttaaaggtgtccagtctgaggtagcagctggtggagtcgtggggagcttggtcagccgggggtcctnagactntacgtgtgcagcctactggattcaccggtcagtggcacgtcttaccgngtacgcgtacgggtcccgtcgagtccgtacgaaggggaacggccgttgggacgggtcggttccgtagttaacggtttaacgtttttaacgacccgttacggggaccttacgacggtcgtttaaccgacgtcgtaacgttacggtttacccgtttaagggggaccccgtaatttcccgaaacccgtacctttaccgttacccgtaaggaccggttaaaccaagttttccccgaaagggttaaccgtacgggtttacgggttttacccttaagtaaaaccggttacgtaaaacccggtaacctttaccggggaaaccgtaacccggggtaaacccgggtaaacgaacccgggtacccttttaaaccgaaggtttttaaaacttacggtccgttaaaacggcccggtttaaaacggagttaaacccgttaccccgggaaccctaaaacggttaaccccggtaggaaaaccggttaaaacgtccccttaaaaggtacccgttaaaccttaaccgggggtaaacgtttcggtaaaacccggg

SEQ ID NO: 299512 - DNA, 796 bp, Homo sapiens
  misc_feature: GZ8MTXP02HJIX9.45.75.G09.1.454.CMB.2.raw
  modified_base (174)..(174): a, c, t, g, unknown or other
  misc_feature (174)..(174): n is a, c, g, or t
  modified_base (254)..(254): a, c, t, g, unknown or other
  misc_feature (254)..(254): n is a, c, g, or t
  modified_base (261)..(261): a, c, t, g, unknown or other
  misc_feature (261)..(261): n is a, c, g, or t
  modified_base (264)..(264): a, c, t, g, unknown or other
  misc_feature (264)..(264): n is a, c, g, or t
  modified_base (269)..(269): a, c, t, g, unknown or other
  misc_feature (269)..(269): n is a, c, g, or t
  modified_base (275)..(275): a, c, t, g, unknown or other
  misc_feature (275)..(275): n is a, c, g, or t
tcagacgcgatcgacacgaccggtgctcgatttagtatagacatcagggggggagaggagcccagcactgggattccgaggtgtttccattcagtgatctgcactgaacacagaggactcgccatggagtttgggctgagctgggttttccttgttgcttaattttaaaaggtntccagtctgaggagcagctggtggagtcgtgggggagcttgggtccaggccggggggtccctcgagactcgtcgtgtgcngctctgntcnccgtngtcgcngtctcctgagcgtggtccgccgacggccgtaccgaggggaacggccgtaggaggtggtacgtacgtagttaactttttagtacgtaggacaacgacgtaccgtacctacgacgtacgtacgttaccggacggggtttttttttcccgaacgtttaccaaccgtacctacctaccgtaaacgaaacgtaaactaaacgttacccgaacggtaaaaccgtacccgggtttaagttttaaccgttaagtaaaacgttacgaaaccgaacccgttacggaaccggaaacccggaccggtaaacgtacccgggacttaaccttaaacggttaactttaccggtagttacggacggtaacgtaacgggtaactaacccggaaaacccggttaaaccgggaaaccccgggaaaaaccggttaaaacgttaaacccgttaaactaaaacccgttaacgttaaaccggtttacggtaaaccgggtaccggtacgggtaaccggggaaccggaaaccgggtaaacccccgg

SEQ ID NO: 299513 - DNA, 832 bp, Homo sapiens
  misc_feature: GZ8MTXP02F59UF.45.75.G09.1.454.CMB.2.raw
  modified_base (193)..(193): a, c, t, g, unknown or other
  misc_feature (193)..(193): n is a, c, g, or t
  modified_base (212)..(212): a, c, t, g, unknown or other
  misc_feature (212)..(212): n is a, c, g, or t
  modified_base (232)..(232): a, c, t, g, unknown or other
  misc_feature (232)..(232): n is a, c, g, or t
  modified_base (272)..(272): a, c, t, g, unknown or other
  misc_feature (272)..(272): n is a, c, g, or t
  modified_base (282)..(282): a, c, t, g, unknown or other
  misc_feature (282)..(282): n is a, c, g, or t
  modified_base (313)..(313): a, c, t, g, unknown or other
  misc_feature (313)..(313): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacgagggtcctgggcccagtctcgccctgactcagcctgcctcctgtctgggtctcctggacngtcgatcaccactcccctnccatggatccgaggtcggtntacgtttacttagttttaatattcggtctcgtggtatcanaccacgaccnggaccaaacgccccaaactcatactatttangtatcgtaacaagtaacgtccgtccgttacgggtagggtttcctacgtacgttccgttccgtttacgtccccgttaccgtaccgttacgaaacgtttcgtaacggtaacctaccggtccggtaccccttccgtaccgtacctacgtttccggtacggttcgggacccttacgggagtcgtaacggaaacgtacggaacggttcgttaagttacctttaaacgtccgtggtaaacctacggtacctaaacttagttaaacctttaggttaaccgtttaccgggtttaaccccgtaacgggttttaccgggggttaacggttaccgggggtaacccgggggtaaagggttaaaccccggtttacggggttaaacccgggttaacccgttaaccggtaaaccggggttaccggtaaccggttaacccggtaaaacgggtcccccgttaaacccccggggtacccggtttaccgggttaaacccgtttaccctttcccggtttaaacccccgggtttaccccc

SEQ ID NO: 299514 - DNA, 512 bp, Homo sapiens
  misc_feature: GZ8MTXP01BCKCL.38.23.C01.1.454.CMB.2.raw
  modified_base (426)..(426): a, c, t, g, unknown or other
  misc_feature (426)..(426): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctctgggcgagaggccaccatcaactgcaagtccagccagagtctttgtcagctccaaagatatgagtcgtagcttggtaccagcagaaagcacgacagtcccctaagtgctctatttatggtcatctacgtcgggtgtccggggtccctgaccgattcgagcgcagcggatcgtgggacagatttcactctcaccatcagcagcctgcagactgaagatggtggctagtttatactgtcaganaatattagtggtagtcctcggctcacgtttcgggcggttacgggaccaagggtggaagaagtcgaaggccgtaacgttgtaacggg

SEQ ID NO: 299515 - DNA, 546 bp, Homo sapiens
  misc_feature: GZ8MTXP01A2XIZ.38.23.C01.1.454.CMB.2.raw
  modified_base (373)..(373): a, c, t, g, unknown or other
  misc_feature (373)..(373): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagcctgggggtccctgagctctcctgtgcagcctctggattcatatttagtaatcattggatgagttgggtccgccaggctccgagggacggggctggagtgggtggccactataaaccacgatggaactagaaaaagactaaangtggactctgtgaagggccgattcaccgtctccagagacaacgaccaaagattcacttgtatttgacaaatgaaacagcctagagagtcgaaagacacggccatataatttaattgtagttaaaagattcatttcgattaatgggttggcggacggttacggggtggcgtaag

SEQ ID NO: 299516 - DNA, 514 bp, Homo sapiens
  misc_feature: GZ8MTXP01BTVF1.38.23.C01.1.454.CMB.2.raw
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctctgggcgagaggccaccatcaactgcaagtccagccagagtctttgtcagctccaaagatatgagttcgtagcttggtaccagcagaaagcacgacagtcccctaagttgctctatttatggtcatctacgtcgggtgtccggggtccctgaccgtattcagcggcagcggatcgtgggacagtatttcactctcacatcagcacgcctgcagactgaagatggtggctagtttattactgtcagactaatattatggtatcctcggctcttacgtttcgggcggacggggaccaagggtggagtaatcgaaaggccgtaacgttggtgg

SEQ ID NO: 299517 - DNA, 521 bp, Homo sapiens
  misc_feature: GZ8MTXP01BQ46C.38.23.C01.1.454.CMB.2.raw
  modified_base (417)..(417): a, c, t, g, unknown or other
  misc_feature (417)..(417): n is a, c, g, or t
  modified_base (444)..(444): a, c, t, g, unknown or other
  misc_feature (444)..(444): n is a, c, g, or t
  modified_base (518)..(518): a, c, t, g, unknown or other
  misc_feature (518)..(518): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagacctccctggctgtgtctcgtgggcgagagggccaccatcaactgcaagtccagccagagtctttgtcagctaccaagatatgagttcgtagcttggtaccagacaagaaagcaacgacacgtcccctaagtgctacatttatggtcatctacgtcgggtcgtcccggggtccctggaccgtattcgagcggacagcggatcgtgggacagtatttcactctcacatcagcagcctgacagactgaaagntgggtcggactagtttacttactgtanagtataatatagtgtgtcgtcgttctcgttcgttcggtcggacggacgaggtaaggagaagagagacgtaacgngtg

SEQ ID NO: 299518 - DNA, 493 bp, Homo sapiens
  misc_feature: GZ8MTXP01EEOU1.38.23.C01.1.454.CMB.2.raw
tcagtcgatcacgtcacgaccggtgctcgatttagtacacgtgattagggattgggacaacaggcaggcaggggcagcaagatggtgttgcagacccaggtcttcatttctctgttgctctggatctctggagcctacggggacatcgtgatgacccagtctccagactccctggctgtgtctctgggcgagaggccaccatcaactgcaagtccagccagagtctttgtcagctccaaagatatgagttcgtagcttggtaccagcagaaagcacgacagtcccctaagttgctcatttattggtcatctactcgggtgtccggggtcctgaccgattcagcggcagcggatcgtgggacagatttcactctcaccatcagcagcctgcagactgaagatgggtggctagtttatactgtcagcaatattatggtagtcctggctcacgtttcgggcggagggccaagggtggagaatcagcgtaacttgtg

SEQ ID NO: 299519 - DNA, 545 bp, Homo sapiens
  misc_feature: GZ8MTXP01DCML7.38.23.C01.1.454.CMB.2.raw
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctcgtgggcgagacgggccaccatcaactgacaagtccagccagagttcttttgtcagctaccaaagaatatgagttcgtagcttggtaccagcaagaaagcacgacacgtcccctaagttgctctatttatggtcatctacgtcggtgtccggggtcctgaccgattcgacgcggacaggcggatcgtggggacagtatttcactctcaccatcagcagcctgcagactgaagatgggtgctagtttatactgtcagactaatattatggtagtccgtcggctcgttacgtttcgggcgggttaggggacccgaagggttgggaagtaagttacgaacggttacgtaaccgttgggttcggg

SEQ ID NO: 299520 - DNA, 555 bp, Homo sapiens
  misc_feature: GZ8MTXP01BF6C6.38.23.C01.1.454.CMB.2.raw
  modified_base (276)..(276): a, c, t, g, unknown or other
  misc_feature (276)..(276): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctctgggcgagaggccaccatcaactgcaagtccagccagagtctttgtcagctcaagatatgagtcgtagcttggtaccagcagaaancacgacacgtcccctaagttgctctatttatggtcatctacgtcgggtgtccccggggtccctgacccgtattcgaagcggcagcgggatcgtgggacagtactttcactctacaccatcaagcagcctgcagactgaaggatgtgctagtttatactgtacagtactaattattatggtacgttcccgtcggttcttaccgtaacgtttccggggcgggttaacggggtaacccgtaaggggttcggaacggattaccgaaaggttaaccgtaaacgg

SEQ ID NO: 299521 - DNA, 516 bp, Homo sapiens
  misc_feature: GZ8MTXP01AXQ3Q.38.23.C01.1.454.CMB.2.raw
tcagtcgatcacgtcacgaccggtgctcgatttagtacacgtgattagggattggggacaacaggcaggcagggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagagtctttgtcagctccaagatatgagttcgtagcttggtaccagcagaaagcacgacagtcccctaagtgctcatttatggtcatctactcgggtgtccggggtccctgaccgattcgagcggcaggcggatcgtgggacagtattcactctcaccatcagcacgcctgcagactagaagatgggtggctagtttatactgtcagcaattattatggtatcctcggctcgacgtttcgggcggttacgggccaaagggtcggagcgttacgaaggttcgtaacgttggtaacgg

SEQ ID NO: 299522 - DNA, 541 bp, Homo sapiens
  misc_feature: GZ8MTXP01D9PR1.38.23.C01.1.454.CMB.2.raw
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagagttcttttgtcagctccaaagaatatgagttcgttagcttggtaccagcagaaagcacgacacgtcccctaagttgctctatttattggtctatctacgtcgggtcgtccggggtcctgaccgattcagcgcagcggatcgtgggacagtattcactctcaccatcagcagcctgcagactgaaagtatgggtgtctaagttttactactgtcagtactaattattagtggtagtcctcggcttcgttacgtttcgggcgggttaacggggccgttaagggtggaagtaacgtcgaaggcgtaacgttggtaacggg

SEQ ID NO: 299523 - DNA, 530 bp, Homo sapiens
  misc_feature: GZ8MTXP01CXP4I.38.23.C01.1.454.CMB.2.raw
  modified_base (449)..(449): a, c, t, g, unknown or other
  misc_feature (449)..(449): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctctgggcgagaggccaccatcaactgacaagtccagccagagttcttttgtcagctaccaaagaatatgagttcgttagcttggtaccagcaagaaagcaacgacagtcccctaagttcgctcatttatggtcatctacgtcggtcgtcccggggtcctgaccgtattcgagcgcagcgatcgtgggacagtatttcactctcacatcagcacgcctgacagactagaagtatggggtagtctagtttatactgtacagactaatnttatggtatcctggttctcgttacgtttcggcgggttacggccgaagggtgagtaagtacgaaggacgtaacgttggtcgg

SEQ ID NO: 299524 - DNA, 547 bp, Homo sapiens
  misc_feature: GZ8MTXP01DU653.38.23.C01.1.454.CMB.2.raw
  modified_base (515)..(515): a, c, t, g, unknown or other
  misc_feature (515)..(515): n is a, c, g, or t
  modified_base (518)..(518): a, c, t, g, unknown or other
  misc_feature (518)..(518): n is a, c, g, or t
  modified_base (545)..(545): a, c, t, g, unknown or other
  misc_feature (545)..(545): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcgtggtttcctgtagctatttagaaggtgtcagtgtgaggtgcagttggtggaatcgtgggggaaacttggtccagccgtggggggtccctgagctctcctgtgcagcctctggattcatattagtaatcaattggatggagttgggtccgcaggctccgaggggacgggggctgggaggtggggtcggccaactaataaaccacgaactagggaaactagaaaaagctaaagtgtgggactgtgtaggaaacgggccgaattcaccgttcaccagacgaacaacgaccaaagaattcatgtattgacaaatgaacagcctagagagacgaaagcacggccaatataattattgtagttaaagntanattgataagtggtgcgagttagggtgntg

SEQ ID NO: 299525 - DNA, 572 bp, Homo sapiens
  misc_feature: GZ8MTXP01CRJZG.38.23.C01.1.454.CMB.2.raw
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctcgtgggcgagagggccaccatcaactgacaagtccagccagagttctttgtcagctaccaagaatatgtagttcgttagcttggtaccagcaagaaagcacgacacgtcccctaagtcgctctatttatggtcatcgtacgtcgggtcgtccggggtcctggaccgtatcgaggcgacagcggatcgtgggacagtactttcactctcacatcagcacgcctgacagactaggaagtagtcggggtggtacttaagttttacttactgtacagtactaaattattaagtcggttagtcccgtcggcttcgttacggtttcgggcgggttaacgggaccgttaagggtcggaagtaacgtacgaacggttacgtaacgttgggtaacgg

SEQ ID NO: 299526 - DNA, 508 bp, Homo sapiens
  misc_feature: GZ8MTXP01APTCC.38.23.C01.1.454.CMB.2.raw
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctctgggcgagaggccaccatcaactgcaagtccagccagagtcttttgtcagctccaagaatatgagttcgttagcttggtaccagcagaaagcacgacagtcccctaagttgctcatttatggtcatctactcgggtgtccggggtccctgaccgattcgagcggcagcggatcgtgggacagatttcactctcacatcagcagcctgcagactgaagatgggtgctagtttattactgtcagacaatattatggtagtcctcggctcgacgtttcgggcggttacgggaccaagggtggagaatcgaagcgtaacgttgtcgg

SEQ ID NO: 299527 - DNA, 515 bp, Homo sapiens
  misc_feature: GZ8MTXP01BB94G.38.23.C01.1.454.CMB.2.raw
  modified_base (404)..(404): a, c, t, g, unknown or other
  misc_feature (404)..(404): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctctgggcgagaggccaccatcaactgcaagtccagccagagtctttgtcagctccaagatatgagttcgtagcttggtaccagcagaaagcacgacagtcccctaagttgctctatttattggtcatctactcgggtgtcccggggtcctgaccgtattcgagcggcagcggatcgtgggacagatttcactctcaccatcagcagcctgcagactgaagntgggtggctagtttatacgtgtcagactaatattagtggtagtcctcggttctcgacgtttcgggcggagggccaagggtggagtaatacgagacgtaacgttggtaacgg

SEQ ID NO: 299528 - DNA, 554 bp, Homo sapiens
  misc_feature: GZ8MTXP01D7FGR.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagccgtggggggtccctgagctctcctgtgcagcctctggattcatattagtaatcattggatgagttgggtccgccaggctccgaggggacgggggctgggagtggggtcggccactataaaccacgatggaaactgaaaaagctaaatgtggactcgtggtagaaggggccattcaccgtctccagagacaacgaccaaagaattcactgtatttgacaaagtagaacagcctagagagtacgaagacacggccaagtataattattgtattaaaagatcttagttcgataagtggtggcggacgggttacgggtggcgttaag

SEQ ID NO: 299529 - DNA, 535 bp, Homo sapiens
  misc_feature: GZ8MTXP01DQDBS.38.23.C01.1.454.CMB.2.raw
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagagtcttttgttcagctccaaagaatatgagttcgtagcttggtaccagcaagaaagcacgacagtcccctaagttgctctatttattgtcatctactcgggtgtccggggtcctgaccgattcgagcggcagcggatcgtgggacagtatttcactctcaccatcagcagcctgcagactagaagatggggtggtactagttttatacgtgtcagtactaaattattagttggtagtcctcggcttccgacgtttcgggcgggttaacgggaccgaagggtcggaagtaactcgaaagcgtaacgttggtgg

SEQ ID NO: 299530 - DNA, 489 bp, Homo sapiens
  misc_feature: GZ8MTXP01DKABQ.38.23.C01.1.454.CMB.2.raw
  modified_base (400)..(400): a, c, t, g, unknown or other
  misc_feature (400)..(400): n is a, c, g, or t
  modified_base (417)..(417): a, c, t, g, unknown or other
  misc_feature (417)..(417): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctctgggcgagaggccaccatcaactgcaagtccagccagagtctttgtcagctccaagaatatgagttctagcttggtaccagcagaaagcacgacagtcccctaagtgctcatttatgtcatctactcggtgtccgggtcctgaccgattcagcgcagcggatcgtgggacagtattcactctcaccatcagcagcctgcagactgagatggtggntaagtttatactgtcanatatatatgtagtctcgctcttacgttcggtcggacggaccgaggtaagagaagtagagacgaacgttgtgg

SEQ ID NO: 299531 - DNA, 552 bp, Homo sapiens
  misc_feature: GZ8MTXP01BB658.38.23.C01.1.454.CMB.2.raw
  modified_base (449)..(449): a, c, t, g, unknown or other
  misc_feature (449)..(449): n is a, c, g, or t
  modified_base (502)..(502): a, c, t, g, unknown or other
  misc_feature (502)..(502): n is a, c, g, or t
  modified_base (542)..(542): a, c, t, g, unknown or other
  misc_feature (542)..(542): n is a, c, g, or t
tcagtcgatcacgtcacgaccggtgctcgatttagtacacgtgattagggattgggggtctcagagaggagccttagccctggactccaaggcctttgcacttggtgatcagcactgaacacagaggactcaccatggaattggggctgagctgggttttccttgttgctattttagaaggtgtccagtgtgaggtgcagttggtggaatctgggggaaacttggtccagcctgggggtccctgaagctctcctgtgcagcctctggattcatattagtaatcattggatgagttgggtccgccaggctccaggggacggggctgggagtgggtggccactataaaccacgatggaactagaaaagactatgtggaactctgtgaagggccgattcaccgtctccagagacaacgccaaagaattcactgtatttgacaaatggaaacngcctagagagtcgaagacacggccaatataattaattagttagtaaaaagttntactattcgattagtgggtggaacggtacgggtacggggngtcgttgttg

SEQ ID NO: 299532 - DNA, 532 bp, Homo sapiens
  misc_feature: GZ8MTXP01EIQCL.38.23.C01.1.454.CMB.2.raw
  modified_base (436)..(436): a, c, t, g, unknown or other
  misc_feature (436)..(436): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctcgtgggcgagaggccaccatcaactgcaagtccagccagtagttctttgtcagctacaagaatatgtagtcgtagcttggtaccagcaagaaagcacgacacgtcccctaagtgctctatttattggtcattctacgtcgggtcgtccccgggtccctgaccgtatcgaacgcggcgagcggatcgtgggacagtactttcactctcacatcaagcagcctgacagactgaagatgtagctagtttntactgtacagtactaatatagtggtacgttccgtcggttctcgtacgtttcgggcgggttaacgggaacagggtggagagttacgtaacgcgtaag

SEQ ID NO: 299533 - DNA, 512 bp, Homo sapiens
  misc_feature: GZ8MTXP01EAS50.38.23.C01.1.454.CMB.2.raw
  modified_base (207)..(207): a, c, t, g, unknown or other
  misc_feature (207)..(207): n is a, c, g, or t
  modified_base (252)..(252): a, c, t, g, unknown or other
  misc_feature (252)..(252): n is a, c, g, or t
  modified_base (256)..(256): a, c, t, g, unknown or other
  misc_feature (256)..(256): n is a, c, g, or t
  modified_base (262)..(262): a, c, t, g, unknown or other
  misc_feature (262)..(262): n is a, c, g, or t
  modified_base (303)..(303): a, c, t, g, unknown or other
  misc_feature (303)..(303): n is a, c, g, or t
  modified_base (306)..(306): a, c, t, g, unknown or other
  misc_feature (306)..(306): n is a, c, g, or t
  modified_base (311)..(311): a, c, t, g, unknown or other
  misc_feature (311)..(311): n is a, c, g, or t
  modified_base (316)..(316): a, c, t, g, unknown or other
  misc_feature (316)..(316): n is a, c, g, or t
  modified_base (376)..(376): a, c, t, g, unknown or other
  misc_feature (376)..(376): n is a, c, g, or t
  modified_base (403)..(403): a, c, t, g, unknown or other
  misc_feature (403)..(403): n is a, c, g, or t
  modified_base (409)..(409): a, c, t, g, unknown or other
  misc_feature (409)..(409): n is a, c, g, or t
  modified_base (411)..(411): a, c, t, g, unknown or other
  misc_feature (411)..(411): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcgtggtttcgtgtaggctatttagaaggtgtcagtgtgaggtgcagtggtggaatntggggaaacgtgtcgagcgtgggggtccgtgagctctcctgtgcngctntgtatntatattatatatatgtagtgtgtcggtcgcgcgcgcgaggnggngtggngtggngacactacaacacgacgagaagaagaaagataatgtgagtgtgagaggacgactcactcncagagacacacatatacatatatatanaagtananacgacgagagagacgaacgacgtacgactatataattagttagtaagttaaagtaatattagttgttagtaagtggtggcggtacggttacggtcgttgtg

SEQ ID NO: 299534 - DNA, 525 bp, Homo sapiens
  misc_feature: GZ8MTXP01CS3BA.38.23.C01.1.454.CMB.2.raw
  modified_base (345)..(345): a, c, t, g, unknown or other
  misc_feature (345)..(345): n is a, c, g, or t
  modified_base (437)..(437): a, c, t, g, unknown or other
  misc_feature (437)..(437): n is a, c, g, or t
  modified_base (491)..(491): a, c, t, g, unknown or other
  misc_feature (491)..(491): n is a, c, g, or t
  modified_base (521)..(521): a, c, t, g, unknown or other
  misc_feature (521)..(521): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggtttccttgttgctattttagaaggtgtccagtgtgaggtgcagttggtggaatctgggggaaacttggtccagcctgggggtccctgagctctcctgtgcagcctctggattcatatttagtaatcattggatgagttggtccgcaggctccagggacggggctggaggtgggtggccacgtataaacncgaatggaaactgaaaaagctaaatgtggactctgtgaagggcattcaccgtctccagagacaacgccaaagatcactgtatttgacaaatnaaacagcctagagagtcgaaagcacggccatataattaattgtagttaaagatnattgataatggtggcgaggttacgggtggntaag

SEQ ID NO: 299535 - DNA, 486 bp, Homo sapiens
  misc_feature: GZ8MTXP01AS9BD.38.23.C01.1.454.CMB.2.raw
  modified_base (321)..(321): a, c, t, g, unknown or other
  misc_feature (321)..(321): n is a, c, g, or t
  modified_base (398)..(398): a, c, t, g, unknown or other
  misc_feature (398)..(398): n is a, c, g, or t
  modified_base (423)..(423): a, c, t, g, unknown or other
  misc_feature (423)..(423): n is a, c, g, or t
  modified_base (472)..(472): a, c, t, g, unknown or other
  misc_feature (472)..(472): n is a, c, g, or t
  modified_base (483)..(483): a, c, t, g, unknown or other
  misc_feature (483)..(483): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctctgggcgagaggccaccatcaactgcaagtccagccagagtctttgtcagctccaaagaatatgagttctagcttggtaccagcagaaagcacgacagtcccctaagttgctcatttattggtcatctactcgggtntccggggtcctgaccgattcagcgcagcggatcgtgggacagatttcactctcacatcagcagcctgcagactgaanatggtggcagtttatactgtcaganatatatgtagtctcgctcacttcgtcggaggacgagtaaggaggaaganagacgtaacgngtg

SEQ ID NO: 299536 - DNA, 523 bp, Homo sapiens
  misc_feature: GZ8MTXP01E28O8.38.23.C01.1.454.CMB.2.raw
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctcgtgggcgagagggccaccatcaactgcaaagtccagccagagtcttttgtcagctcaagaatatgagtcgtagcttggtaccagcagaaagcacgacagtcccctaagtgctctatttatggtcatctacgtcgggtcgtccccggggtcctgaccgattcaagcgcagcggatcgtgggacagtattcactctcaccatcagcagcctgcagactagaaggatggtggctaagtttatactgtacagtactaaatattaagtggtaacgttcctcggctacgtacgtttcgggcgggagggaaccaagggtggaagattacaaggccgtaag

SEQ ID NO: 299537 - DNA, 578 bp, Homo sapiens
  misc_feature: GZ8MTXP01D5V9W.38.23.C01.1.454.CMB.2.raw
  modified_base (528)..(528): a, c, t, g, unknown or other
  misc_feature (528)..(528): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcttgggttttccttgttgcttattttagaaggtgtccagtgtgaggtgctaggttggtggaatcgtagggggaaacttggtccagccgtgggggtccctgagctctcctgtgcagcctctggattcatattagtaatcattggatgagttggtccgcaggctccgaggggacgggctggagtgggtcgccactaataaaccacgataggaaactagaaaagactaatgtggactcgtggtagaacgggccattccaccgtctacagacgacaacgaccaaagtaattcacttgtatttagactaaagtagaaacacgacctagaagagtacgaaacgacaccggaccaatataatttattagtaagttaaaagatanaagtttcgaattgtagggttcggacggtacgggttacgggtggctttaag

SEQ ID NO: 299538 - DNA, 515 bp, Homo sapiens
  misc_feature: GZ8MTXP01B5LP2.38.23.C01.1.454.CMB.2.raw
  modified_base (340)..(340): a, c, t, g, unknown or other
  misc_feature (340)..(340): n is a, c, g, or t
  modified_base (345)..(345): a, c, t, g, unknown or other
  misc_feature (345)..(345): n is a, c, g, or t
  modified_base (482)..(482): a, c, t, g, unknown or other
  misc_feature (482)..(482): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagagtcttttgtcagctccaagaatatgagtcgtagcttggtaccaacagaaagcacgacagtcccctaagttgctcatttattggtcatctactcgggtgtccggggtccccngacgnttcagcgcaagcggatcgtgggacagtatttcactctcacatcagcagcctgcagactagaagagtgtggctagtttatacgtgtcagctaattattaatggtaacgtccgttcggcttcgtacgtttcggacgggnggaccgaaggtggaagtatcaagtcgaacgtgg

SEQ ID NO: 299539 - DNA, 535 bp, Homo sapiens
  misc_feature: GZ8MTXP01D4A4D.38.23.C01.1.454.CMB.2.raw
  modified_base (301)..(301): a, c, t, g, unknown or other
  misc_feature (301)..(301): n is a, c, g, or t
  modified_base (456)..(456): a, c, t, g, unknown or other
  misc_feature (456)..(456): n is a, c, g, or t
  modified_base (499)..(499): a, c, t, g, unknown or other
  misc_feature (499)..(499): n is a, c, g, or t
  modified_base (531)..(531): a, c, t, g, unknown or other
  misc_feature (531)..(531): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcgtggtttcctgttgctatttagaaggtgtccagtgtgaggtgcagttggtggaatctgggggaaacttggtccagcctggggggtccctgaagctctcctgtgcagcctctggattcatattagtaatcattggatgtagttgggtccnccgaggctccgaggggacggggctggagtgggtggccactaataaaccacgatggaaactagaaaaagctaatgtggactctgtagaagggcgattcacgtctcagagacaacgaccaagaattcactagtattagacaatagaacagcctgagngtacgaaagacacggaccataataattattgtagttaaagatnttattgataagtggtgcgacggttagggtggntaag

SEQ ID NO: 299540 - DNA, 535 bp, Homo sapiens
  misc_feature: GZ8MTXP01D02DN.38.23.C01.1.454.CMB.2.raw
  modified_base (414)..(414): a, c, t, g, unknown or other
  misc_feature (414)..(414): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctcgtgggcgagagggccaccatcaactgacaagtccagccagtagttcttttgtcagctacaagaatatgagtcgtagcttggaccagcaagaaagcaacgacacgtcccctaagttgctctatttatggtcatctacgtcggggtcgtcccccggggtcctgaccgtatcgaagcggcagcgggatcgtggggacagtactttcactctacaccatcagcagccngcagactgaagtagtgtgactagtttatactgtacagtactaatattagtggttagttcctcggactcgtacgtttcgggcggacgggaaccgaagggtgaaggattacgaagttcgaacg

SEQ ID NO: 299541 - DNA, 564 bp, Homo sapiens
  misc_feature: GZ8MTXP01CZBGZ.38.23.C01.1.454.CMB.2.raw
  modified_base (404)..(404): a, c, t, g, unknown or other
  misc_feature (404)..(404): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagacctccctggctgtgtctcgtgggcgagacgggccaccatcaactgcaagtccagccagagttcttttgtcagctacaaagatatgagttcgttagcttggtaccagacaagaaagcacgacacgtcccctaagtgctctatttatggtcatctacgtcgggtcgtcccggggtcctggacccgtattcgaggcggcaaggcggatcgtagggacagtacttcactctcaccatcancacgcctgcagactagaagtatggggtcggtacttaagtttacttacgtgtcaagtactaattagttagtcggttacgtccgtcggcttcgttacggtttcgggacggttacgggacgttaagggtggagtaacgtacgaacgacgtaacgttggtaacg

SEQ ID NO: 299542 - DNA, 539 bp, Homo sapiens
  misc_feature: GZ8MTXP01AHFXU.38.23.C01.1.454.CMB.2.raw
  modified_base (424)..(424): a, c, t, g, unknown or other
  misc_feature (424)..(424): n is a, c, g, or t
  modified_base (436)..(436): a, c, t, g, unknown or other
  misc_feature (436)..(436): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctctgggcgagaaggccaccatcaactgcaagtccagccagagtctttgtcagctccaagaatatgagtcgtagcttggtaccagcagaaacgcacgacacgtcccctaagttgctctattttattggtcattctacgtcggggtgtcccccggggtccctgacccgtattcaagcggcaggcggatcgtggggacagtactttcactctcacatcagcagcctgcagactgaaggntggtgctagttnttactgtacagtactaatattatggtaacgttccgtcggcttccgtaacgttttcgggcgggttaacgggaaccaagggtggagagttacgtaaggcgtaacg

SEQ ID NO: 299543 - DNA, 569 bp, Homo sapiens
  misc_feature: GZ8MTXP01C8P13.38.23.C01.1.454.CMB.2.raw
  modified_base (415)..(415): a, c, t, g, unknown or other
  misc_feature (415)..(415): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctcgtgggcgaggagggccaccatcaactgcaagtccagccagagttcttttgtcagctaccaaagatatgagttcgtagcttaggtaccagacaagaaagcacgacacgtcccctaagttgctctatttatggtactatctacgttcgggtcgtccggggtccctcgaccgtattcgagcggacagcggatcgtagggacagtactttcactctcacatcagcaacgcctanacgacgtgaagagttcggtaggggttcggttttaattacctgtactagctagttattagttcgttactcctctaacgttacggttttcggaccgaacgggggtacccaaggcgttagggacgtaagtacgaacgaacgacgttgtcggctaacg

SEQ ID NO: 299544 - DNA, 554 bp, Homo sapiens
  misc_feature: GZ8MTXP01AEPJW.38.23.C01.1.454.CMB.2.raw
  modified_base (266)..(266): a, c, t, g, unknown or other
  misc_feature (266)..(266): n is a, c, g, or t
  modified_base (275)..(275): a, c, t, g, unknown or other
  misc_feature (275)..(275): n is a, c, g, or t
  modified_base (277)..(277): a, c, t, g, unknown or other
  misc_feature (277)..(277): n is a, c, g, or t
  modified_base (288)..(288): a, c, t, g, unknown or other
  misc_feature (288)..(288): n is a, c, g, or t
  modified_base (294)..(294): a, c, t, g, unknown or other
  misc_feature (294)..(294): n is a, c, g, or t
  modified_base (322)..(322): a, c, t, g, unknown or other
  misc_feature (322)..(322): n is a, c, g, or t
  modified_base (438)..(438): a, c, t, g, unknown or other
  misc_feature (438)..(438): n is a, c, g, or t
tcagtcgatcacgtcacgaccggtgctcgatttagtacacgtgattagggagttgggggtctcagagaggagccttagccctggactccaaggcctttgcacttggtgatcagcactgagcacagaggactcaccatggaattggggctgagcgtggtttcgtgttaggctatttagaaggtgtccagtgtgaggtgcgaggttggtggaatcgtgggggaaaccttgggtcccgagccgtgggggtccctgagctctcctgtgcnctctctgtntntatattatatntagtgngtgtggtcggcgcgcgcgcgacggcggnggtggtggtggtgcgactacaacagacgtagagtaagaaatataatgtgtacgtgtgtaggaggcgtactctacgtcgtcgagacgacgacgacgaactactactatatattatanaagtagaagagacgtagagagacgaacgacgtacgactatataattagttagtaagttaagtagtattagttgttagtaagtggtcggtacggtacgggttacgggtcggttcgtg

SEQ ID NO: 299545 - DNA, 528 bp, Homo sapiens
  misc_feature: GZ8MTXP01DTIWG.38.23.C01.1.454.CMB.2.raw
  modified_base (416)..(416): a, c, t, g, unknown or other
  misc_feature (416)..(416): n is a, c, g, or t
  modified_base (507)..(507): a, c, t, g, unknown or other
  misc_feature (507)..(507): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctctgggcgagaggccaccatcaactgcaagtccagccagtagttcttttgtcagctaccaaagaatatgtagttcgttagcttggtaccagcaagaaagccacgacagtcccctaagttgctactatttatggtcatctacgtcgggtgtcccggggtcctgaccgtatcgagcggacagcggatcgtgggactagtatttcactctcacatcagcagcctgcagactgaagntgggtgtactagtttatactgtcagtactaattattatggtactctcggcttcgttacgtttcgggcggttacggaccgaagggtggagtntacgagacgtaacgttggtcg

SEQ ID NO: 299546 - DNA, 558 bp, Homo sapiens
  misc_feature: GZ8MTXP01EYX3A.38.23.C01.1.454.CMB.2.raw
  modified_base (280)..(280): a, c, t, g, unknown or other
  misc_feature (280)..(280): n is a, c, g, or t
  modified_base (299)..(299): a, c, t, g, unknown or other
  misc_feature (299)..(299): n is a, c, g, or t
  modified_base (396)..(396): a, c, t, g, unknown or other
  misc_feature (396)..(396): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggatgtgtctctgggcgagaggccaccatcaactgcaagtccagccagtagtcttttgtcagctaccaaagaatatgagttcgttagcttggtaccagcaagaaancacgacacgtccctaagtnctctatttattgtcattctacgttcgggtgtcccggggtcctagaccgtattcgagccggacagcggatcgtgggactagtacttcactctcacctncagcagcctgcagactagaagtagtgggtaggtacttaagtttacttacgtgtaccaagtactaaagttattagtcggtatccgtcggcttcgttacgtttcgggacgggttaacgggaccgaagggttcgggagtaagtacgaagacgtaacgttcggtgg

SEQ ID NO: 299547 - DNA, 566 bp, Homo sapiens
  misc_feature: GZ8MTXP01D1U8Y.38.23.C01.1.454.CMB.2.raw
  modified_base (312)..(312): a, c, t, g, unknown or other
  misc_feature (312)..(312): n is a, c, g, or t
  modified_base (374)..(374): a, c, t, g, unknown or other
  misc_feature (374)..(374): n is a, c, g, or t
  modified_base (403)..(403): a, c, t, g, unknown or other
  misc_feature (403)..(403): n is a, c, g, or t
  modified_base (407)..(407): a, c, t, g, unknown or other
  misc_feature (407)..(407): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagccgtacggggacatcgtgatcgacccagtctccagacctccctggctgtgtctcgtgggcgagacggccacatcaactgacaagtccagccagtagttcttttgtcagctacaaagaatatgtagtcgtagcttggaaccagacaagaacgcaacgacacgtaccctaagtcncttacttatttatgtctattcgtacgtcgggtcgtccccgggtcctagacgtatcgaagcgngagcgatcgagggactagtacttcactcncacntcagtcacgcctgaccaagtacgtagaaggtagtggtcgtacttaagtttactacgtgtacagtactaagttattagtggttaccttccgtcggttcttacgtacggttccgggcggaacgggtaacgtagggtgacgagttacgaacgttcgtaacgg

SEQ ID NO: 299548 - DNA, 574 bp, Homo sapiens
  misc_feature: GZ8MTXP01EHCJT.38.23.C01.1.454.CMB.2.raw
  modified_base (395)..(395): a, c, t, g, unknown or other
  misc_feature (395)..(395): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctcgtgggcgagaggccaccatcaactgacaagtccagccagtagttcttttgtcagctaccaaagatatgagttcgtagcttggtaccagacagaaagcacgacacgtcccctaagttcgctctatttagtggtctatcgtacgtcgggtcgtcccggggtcctgaccgattcgacgtcggacagcggatcgtgggactagtacttcactcncacatcagcagcctgcagactagaagtagttggggtacggtcttaaggttttactacgtgtacgaagtactaaattaagttagtgggttaaccgtccgttcgggttcttaccgttacgtttcgggcggttaagggaccttaagggtggagtaagtaccgaaggcgtaacgttggtaacg

SEQ ID NO: 299549 - DNA, 567 bp, Homo sapiens
  misc_feature: GZ8MTXP01A5ZQ2.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggtttccttgttgctattttagaaggtgtccagtgtgaggtgcagttggtggaatcgtgggggaaacttggtccagccgtgggggtccctgagctctcctgtgcagcctctggattcatattagtaatcattggatgagttggtccgcaggctccgaggggacggggctgggagtgggtggccactataaaccacgatgggaaactaggaaaaagctaatggtggactctggtagaagggcccgattccaccgtctaccagacgaacaacgaccaaagtaactcactagttatttagacaaagtggaaacagacctagagagtacgaaagacacggacctaatataattattgtaagttaaagtatcattcgattaagtgggttcggacggtacggttacgggtggcttaagg

SEQ ID NO: 299550 - DNA, 548 bp, Homo sapiens
  misc_feature: GZ8MTXP01A1549.38.23.C01.1.454.CMB.2.raw
  modified_base (283)..(283): a, c, t, g, unknown or other
  misc_feature (283)..(283): n is a, c, g, or t
  modified_base (362)..(362): a, c, t, g, unknown or other
  misc_feature (362)..(362): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagtagtcttttgtcagctaccaagaatatgtattcgtagcttggtaccagcagaaancacgacagtcccctaagtgctctatttattggtcattctacgtcgggtcgtcccccggggtcctgaccgatcaagcggnagcgatcgtgggacagtacttcactctacaccatcagcacgcctgcaagactagaaggtatggtgacgttagtttattacgtgtacaagtactaaattattagtggttacgttccgtacggttcttcgtacgtttcgggcgggttacgggtaacgagggtggagtacgttacgaacgttcgtaacg

SEQ ID NO: 299551 - DNA, 544 bp, Homo sapiens
  misc_feature: GZ8MTXP01AFY8U.38.23.C01.1.454.CMB.2.raw
  modified_base (372)..(372): a, c, t, g, unknown or other
  misc_feature (372)..(372): n is a, c, g, or t
  modified_base (518)..(518): a, c, t, g, unknown or other
  misc_feature (518)..(518): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtggggggtccctgaagctctcctgtgcagcctctggattcatatttagtaatcattggatgagttgggtccgcaggctccgagggacgggctggagtgggtgccactataaaccacgatggaactagaaaaagctaangtgactctgtagaagggcattccaccgtctccagagacaacgccaagaatcactgtatttagacaaagtgaaacagacctagagagtacgaaagacacgggaccatataattattgtagttaaaagatacttattcgataagtggnggtcgacggttacgggtggcgttaag

SEQ ID NO: 299552 - DNA, 539 bp, Homo sapiens
  misc_feature: GZ8MTXP01C7VRI.38.23.C01.1.454.CMB.2.raw
  modified_base (464)..(464): a, c, t, g, unknown or other
  misc_feature (464)..(464): n is a, c, g, or t
  modified_base (503)..(503): a, c, t, g, unknown or other
  misc_feature (503)..(503): n is a, c, g, or t
  modified_base (533)..(533): a, c, t, g, unknown or other
  misc_feature (533)..(533): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcgtggtttctgtgctatttagaaggtgtcagtgtgaggtgcagttggtggaatcgtgggggaaacttggtccagccgtggggggtccctgaagctctcctgtgcagcctctggattcatatttagtaatcattggatgagttgggtccgcaggctccgagggggacggggctgggagtgggtggccactaataaaccacgatggaactagaaaaagctaaatgtggactcgtgtgaagggccgattcaccgtctccagacgacaaacgccaaagaacttcactgtatttagacaaatgaaacagcctgagagngaaagacacggcaatataattagttgtaagttaaagatnaattgataagtggtggcgaggttaggtggngttaag

SEQ ID NO: 299553 - DNA, 508 bp, Homo sapiens
  misc_feature: GZ8MTXP01B2B3F.38.23.C01.1.454.CMB.2.raw
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagagtcttttgtcagctccaaagaatatgagttcgttagcttggtaccagcagaaagcacgacagtcccctaagtgctcatttattggtcatctactcgggtgtccggggtcctcgaccgattcagcggcagcgatccgtgggacagtatttcactctcaccatcagcagcctgcagactagaagatggggtgctagtttattactgtcagtacaatattatggtatcctcggttctcacgtttcggcggagggccaagggtgaggaatcgagcgtaacgttggtgg

SEQ ID NO: 299554 - DNA, 548 bp, Homo sapiens
  misc_feature: GZ8MTXP01EMBYH.38.23.C01.1.454.CMB.2.raw
  modified_base (376)..(376): a, c, t, g, unknown or other
  misc_feature (376)..(376): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctcgtgggcgagagggccaccatcaactgcaagtccagccagagttctttgtcagctcaagaatatgagtctagcttggaccagcagaaagcaacgacacgtcccctaagttcgactctattttattggtacattctacgtcgggtcgtcccccggggtcctgaccgtattcgaagcggcagcgatcgngggacagtatttcactctcaccatcagcagcctgcagactagaaggtagtggtcggacttaagtttacttacgttgtacagtactaaattagtttaatggttacttccgtcggcttacgtacgtttcgggcggaacggtaaccgagggtcggagtagttccgaaggcgtaag

SEQ ID NO: 299555 - DNA, 560 bp, Homo sapiens
  misc_feature: GZ8MTXP01ASQHH.38.23.C01.1.454.CMB.2.raw
  modified_base (303)..(303): a, c, t, g, unknown or other
  misc_feature (303)..(303): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtgggggtccctgaagctctcctgtgcagcctctggattcatatttagaatcattggatgagttggtccncaggctccgagggacggggctgggagtgggtggccactataaaccacgatagggaaactagaaaaagctaatgtggactcgtgtaggaagggccgattccaccgtctacagagacaacgaccaagaattcactgtacttagacaaagtgaaacagcctagagagtacgaagacacggacatataattattagtagttaaaagtatattaattcgaattaaggtgggttggacggtaagggttacgggtgggcttaag

SEQ ID NO: 299556 - DNA, 644 bp, Homo sapiens
  misc_feature: GZ8MTXP01CEK69.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctatttagaaggtgtccagtgtgaggtgcagttggtggaatcgtgggggaaacttggtccagccgtgggggtccctgagctctcctgtgcagcctctggattcatatttagtaatctaattggatgagttgggtccgccgaggctccgaggggacggggctgggaggtggggtcggaccaactaataaaccgacgaagtagggaaactaaggaaaaaagacttaaagtggtgggacttcgtaggtacggaaacggggtcccgtaaattccaacccgttctacccgaaggacgaaaccaaacggacccaaaaggtaacttaccaaccgttagttaattttaggaacctaaaagttacggaaacacgacccgtagaagacgtaccgaaagacctaacggacctaataataatttaattagtaagaaaagtatacttagttgattaagtgggtggacgtacggttacgggtgcgttaag

SEQ ID NO: 299557 - DNA, 558 bp, Homo sapiens
  misc_feature: GZ8MTXP01B1TL2.38.23.C01.1.454.CMB.2.raw
  modified_base (381)..(381): a, c, t, g, unknown or other
  misc_feature (381)..(381): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagcctgggggtccctgagctctcctgtgcagcctctggattcatatttagtaatcattggatgagttgggtccgcaggctccgagggacggggctggagtgggtggccactataaaccacgatggaactagaaaaagctaatgtggactctgngaagggccgattcaccgtctccagagacaacgaccaaagacttcactgtatttgacaaagtgaacagcctagagagtcgaagacgacggaccaattataatttaattgtaagttaaaagtatacttagttcgattaagttagggtggtacggtaacggttacggggttgggcttaag

SEQ ID NO: 299558 - DNA, 537 bp, Homo sapiens
  misc_feature: GZ8MTXP01DGNNB.38.23.C01.1.454.CMB.2.raw
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagagttcttttgtcagctaccaaagaatatgagttcgttagcttggtaccagcagaaagcagacagtcccctaagtgctctatttatggtcatctacgtcgggtcgtccggggtccctgaccgtattcgagcggcagcggatcgtgggacagtactttcactctcacatcagcagcctgcagactgaagatgggtgactagtttatactgtcagtactaagttattagtggtatccgtcggttcttcgttacgtttcgggcgggttaacgggccgttaaagggtggaagaacgtacgaaggcgtaacgttggtcgg

SEQ ID NO: 299559 - DNA, 540 bp, Homo sapiens
  misc_feature: GZ8MTXP01DOQJ4.38.23.C01.1.454.CMB.2.raw
  modified_base (505)..(505): a, c, t, g, unknown or other
  misc_feature (505)..(505): n is a, c, g, or t
tcagtcgatcacgtcacgaccggtgctcgatttagtacacgtgattagggattgggggtctcagagaggagccttagccctggactacaaggcctttgcacttggtgatcagcactgagcacagaggactcaccatggaattggggctgagctgggttttccttgttgctattttagaaggtgtccagtgtgaggtgcagttggtggaatctgggggaaacttggtccagccgtgggggtccctgagctctcctgtgcagcctctggattcatatttagtaatcattggatgagttgggtccgccaggctcgaggggacggggctggagtgggtggccactataaaccacgatggaaacagaaaagctaatgtggactctgtaggaacgggccgaattccaccgtctaccagacgacaacgaccaagaattcactagtatttagacaaagtagaacagcctagagagtacgaagacacggacatataattattgtagaaagtatnattcgatgtaggtggcgaggttcgggtgcgttaag

SEQ ID NO: 299560 - DNA, 665 bp, Homo sapiens
  misc_feature: GZ8MTXP01E5VIE.38.23.C01.1.454.CMB.2.raw
  modified_base (255)..(255): a, c, t, g, unknown or other
  misc_feature (255)..(255): n is a, c, g, or t
  modified_base (259)..(259): a, c, t, g, unknown or other
  misc_feature (259)..(259): n is a, c, g, or t
  modified_base (264)..(264): a, c, t, g, unknown or other
  misc_feature (264)..(264): n is a, c, g, or t
  modified_base (275)..(275): a, c, t, g, unknown or other
  misc_feature (275)..(275): n is a, c, g, or t
tcagtcgatcacgtcacgaccggtgctcgatttagtacacgtgattagggattggggtctcagagaggagccttagccctggactccaaggcctttgcacttggtgatcagcactgagcacagaggactcaccatggaattggggctgagcgtggtttcgtgttaggctatttagaaggtgtccagtgtgagtgcagtggtggaatctggggaaacgttgtcagccgtgggggtcccgtgaagctctcctgtgcngctntgatntatattatatntagtgagtgtagtggtccgcgacgcgtcgacgggacgggcgtggtaggtggtacggaccgaactaacgtaaaccgaacgacgtaggaaagtaagaaaagtaacgtaagtagtcgtacgtcgtagtaggaacgggtaccgtacttacctacccgtaccgtaccgaacgaacgaaccgaaaccgaaccgaaacgtaacttactaacgttagttaagttacgtaactaaacgtaacgtaacgtacgtacgtacgaagaacgtaacgaaacgaaccgtaaccgtaaccgtaacttaaattaatttaagttaagttaaagttaaaagtaaacgtacttacgttacgttagtaagtagggtcgggtacggtacgggttacgggtcggttcgtaacg

SEQ ID NO: 299561 - DNA, 519 bp, Homo sapiens
  misc_feature: GZ8MTXP01BOL1Z.38.23.C01.1.454.CMB.2.raw
  modified_base (250)..(250): a, c, t, g, unknown or other
  misc_feature (250)..(250): n is a, c, g, or t
  modified_base (254)..(254): a, c, t, g, unknown or other
  misc_feature (254)..(254): n is a, c, g, or t
  modified_base (257)..(257): a, c, t, g, unknown or other
  misc_feature (257)..(257): n is a, c, g, or t
  modified_base (259)..(259): a, c, t, g, unknown or other
  misc_feature (259)..(259): n is a, c, g, or t
  modified_base (270)..(270): a, c, t, g, unknown or other
  misc_feature (270)..(270): n is a, c, g, or t
  modified_base (291)..(291): a, c, t, g, unknown or other
  misc_feature (291)..(291): n is a, c, g, or t
  modified_base (303)..(303): a, c, t, g, unknown or other
  misc_feature (303)..(303): n is a, c, g, or t
  modified_base (308)..(308): a, c, t, g, unknown or other
  misc_feature (308)..(308): n is a, c, g, or t
  modified_base (313)..(313): a, c, t, g, unknown or other
  misc_feature (313)..(313): n is a, c, g, or t
  modified_base (321)..(321): a, c, t, g, unknown or other
  misc_feature (321)..(321): n is a, c, g, or t
  modified_base (380)..(380): a, c, t, g, unknown or other
  misc_feature (380)..(380): n is a, c, g, or t
  modified_base (395)..(395): a, c, t, g, unknown or other
  misc_feature (395)..(395): n is a, c, g, or t
  modified_base (410)..(410): a, c, t, g, unknown or other
  misc_feature (410)..(410): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcgtggtttcgtgtagcgtatttagaaggtgtcagtgtgaggtgcagtggtggaatgtgggaaacgtgtcgagcgtggggtccgtgagctctcctgtgcngctntgntntatattatatntagtgtagtgtgtggtcgcgngcgcgaggcggngtggngtggngcgactanaacacgacgagagaagaaagagtaagtgtgtacgtcgtgtagacggacgactcacgtcncagagacgacgacanatacatatatagtanaagtagagacgacgagagagacgaacgacgacgactatataattagttagtaagttaaagtaatattagttgttagtaagtggtggtcggtacggttacggtcgttgtg

SEQ ID NO: 299562 - DNA, 581 bp, Homo sapiens
  misc_feature: GZ8MTXP01C20BO.38.23.C01.1.454.CMB.2.raw
  modified_base (361)..(361): a, c, t, g, unknown or other
  misc_feature (361)..(361): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctctgggcgagaggccaccatcaactgcaagtccagccagagttcttttgtcagctaccaaagaatatgtagttcgttagcttggtaccagacaagaaagcagacacgtcccctaagtgctactatttatgtcatctacgtcgggtgtccggggtcctcgaccgattcagcgacagcgntcgtgggacagtacttcactctacaccatcatagcctgcagactagaagtagtgtggggtacttaaggtttaattactgttaccagtactaaattattaagtaggtaacgttcccgttaacggtccttcggttaaccgttcggggacgggtaacgggacccgttagttcggggaaggacgtaagttaccgaaaggttacgtaaaccgttcggttaacggg

SEQ ID NO: 299563 - DNA, 618 bp, Homo sapiens
  misc_feature: GZ8MTXP01BX0CG.38.23.C01.1.454.CMB.2.raw
  modified_base (282)..(282): a, c, t, g, unknown or other
  misc_feature (282)..(282): n is a, c, g, or t
  modified_base (321)..(321): a, c, t, g, unknown or other
  misc_feature (321)..(321): n is a, c, g, or t
  modified_base (326)..(326): a, c, t, g, unknown or other
  misc_feature (326)..(326): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcgtggtttcgtgtagctatttagaaggtgtcagtgtgaggtgcagttggtggaatcgtgggggaaacttggtccagccgtgggggtccctgaagctctcctgtgcagcctctggattcatatttagaattntagtgatgtagttcggccgcgaggcgtacggagggcggngtggnggtggtcgaccaactaactaaacgacgtacgtacggaaactaagaaaacgtctaagtgtcgtactcgtaggtacggaacgggtccgtacttccgaccgtctacgaagacgaacgaacgacaagtaacttacgacgttagtattagaactaaagtacgaacgacgacgtagaacggacgtacgaaacgacgtaccgtactaattaattaatttaagttaggtaaagttaaacgtatacgttaagttcgagttaagtcggtaacgggacggtacgggttacgggtgttcgtaag

SEQ ID NO: 299564 - DNA, 544 bp, Homo sapiens
  misc_feature: GZ8MTXP01E1HRY.38.23.C01.1.454.CMB.2.raw
  modified_base (420)..(420): a, c, t, g, unknown or other
  misc_feature (420)..(420): n is a, c, g, or t
  modified_base (454)..(454): a, c, t, g, unknown or other
  misc_feature (454)..(454): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctctgggcgagagggccacatcaactgcaagtccagccagagtcttttgtcagctccaagaatatgtagtcgtagcttggtaccagacaagaaacgcacgacacgtacccctaagttgctctatttattggtcattctacgtcgggtcgtccccggggtcctgacctatcaagcgcaggcggatcgagggacagtatttcactctcacatcagcacgcctgcagactagaagntggtgactagtttatacgtgtacagtctaaagtntagtggtacttcccggtcggttctcgtaaccggtttcgggacgggacgggaaccgtagggtgggaagtacgttacgaaacggcgtaacgg

SEQ ID NO: 299565 - DNA, 546 bp, Homo sapiens
  misc_feature: GZ8MTXP01B97B0.38.23.C01.1.454.CMB.2.raw
  modified_base (410)..(410): a, c, t, g, unknown or other
  misc_feature (410)..(410): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagcctgggggtccctgaagctctcctgtgcagcctctggattcatatttagtaatcattggatgagttgggtccgccaggctccagggacggggctggagtggtggccatataaaccacgactggaaactgaaaaaagctaaatgtggactctgtagaagggccgattcaccgtctccaganacaacgaccaagaatcactgtatttgacaaatgaacagcctagagagtacgaaagacacggccatataattaattgtagttaaaagatcgaattcgaattaagtgggttggcggtacgttacggggtggcgttaag

SEQ ID NO: 299566 - DNA, 607 bp, Homo sapiens
  misc_feature: GZ8MTXP01BJI85.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagccgtgggggtccctgagctctcctgtgcagcctctggattcatattagtaatcattggatgagttggtccgccaggctccgaggggacgggctggagtgggtggccactataaaccacgataggaactagaaaagctaatgtggactcgtgtggaagggccgattcaccgtctccagacgacaacgaccaaagaattcgactgtatttagactaaagttcggaaacagacccgtagaaggtacgacgaaagaccaaccggggtacccaattaataatttaaagttggttaaagttaaaaaggtattaccttaagtttcggaatttaaggttggggttggaccgggtaacggttaccgggggtgggttaaccttaagg

SEQ ID NO: 299567 - DNA, 538 bp, Homo sapiens
  misc_feature: GZ8MTXP01BC5LU.38.23.C01.1.454.CMB.2.raw
  modified_base (352)..(352): a, c, t, g, unknown or other
  misc_feature (352)..(352): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagagtctttgtcagctccaaagaatatgagttcgtagcttggtaccagcagaaagcacgacagtcccctaagttgctctatttatgtcatctactcgggtgtccggggtcctgaccgtattcgagtcgganagcgatctgggacagtactttcactctacaccatcagtacgcctgaccagactgaagtatcggtggggactagttttactactgtcagtacaaagttattagtggttacgtcctgggcttcgtacgtttcgggcgggaggccgttagttgggtaaggagtaactacgaagccgtaagttcggaagg

SEQ ID NO: 299568 - DNA, 562 bp, Homo sapiens
  misc_feature: GZ8MTXP01DTN63.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtggggggtccctgaagctctcctgtgcagcctctggattcatattagtaatcattggatgagttggtccgcaggctccgagggacgggctggagtgggtggccactaataaaccacgataggaaactagaaaaaagctaaatgtggactcgtgtggaacgggccgattcacccgtctaccagacgaacaacgaccaaagaattcaactgtattagacaaatgaaacagcctgagagtacgaaagacacggaccatataattattgtagttaaaagatacttattcgattaagtgggtggcggtaacggttacggggtggttcgtaagg

SEQ ID NO: 299569 - DNA, 530 bp, Homo sapiens
  misc_feature: GZ8MTXP01DHBGR.38.23.C01.1.454.CMB.2.raw
  modified_base (489)..(489): a, c, t, g, unknown or other
  misc_feature (489)..(489): n is a, c, g, or t
  modified_base (494)..(494): a, c, t, g, unknown or other
  misc_feature (494)..(494): n is a, c, g, or t
  modified_base (496)..(496): a, c, t, g, unknown or other
  misc_feature (496)..(496): n is a, c, g, or t
  modified_base (504)..(504): a, c, t, g, unknown or other
  misc_feature (504)..(504): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagcctgggggtccctgagctctcctgtgcagcctctggattcatattagtaatcattggatgagttgggtccgcaggctcgagggacgggctggagtggggtggccactataaaccacgaatggaaactagaaaaagctaaatgtggactctgtgaagggccgattcaccgtctccagagacaacgaccaaagattcacttgtattgacaaatgaaacagacctgaagagtacgaaagacacgaccatataattattgtanaaagntnattcgatntggtggcggagttacgggtgcgtaag

SEQ ID NO: 299570 - DNA, 566 bp, Homo sapiens
  misc_feature: GZ8MTXP01AL935.38.23.C01.1.454.CMB.2.raw
  modified_base (255)..(255): a, c, t, g, unknown or other
  misc_feature (255)..(255): n is a, c, g, or t
  modified_base (283)..(283): a, c, t, g, unknown or other
  misc_feature (283)..(283): n is a, c, g, or t
  modified_base (303)..(303): a, c, t, g, unknown or other
  misc_feature (303)..(303): n is a, c, g, or t
  modified_base (366)..(366): a, c, t, g, unknown or other
  misc_feature (366)..(366): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagacctccctggctgtgtctcgtgggcgagacgggccacatcaactgcaagtccagccagtagttctttgtcagctacaagaatntgagtcgtagcttaggaccagcaagaancacgacacgtcccctaagtnctactatttagtggtctatctacgtcggggtcgtcccccggggtcctgacccgatcgagcggnagcggatcgtgggacagtcttcactctacacatcagcacgcctgacaagactagaaaggtgttggtacggacttaagtttactactggtacagtactaaattagtttgtaacgggttacgttccgtcggttccttaccgtaacggtttcggggacggggacgggtaacaaggggtcgaagtacgttacggaagccgtaag

SEQ ID NO: 299571 - DNA, 592 bp, Homo sapiens
  misc_feature: GZ8MTXP01AC5BA.38.23.C01.1.454.CMB.2.raw
  modified_base (464)..(464): a, c, t, g, unknown or other
  misc_feature (464)..(464): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagccgtggggggtccctgaagctctcctgtgcagcctctggattcatattagaatcattggatggagttgggtccgccaggctccgaggggacgggctggagtggggtgccactataaaccacgatggaactagaaaaagctaaatgtggacctgtgagggacggacgtactaccacccgtcaccgagacgaaccgaccgaacgaaagtaactactacgttagttagttacgaaanaacgtaacgaacgtacgtacgagaacgtacggaacgaaacgaccgaccgactattattaattattagtaaagttaaagtactacttgttagataaggtggtggacggacgggttacgggtgaacgttg

SEQ ID NO: 299572 - DNA, 551 bp, Homo sapiens
  misc_feature: GZ8MTXP01BAZJ8.38.23.C01.1.454.CMB.2.raw
  modified_base (513)..(513): a, c, t, g, unknown or other
  misc_feature (513)..(513): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagccgtggggggtccctgagctctcctgtgcagcctctggattcatattagaatcattggatgagttgggtccgccaggctccgaggggacggggctgggagtgggtggccactaataaaccacgaataggaaactagaaaaaagactaaatgtggactctgtaggaagggccgattccacgtctaccagagacaacgaccaaagattcactgtaatttgacaaatgaaacagacctagacgagtacgaaagacacggcatataattattgtattaaagtactanagttgataagtggtggcgacgttacggggtgcgttaag

SEQ ID NO: 299573 - DNA, 537 bp, Homo sapiens
  misc_feature: GZ8MTXP01AROMS.38.23.C01.1.454.CMB.2.raw
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctctgggcgagaggccacatcaactgcaagtccagccagagtctttgtcagctcaagatatgagtcgtagcttggtaccagcagaagcacgacacgtcccctaagtgactctatttatggtcattctacgtcgggtcgtccccggggtcctgacccgtattcgaagcggcagcggatcgtaggggacagtacttcactctcacactcagcagcctgacagactagaaggagtggtcgtctagtttacttagtgtacagtataaatattagtggtacgttccgtcgttcgtcgtacgtttcgggcgggttacgggaaccgaagggtggagtacgttacgaaggccgtaagg

SEQ ID NO: 299574 - DNA, 573 bp, Homo sapiens
  misc_feature: GZ8MTXP01DV8AD.38.23.C01.1.454.CMB.2.raw
  modified_base (428)..(428): a, c, t, g, unknown or other
  misc_feature (428)..(428): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctcgtgggcgagacgggccaccatcaactgacaagtccagccagagttcttttgtcagctaccaaagatatgagttcgtagcttggtaccagacaagaaagcacgacacgtacccctaagttgctactatttagtggtctaattcctacgtcgggtcgtcccggggtcctcggaccgtattcgagcgacagcgatcgtgggacagtattcactctcacatcagcacgcctgacagactagaaagtntgggtggtacttaagtttacttacgtgtacgagtactaagttattagtcgtacgttcctcggacttccgttacggtttcgggaccgggttaagggttaccgaagggttgggagtaacttaccgaagccgtaacgttggtaaccgg

SEQ ID NO: 299575 - DNA, 605 bp, Homo sapiens
  misc_feature: GZ8MTXP01A0B5C.38.23.C01.1.454.CMB.2.raw
  modified_base (352)..(352): a, c, t, g, unknown or other
  misc_feature (352)..(352): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctctgggcgagaggccaccatcaactgcaagtccagccagagtcttttgtcagctccaagaatatgagttcgttagcttggtaccagcagaaagcacgacagtcccctaagttgctcatttatggtcatctactcgggtgtccggggtcctcgaccgattcagcggtacnggcgtcgtcggtaggactagttacttctactcctaccaactacacgacgacgaccgtcctcgaccgaagtacgtaaggaagtagttgggggtacgtagtttaagttttacgttacgttcgtacgacgtaataattattaggttacggtaccgtccgtcggttcttaccgttacgggttccggggacgggaacgggttaaccggttagggtaacggtagtaacgtaacgacggttaaccgtaagttcgggtcgg

SEQ ID NO: 299576 - DNA, 568 bp, Homo sapiens
  misc_feature: GZ8MTXP01D32RW.38.23.C01.1.454.CMB.2.raw
  modified_base (254)..(254): a, c, t, g, unknown or other
  misc_feature (254)..(254): n is a, c, g, or t
  modified_base (433)..(433): a, c, t, g, unknown or other
  misc_feature (433)..(433): n is a, c, g, or t
  modified_base (466)..(466): a, c, t, g, unknown or other
  misc_feature (466)..(466): n is a, c, g, or t
  modified_base (509)..(509): a, c, t, g, unknown or other
  misc_feature (509)..(509): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctcgtgggcgaggacggccaccatcaactgacaagtccagccagtagttcttttgtcagctaccaaagaatntgtagttcgttagcttggaccagacagaaagcacgacacgtcccctaagttgcttactatttattggtctatcgtacgtcgggttcgtcccggggtccctgaccgtatcgagcggacaggcggtatcgtagggacagtactttcactctacacatcagcagcctgcagactagaaagtntgggtggtacttagtttacttactgtacagtanaattatagttggtacttcctcggttctacgttacggtttcggngggttaacggttacgttaagggtcggaagtcgtacgaacggcgtaaacgttggtaacgg

SEQ ID NO: 299577 - DNA, 545 bp, Homo sapiens
  misc_feature: GZ8MTXP01DV8Z3.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtcagccgtgggggtccctgagctctcctgtgcagcctctggattcatatttagtaatcattggatgagttgggtccgcaggctccgagggcgggctggagtggtggcactataaaccacgatggaactagaaaaagctaaatgtggactcgtgtagaaggggccgattccaccgtctaccagagacaacgaccaagaattcacttgtatttgacaaatagaaactagcctagagagtacgaaagacacggacatataattattgtagttaaaagactcttagttcgataagtcggtggcgacggttacgggtggcgtaag

SEQ ID NO: 299578 - DNA, 583 bp, Homo sapiens
  misc_feature: GZ8MTXP01AZPVH.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcgtgggtttccttgttgctatttagaaggtgtccagtgtgaggtgcagttggtggaatctgggggaaacttggtccagccgtgggggtccctgaagctctcctgtgcagcctctggattcatatttagtaatcattggatgagttgggtccgccaggctccgaggggacgggctggaggtgggtggccactaataaaccacgataggaactagaaaaagctaaatgtggaactcgtggtagaacggggccgattccacccgtctaccaggacgacaaacgaccaaagtaacttcactgtaatttagacaaagtgaacagacctgaagagtacgaaagaccacggccaattataattattagtaagttaaagtatacttagttcgaattaagtggggttcggcggtaacgggttacggggtggttccttaagg

SEQ ID NO: 299579 - DNA, 533 bp, Homo sapiens
  misc_feature: GZ8MTXP01BT6OT.38.23.C01.1.454.CMB.2.raw
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagagtcttttgtcagctaccaaagaatatgtagttcgttagcttggtaccagacaagaaagcacgacacgtcccctaagtgctctatttattgtcatctacgtcgggtcgtccggggtcctcgaccgtattcgagcggcagcggatcgtgggacagtattcactctcacatcagcagcctgcagactgaagtagtggtggtactagtttatactgtcagtactaattattagtggtagtcctcggctacgttcgtttcgggcggttaacgggccttaagggtcgagaatacgaagttcgtaacgttggtaag

SEQ ID NO: 299580 - DNA, 546 bp, Homo sapiens
  misc_feature: GZ8MTXP01DT332.38.23.C01.1.454.CMB.2.raw
  modified_base (421)..(421): a, c, t, g, unknown or other
  misc_feature (421)..(421): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagccgtacggggacatcgtgatgacccagtctccagacctccctggctgtgtctcgtgggcgagacggccacatcaactgacaagtccagccagtagttcttttgtcagctacaagatatgtagtcgtagcttggaaccagcaagaaagcaacgacacgtacccctaagttcacttactatttagtgtcattctacgtcgggtcgtcccccggggtcctagaccgtattcgaacgcgcaggcggatcgtagggacagtacttcactctacacatcagcacgccngcagacgtagaaggagtgtaggtctaagtttatacgtgtacagtactaatatagtgtacgttcctcgctcgtacgttcggcgggttacggaaccgagggtaagagtacgttacgaacgcgtaacg

SEQ ID NO: 299581 - DNA, 570 bp, Homo sapiens
  misc_feature: GZ8MTXP01EVR3B.38.23.C01.1.454.CMB.2.raw
  modified_base (476)..(476): a, c, t, g, unknown or other
  misc_feature (476)..(476): n is a, c, g, or t
  modified_base (532)..(532): a, c, t, g, unknown or other
  misc_feature (532)..(532): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctatttagaaggtgtccagtgtgaggtgcagttggtggaatcgtgggggaaacttggtccagccgtgggggtccctgagctctcctgtgcagcctctggattcatatttagaatcattggatggagttggtccgccgaggctccgaggggacggggcgtgggagtggggtcggccaactaactaaaccgacgataggaaactagaaaaagctaaatgtggactcgtgtacggaagggccgagttccaccgtctaccgagacgaacaacgaccaaagtattcactgtaatttagacaaagtcgaaacgngaccgtagaacgagtacgaaagaccacggctaatataattattagtattaaaacgntacttagttcatgtggtcgcgacggttaggtgaacttg

SEQ ID NO: 299582 - DNA, 580 bp, Homo sapiens
  misc_feature: GZ8MTXP01D19XR.38.23.C01.1.454.CMB.2.raw
  modified_base (286)..(286): a, c, t, g, unknown or other
  misc_feature (286)..(286): n is a, c, g, or t
  modified_base (474)..(474): a, c, t, g, unknown or other
  misc_feature (474)..(474): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactcctggctgtgtctcgtgggcgagacgggccacatcaactgcaagtccagccagtagttcttttgtcagctaccaaagaatatgtagtcgtagcttggtaccagacagaaancacgacacgtcccctaagttgctctatttattggtcattctacgtcggggtcgtccccggggtcctgaccgtatcgaagcgcaggcgatcgtgggacagtacttcactctacaccatcagcacgcctgccgaagactaggaaggtagttggtggtacttaagtttacttactggtacagtactaaatnttagtgggttacttcccgtacggttcctacgttaccggttcggggacgggttaacgggtaaccggtaagggttcgggaagtacgttacgaaacggttcggtaacgg

SEQ ID NO: 299583 - DNA, 559 bp, Homo sapiens
  misc_feature: GZ8MTXP01CNJFL.38.23.C01.1.454.CMB.2.raw
  modified_base (303)..(303): a, c, t, g, unknown or other
  misc_feature (303)..(303): n is a, c, g, or t
  modified_base (416)..(416): a, c, t, g, unknown or other
  misc_feature (416)..(416): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctcgtgggcgagagggccaccatcaaactgcaagtccagccagagtcttttgtcagctcaagaatatgagtcgtagcttggtaaccaacagaaagcaacgacacgtcccctaagtnctactatttattggtcatctacgtcgggtgtccggggtcccctgacgatcagcgcaagcgatcgtgggactagactttcactctcacatcagcacgcctgacagactagaagngtggtaggctagttttactactgtacagtactaaagttattagtggttaacgtccgttacggtccttcgtaaacggtttccgggacgggttacgggaacccgtaaaggggtggaagaacgtacccgaaggtccgaacgttggg

SEQ ID NO: 299584 - DNA, 528 bp, Homo sapiens
  misc_feature: GZ8MTXP01BRWSR.38.23.C01.1.454.CMB.2.raw
  modified_base (488)..(488): a, c, t, g, unknown or other
  misc_feature (488)..(488): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagcctgggggtccctgaagctctcctgtgcagcctctggattcatatttagtaatcattggatgagttgggtccgccaggctccgagggacggggctggagtgggtggccactataaaccacgatggaactgaaaagactaatgtggactctgtgaagggcattcaccgtctccagagacaacgaccaaagattcactgtatttgacaaagtgaacagcctgagagtcgaagcacggcatataattattgtagttaaagntcagttcgataagtggtggcgacggttacgggtgcgtaag

SEQ ID NO: 299585 - DNA, 536 bp, Homo sapiens
  misc_feature: GZ8MTXP01CJ9Y5.38.23.C01.1.454.CMB.2.raw
  modified_base (304)..(304): a, c, t, g, unknown or other
  misc_feature (304)..(304): n is a, c, g, or t
  modified_base (335)..(335): a, c, t, g, unknown or other
  misc_feature (335)..(335): n is a, c, g, or t
  modified_base (433)..(433): a, c, t, g, unknown or other
  misc_feature (433)..(433): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtgggggtccctgaagctctcctgtgcagcctctggattcatatttagtaatcattggatgagttgggccncaggctccgaggggacgggctggagtggggngccatataaaccacgataggaactagaaaaagactaatgtgactctggtgaagggccgtatccacgtctccagacgacaacgaccaagattacacttntatttgacaagtgaacagcctagagacgtagaagacacgacagtataattattgtagttaaagatcagttcgataagtggtgcggagttacgggtggcttaag

SEQ ID NO: 299586 - DNA, 529 bp, Homo sapiens
  misc_feature: GZ8MTXP01CR5JR.38.23.C01.1.454.CMB.2.raw
  modified_base (476)..(476): a, c, t, g, unknown or other
  misc_feature (476)..(476): n is a, c, g, or t
  modified_base (480)..(480): a, c, t, g, unknown or other
  misc_feature (480)..(480): n is a, c, g, or t
  modified_base (489)..(489): a, c, t, g, unknown or other
  misc_feature (489)..(489): n is a, c, g, or t
  modified_base (510)..(510): a, c, t, g, unknown or other
  misc_feature (510)..(510): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagacctccctggctgtgtctcgtgggcgagagggccaccatcaactgacaagtccagccagtagttcttttgtcagctaccaaagatatgagttcgttagcttggtaccagcagaaagcacgacacgtcccctaagttgctactatttatggtcatctacgtcgggtgtccggggtcctcgaccgattcagcggacaggcggatcgtaggggacagtactttcactctcaccatcagcagcctgcagactgaagagtggggtgacgttagtttattactgtctagactaagtattagtggtatccgtcggnttcncgtttcggnggttacggggacagggtggangtagagcgaacgttggtcg

SEQ ID NO: 299587 - DNA, 531 bp, Homo sapiens
  misc_feature: GZ8MTXP01AQA7O.38.23.C01.1.454.CMB.2.raw
  modified_base (305)..(305): a, c, t, g, unknown or other
  misc_feature (305)..(305): n is a, c, g, or t
  modified_base (352)..(352): a, c, t, g, unknown or other
  misc_feature (352)..(352): n is a, c, g, or t
  modified_base (376)..(376): a, c, t, g, unknown or other
  misc_feature (376)..(376): n is a, c, g, or t
  modified_base (496)..(496): a, c, t, g, unknown or other
  misc_feature (496)..(496): n is a, c, g, or t
  modified_base (509)..(509): a, c, t, g, unknown or other
  misc_feature (509)..(509): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtggggggtccctgaagctctcctgtgcagcctctggattcatatttagtaatcattggatgagttgggccnccaggctccgagggacggggctgggagtgggtggccactataaaccncgatgggaactagaaaaagctaangtgactctgtgagggcgattcaccgtctcagagacaacgaccaagaatcactgtatttgacaaagtgaaacagcctagagagtacgaagacacggaccatataattattgtagttaaagntacattcgataanggtgcggacgacgggtgctaag

SEQ ID NO: 299588 - DNA, 563 bp, Homo sapiens
  misc_feature: GZ8MTXP01CTQMY.38.23.C01.1.454.CMB.2.raw
  modified_base (337)..(337): a, c, t, g, unknown or other
  misc_feature (337)..(337): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtagggggaaacttgggtccaggccgtggggggtccctgaagctctcctgtgcagcctctggattcaatatttagtaatcattggatgagttggtccgcaggctccgagggcgggctggagtgggngccacgtataaaccacgataggaactagaaaaagctaatgtcggactcgtggtagaaggggcctaatccaccgtctaccgagacgacaacgaccaagtaatacacttgtatttagacaaagtagaactagactgaagagtacgaagacacggacatataattattgtagttaaagtatcaattgagtaagtcgggtaaggcggtacggttacgggtgggcttaagg

SEQ ID NO: 299589 - DNA, 545 bp, Homo sapiens
  misc_feature: GZ8MTXP01AYLSQ.38.23.C01.1.454.CMB.2.raw
  modified_base (378)..(378): a, c, t, g, unknown or other
  misc_feature (378)..(378): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctcgtgggcgagaggccaccatcaactgcaagtccagccagagttcttttgtcagctaccaaagatatgtagttcgtagcttaggtaccagcaagaaagcaacgacacgtcccctaagttcgctactatttatggtcatctacgtcgggtcgtccgggtcctgaccgattcgagcgacagcgatcgtgggacagtnttcactctacacatcagcagcctgcagactgaagtagtgggtaggtactagtttactacgtgtacagtactaaattagttagtggttacgtcccgtacggcttacgttacggttcgggacggacgggttaccagggtcgagaacgtacgaagcgtaacgttggtcgg

SEQ ID NO: 299590 - DNA, 561 bp, Homo sapiens
  misc_feature: GZ8MTXP01BNL0R.38.23.C01.1.454.CMB.2.raw
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagacctccctggctgtgtctctgggcgagagggccaccatcaactgcaagtccagccagagttcttttgtcagctaccaagaatatgagtcgtagcttggtaccagcaagaaagcaacgacacgtcccctaagttgctctatttattggtcattctacgtcgggtcgtccccggggtcctgaccgtatcgaagcgcagcggtatcgtgggactagtactttcactctcacatcagcagcctgcagactgaaggtagtggtgtacttagtttattacgtgtacagtactaaattattagtggttacgttcccgtcggttcttaccgtacggtttccgggcggggttacgggaaccgtaaggggtcggaagtacgttacgaacggcgtaacgg

SEQ ID NO: 299591 - DNA, 607 bp, Homo sapiens
  misc_feature: GZ8MTXP01CDDGI.38.23.C01.1.454.CMB.2.raw
  modified_base (256)..(256): a, c, t, g, unknown or other
  misc_feature (256)..(256): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctcgtgggcgaggacgggccaccatcaaactgacaagtccagccagtagttcttttgtcagctacaaagtaatntgtagttcgtagcttaggaccagcaagaaacgcaacgacacgtcccctaagtcgctattatttagtgtctaattcctacgttcgggtcggtcccggggtcctacggaccgtagttccgaggtccggacaaggtcggatccggtagggaacagtactttcactcacacatcagcagcctagcaagactaggaagtacgtggggtacggtacgtttaaacgtttacttacgtcgtactaacgtaactaaattagttagtcggttacgttccgtacggttcttcgttacgtttcggggacggttacgggacggttagggttaaggataacgtacgaacgcgtaacgttggtcgg

SEQ ID NO: 299592 - DNA, 555 bp, Homo sapiens
  misc_feature: GZ8MTXP01AYKHD.38.23.C01.1.454.CMB.2.raw
  modified_base (400)..(400): a, c, t, g, unknown or other
  misc_feature (400)..(400): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagtagtcttttgtcagctaccaaagaatatgtagttcgtagcttggtaccagacagaaagcacgacagtcccctaagttgctctatttagttggtcatctacgtcgggtcgtcccgggtcctcgaccgtatcgagcggcagcggtatcgtgggacagtacttcactctcacatcagcanccctgcagactagaagtagtggggtaggtcttagtttacttactgtctagactaatatttagtggtacttccgtggttctacttacggtttcgggacgggttacgggaccgttagggtggagtaagtaccgaaggttacgtaacgttgggtaacg

SEQ ID NO: 299593 - DNA, 545 bp, Homo sapiens
  misc_feature: GZ8MTXP01D9RNY.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagccgtggggggtccctgaagctctcctgtgcagcctctggattcatattagtaatcattggatgagttgggccgccaggctccgaggggacggggctggagtgggtggccactaataaaccacgatggaaactagaaaaagctaatgtggactctgtagaagggccgattcaccgtctccagagacaacgaccaagaattcactgtatttgacaaagtgaaactagcctagagagtacgaaagacacggccatataattattgtagttaaagatacattcgatgtgggtggcggacggttacggggtggcgttaag

SEQ ID NO: 299594 - DNA, 566 bp, Homo sapiens
  misc_feature: GZ8MTXP01CKSL3.38.23.C01.1.454.CMB.2.raw
  modified_base (387)..(387): a, c, t, g, unknown or other
  misc_feature (387)..(387): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctctgggcgagacgggccaccatcaactgcaagtccagccagagtcttttgtcagctaccaaagaatatgagttcgttagcttggtaccagcagaaagcacgacagtcccctaagttgctcatttatggtcatctacgtcgggtcgtccgggtcctgaccgtattcgagcgcagcgatcgtgggacagtactttcactctcaccntcagcagcctgcagactagaagtactggggtggtactagttttactacgtgtcaagtactaaattattagtcggtacgttccgtcgggttcttccgttaccgtttacgggggcggttaacggggaccgttaaagggttcgggaagtaacgtacgaagggttccgtaaacgttgggtccg

SEQ ID NO: 299595 - DNA, 667 bp, Homo sapiens
  misc_feature: GZ8MTXP01CIATP.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcgtggtttccgtgttaggctattttagaaggtgtccagtgtgaggtgcagttggtggaatcgtgggggaaacttggtccagcctggggggtccctgaagctctcctgtgcagcctctggattcatatttagtaatctaattggatggtagttgggtccgccgaggctcccgagggggacggggctgggagtggggtggacctactaataaacccgagataggaaactaggaaaaaagctaaagtggtggaactcgtggtaggaaacgggccgtaattccaacccgtctacccgagacgaaccaaacggacccaaagtaacttacacttagttaatttaacgaacgtaaaggtacgaaacgtacgacgtaggaagtaacggtacgaaacgaaccgtacggtacctaagttaattaacgtttaagttaggttaaagttaaaacgtacgttacttaagttcgttaagttaaggtacggggttcgggacggtacggggttacgggtcggttaacgttaag

SEQ ID NO: 299596 - DNA, 576 bp, Homo sapiens
  misc_feature: GZ8MTXP01A8BJ3.38.23.C01.1.454.CMB.2.raw
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctcgtgggcgagaggccacatcaactgacaagtccagccagtagttcttttgtcagctaccaaagaatatgtagttcgtagcttggtaccagcaagaaagcacgacacgtacccctaagttcgcttactatttagttggtacctatctacgttcgggtcgtccggggtccctcggaccgtatcgacgcggacagcggatcgtgggacagttacttcactcactacatcagcacgcctgacagactagaagtgtggggtcgtacttaagtttattactgacagtactaattatacgttaggtacttcccgtggttacttcgttacgttcggggacgggttacggaccggttaagggtcgggataaggtacaaggttaccgtaagttgggtaaccg

SEQ ID NO: 299597 - DNA, 642 bp, Homo sapiens
  misc_feature: GZ8MTXP01DNU4S.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtagggggaaacttggtcagccgtgggggtccctgagctctcctgtgcagcctctggattcatattagtaatctattggatggaggttcgggtcccgccgaggctccggagggggacgggggctgggaggtgggtcggccactaactaaaccgacgagtaggaaactagaaaaagactaagtgtggactcgtagtaggaaacggggtccgtattccacccgtctaccgaagacgaaccgaacgaccaaagtaacttacacttagttatttagactaaaagtacgaacacgacctaggaagtacgtacgaaacgaccgaaccggacctaattaattaatttaagttaggtaaagttaaaagtattacttaagtttcgaattaagttggggtaacggtaccgggtacgggttaccggggtggttcgtttaagg

SEQ ID NO: 299598 - DNA, 529 bp, Homo sapiens
  misc_feature: GZ8MTXP01C7PTZ.38.23.C01.1.454.CMB.2.raw
  modified_base (297)..(297): a, c, t, g, unknown or other
  misc_feature (297)..(297): n is a, c, g, or t
  modified_base (448)..(448): a, c, t, g, unknown or other
  misc_feature (448)..(448): n is a, c, g, or t
  modified_base (514)..(514): a, c, t, g, unknown or other
  misc_feature (514)..(514): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctctgggcgagagggccacatcaactgcaagtccagccagagtctttgtcagctcaagatatgagtcgtagcttggtaccagcagaaagcacgacacgtcccctaagttnctctatttattggctatctacgtcgggtcgtccccggggtccctgaccgattcgaagcggcagcggatcgtgggacagtattcactctcacatcagcagcctgcagactgaaggtatggtacggcttagtttatactgtacagtactaatnttagtggtacgttccgttcggcttccgtaacgtttcggggcggacgggtaaccaaagggtggaagnttacgaagcgtaacg

SEQ ID NO: 299599 - DNA, 541 bp, Homo sapiens
  misc_feature: GZ8MTXP01C10ED.38.23.C01.1.454.CMB.2.raw
  modified_base (400)..(400): a, c, t, g, unknown or other
  misc_feature (400)..(400): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagccgtggggggtccctgaagctctcctgtgcagcctctggattcatatttagtaatcattggatgagttggtccgcaggctccgagggacggggctggagtgggtggccatataaaccacgatggaactgaaaaagactaatgtgactctgtgaagggcctatcacccgtntccagagacaacgaccaagaatcacttgtatttgacgaaatgaacagcctgagagtacgaagacacggccatataattattgtagttaaaagatcttagttcgataatgggtgggcgtacgggttacggggtggcttaagg

SEQ ID NO: 299600 - DNA, 728 bp, Homo sapiens
  misc_feature: GZ8MTXP01B3846.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgctagttggtggaatcgtagggggaaacttggtccagccgtggggggtccctgagctctcctgtgcagcctctggattcatattagtaatcattggatgtagttcgggtccgccaggctccgagggggacgggcgtgggaggtggggtgccaactaacgtaaaccacggataggaaactaagaaaaagactaaagtggtgggacttcgtgggttaggaaacggggtcccgtagtttacccaccggttcctaccgaggaacgaaccaaaccggacccgtaaagtaactttacctaacgttacggttaattttagggaaccttaaaagtacggtaaaacgacggtacccgtaaggaacgggtaacggttaccgggaaaacgaccgtaaaccggggaccctaaagttaaatttaaagtttaagtttaaaggttaaagttaaaaaccggtaaattaccttaaacgtttacggttaattaagggttggggtcgggtacgggtaacgggttaacgggggtccggttaacgtttaaggg

SEQ ID NO: 299601 - DNA, 531 bp, Homo sapiens
  misc_feature: GZ8MTXP01ALLB2.38.23.C01.1.454.CMB.2.raw
  modified_base (347)..(347): a, c, t, g, unknown or other
  misc_feature (347)..(347): n is a, c, g, or t
  modified_base (354)..(354): a, c, t, g, unknown or other
  misc_feature (354)..(354): n is a, c, g, or t
  modified_base (403)..(403): a, c, t, g, unknown or other
  misc_feature (403)..(403): n is a, c, g, or t
  modified_base (429)..(429): a, c, t, g, unknown or other
  misc_feature (429)..(429): n is a, c, g, or t
  modified_base (448)..(448): a, c, t, g, unknown or other
  misc_feature (448)..(448): n is a, c, g, or t
  modified_base (455)..(455): a, c, t, g, unknown or other
  misc_feature (455)..(455): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgaccccagtctccagactccctggctgtgtctcgtgggcgagacgggccaccatcaactgacaagtccagccagagttcttttgtcagctacaagaatatgtagtcgtagcttggaccagcagaaagcacgacacgtcccctaagtcgctctatttatgtcatctacgtcggggtcgtccccgggtccngaccgtntcgaagcgcaggccgtatcgtagggactagtactttcactctacactancacgcacgctgacagacgtagaaggngtggtgacttaagtttctntacgtanatataattgttagtggtcttccgtcgttctacgtcgttcgggacgggaggaacgaggtgatagacgaacgcgtaag

SEQ ID NO: 299602 - DNA, 565 bp, Homo sapiens
  misc_feature: GZ8MTXP01C3HAD.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtggggggtccctgaagctctcctgtgcagcctctggattcatattagtaatcattggatgagttgggtccgcaggctccgagggggacggggctggagtggggtggccatataaaccacgactggaaactgaaaaagctaatgtggactcgtggtaggaaggggccattcaccgtctccagagacaaacgaccaaagaacttcgacttgtatttagacaaagtgaaactagcctagagagtcgaaagacaacggccaagttataattattgtagttaaaagtatcttaattcaaatgtaggtggacggtacggttacgggtggcgttaagg

SEQ ID NO: 299603 - DNA, 538 bp, Homo sapiens
  misc_feature: GZ8MTXP01A7RTJ.38.23.C01.1.454.CMB.2.raw
  modified_base (420)..(420): a, c, t, g, unknown or other
  misc_feature (420)..(420): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctctgggcgagaggccacatcaactgcaagtccagccagagtcttttgtcagctacaagatatgagtcgtagcttggtaccagcagaaagcacgacacgtcccctaagtcgctctatttatggtcattctacgtcgggtcgtcccccggggtccctgaccgtattcaacggcgcaggcggatcgtagggacagtacttcactctcacatcagcacgcctgacagactagaagngtggtggtactagtttatcgtgtacagtactaattattagtggttacgttccgtcggttcgtacgttacgtttcggggcggacgggtaaccgagggtggagacgttacgaagcgtaag

SEQ ID NO: 299604 - DNA, 571 bp, Homo sapiens
  misc_feature: GZ8MTXP01C223M.38.23.C01.1.454.CMB.2.raw
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagacctccctggctgtgtctcgtgggcgagacggccaccatcaactgacaagtccagccagtagttcttttgtcagtctacaaagaatatgagttcgttagcttggaccagacaagaaacgcaacgacacgtcccctaagtcgctactatttatgtctagtcttacgtcgggtcgtccgggtcctcggtaccgtattcgaggccgacgagcggtatcgagggacagtacttcacttctacaccatcgacgactacgcctagaccaagactaggaagtagtgggtaggtactagtttattacgtgtacgagtactaagttattacgtggttactccgtcggcttcgttacgttcgggacggttacggaccgagggtcgaagtaatacgagttaccgtaagttgtcgg

SEQ ID NO: 299605 - DNA, 591 bp, Homo sapiens
  misc_feature: GZ8MTXP01A2G3J.38.23.C01.1.454.CMB.2.raw
  modified_base (252)..(252): a, c, t, g, unknown or other
  misc_feature (252)..(252): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactcctggctgtgtctcgtgggcgagacggccacatacaactgacaacgtccagccagtagttcttttgtcagctacaaagaatntgtagttcgtagcttaggacagacaagaagcacgacacgtccctaagtcgctactatttagtgtactagtcgtacgtcgggtacgtcccggggtcctacggaccgtatcgacggtcgaacaggcggtatcggtacgggactagtacttcactctaccacatcgacgcacgccctgacaacgacgtagaaagtgtagggtaggtacttaagtttacgtactgtactagtaatattagtagttcggtactccgtacgttcttacgttacggttacgggacggttacgggttacgagggtaagtaagaacgttacgaacggttaccgtaacgttggtaacgg

SEQ ID NO: 299606 - DNA, 559 bp, Homo sapiens
  misc_feature: GZ8MTXP01BZRYA.38.23.C01.1.454.CMB.2.raw
  modified_base (510)..(510): a, c, t, g, unknown or other
  misc_feature (510)..(510): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggtttccttgttgctatttagaaggtgtccagtgtgaggtgcagttggtggaatctgggggaaacttggtccagccgtggggggtccctgaagctctcctgtgcagcctctggattcatatttagtaatcattggatgagttggtccgccaggctccgaggggacgggggctgggagtggggtgccactaataaaccacgatgggaactagaaaaagctaaatgtggactctgtgaagggcgattcaccgtctccagagacaacgaccaagaattcactagtatttagacaaatgaacagacctgaagagtacgaaagacgacggacccaatataattattagtagttaaaagatnttatttcgattaagtgggtcggtacggacggttacggggtggttctaag

SEQ ID NO: 299607 - DNA, 656 bp, Homo sapiens
  misc_feature: GZ8MTXP01BANOS.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctatttagaaggtgtccagtgtgaggtgcagttggtggaatcgtgggggaaacttggtccagccgtgggggtccctgagctctctgtgcagcctctggattcatattagtaatcattggatggagttgggtccgcgaggctccgagggggacggggctgggaggtgggtcggaccaactaataaacccgacgatagggaaactagaaaaaagtactaaatggtggactcgtggtagaaggggcctagttccaccgttctaccgaaggacgaaccaaacgacccgaaagtaacttcaacttggttaatttacggaactaaaagttacgaaactaacgaccgttaagaaggaggttaccggaaacgaaccgtaccggaacctaattaattaatttaagtttaggtaaagttaaaagtaacttacttaaagttcgttaattaaggtggggtaacggtcgggacgggttaccgggggtggaaccgtttaagg

SEQ ID NO: 299608 - DNA, 540 bp, Homo sapiens
  misc_feature: GZ8MTXP01DVX4V.38.23.C01.1.454.CMB.2.raw
  modified_base (458)..(458): a, c, t, g, unknown or other
  misc_feature (458)..(458): n is a, c, g, or t
  modified_base (463)..(463): a, c, t, g, unknown or other
  misc_feature (463)..(463): n is a, c, g, or t
  modified_base (498)..(498): a, c, t, g, unknown or other
  misc_feature (498)..(498): n is a, c, g, or t
  modified_base (525)..(525): a, c, t, g, unknown or other
  misc_feature (525)..(525): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagacctccctggctgtgtctcgtgggcgagagggccaccatcaactgcaagtccagccagagttcttttgtcagctcaaagatatgtagtcgtagcttggtaaccagcaagaaagcaacgacacgtacccctaagttgactactatttagttggtctattctacgtcggggtcgtcccccggggtcctgaccgtatcaagcgcagcggatcgtgggacagtattcactctcacatcagcagcctgacagactagaagtatggtgctagtttatactgtacatataatnttagnggttacgttcgtcggttctcgtaacggttccgggnggttacgggaaccgaagggtggtaganaccgtaagccgtaag

SEQ ID NO: 299609 - DNA, 557 bp, Homo sapiens
  misc_feature: GZ8MTXP01D93EA.38.23.C01.1.454.CMB.2.raw
  modified_base (281)..(281): a, c, t, g, unknown or other
  misc_feature (281)..(281): n is a, c, g, or t
  modified_base (353)..(353): a, c, t, g, unknown or other
  misc_feature (353)..(353): n is a, c, g, or t
  modified_base (362)..(362): a, c, t, g, unknown or other
  misc_feature (362)..(362): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctcgtgggcgagagggccaccatcaactgcaagtccagccagagttcttttgtcagctacaaagaatatgagttcgtagcttggtaccagacaagaaancaacgacacgtcccctaagtgctctatttatgtcatctacgtcggtgtccggggtcctgacctatcgagcgnagcgatcgngggacagtcttcactctcaccatcagcacgcctgcagactgaaagtgtggggtggtacttagtttattactgtacagtactaaattattaagtggtaagtccttcgggcttaccgttacggtttcggggaacggttaacgggaccgttaagggtcggaagtaactacgaaggttaccgtaacgtttgggtaacgg

SEQ ID NO: 299610 - DNA, 530 bp, Homo sapiens
  misc_feature: GZ8MTXP01AZ83Q.38.23.C01.1.454.CMB.2.raw
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctctgggcgagagggccacatcaactgcaagtccagccagtagttctttgtcagctcaagatatgagtcgtagcttggaccagcagaaagcacgacacgtcccctaagtgctctatttatggtcatctacgtcgggtcgtcccccggggtcctgaccgtattacgcgcaagcggatcgtgggacagtattcactctacacatcagcagcctgcagactagaagagtgtggactagtttatactgtacagtctaatattagtggtaactccttcgggtcttcgtacgtttcgggacgggttacgggaccgtaagggtggaagactacgaagtcgttaacgtggg

SEQ ID NO: 299611 - DNA, 536 bp, Homo sapiens
  misc_feature: GZ8MTXP01BMYLP.38.23.C01.1.454.CMB.2.raw
  modified_base (269)..(269): a, c, t, g, unknown or other
  misc_feature (269)..(269): n is a, c, g, or t
  modified_base (361)..(362): a, c, t, g, unknown or other
  misc_feature (361)..(362): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctctgggcgagaggccaccatcaactgcaagtccagccagagtctttgtcagctacaagatatgagtcgtagcttggtaccngcaagaaagcaacgacacgtcccctaagttcgctctatttattgtcattctacgtcggggtcgtccccggggtcctgaccgattcaagcggnnggcggtatcgtgggacagtactttcactctcacctatcgagccagcctgcaagactgaaggatggtgacttagtttatactgtacagtactaattattagtggtacgttcctacggctcgtacgtttcgggcggttagggaaccaagggtggtaagattaccgaaggcgtaacg

SEQ ID NO: 299612 - DNA, 582 bp, Homo sapiens
  misc_feature: GZ8MTXP01D5MIS.38.23.C01.1.454.CMB.2.raw
  modified_base (335)..(335): a, c, t, g, unknown or other
  misc_feature (335)..(335): n is a, c, g, or t
  modified_base (411)..(411): a, c, t, g, unknown or other
  misc_feature (411)..(411): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcttgggttttccttgttgctattttagaaggtgtccagtgtgaggtgcagttggtggaatcgtgggggaaacttggtccagccgtggggggtccctgagctctcctgtgcagcctctggattcatatttagtaatcattggatgagttggcccgcaggctcgaggggacgggcgtggagtgggngccactactaaacacgagtggaaactagaaaaagctaagtgtggatcgtagtgaagggcctatcaccgtctcaganacaacgaccaaagtaatcacgttgtatttagactaaagtacgaaacacgaccgtagaaggacgtacggaaagaccgtaacggacctaataattaattaattaggtaaagttaaaagattacaagttgattaaggtgggtaacggtcggacggttacggggtgttcgttaag

SEQ ID NO: 299613 - DNA, 536 bp, Homo sapiens
  misc_feature: GZ8MTXP01ARCXQ.38.23.C01.1.454.CMB.2.raw
  modified_base (332)..(332): a, c, t, g, unknown or other
  misc_feature (332)..(332): n is a, c, g, or t
  modified_base (346)..(346): a, c, t, g, unknown or other
  misc_feature (346)..(346): n is a, c, g, or t
  modified_base (518)..(518): a, c, t, g, unknown or other
  misc_feature (518)..(518): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtggggggtccctgaagctctcctgtgcagcctctggattcatattagtaatcattggatgagttggtccgcaggctcgagggacgggctggagtgggnggccactataaacncgactaggaactagaaaagctaatgtggactctggtagagggccattccaccgtctcagagacaacgaccaagacttacactagtatttagacaaacgtgaaacagcctagagagtacgaagacacggaccatataattattgtagaaagatcattcgataagtggtggcgnggttacgggtggcttaag

SEQ ID NO: 299614 - DNA, 771 bp, Homo sapiens
  misc_feature: GZ8MTXP01CFES1.38.23.C01.1.454.CMB.2.raw
tcagtcgatcacgtcacgaccggtgctcgatttagtacacgtgattagggattgggggagctacaacaggcaggcaggggcagcaagatggtgttgcagacccaggtcttcatttctctgttgctctggatctctggagccgtacggggacatcgtgatgacccagtctccagacctcctggctgtgtctcgtgggcgagacggccacatcaactgacaagtccagccagtagttctttgtcagctacaagaatatgtagtcgtagcttggtaacagtacaagaaacgcaacgactacgtacccctaagtcgctactatttagttcggtactagttcgtaccggttcgggggttcggtccccccggggttccctaggaacccgtattccggaaacggtccgggcgtacgggaccgggtacgtcggtacggggaacctaggttacctttaccgaccttcctaccgaaccctagttaccgaacgaccacggtcccgttagaaccgtaacggtaacgttaaggaaagggttcggttacggggttacggaccgtttttaaaggttttaacctttacgttaggtacctaacggtaaacttaaagtttaagtttacgggttaacgggtttaaccggttccccggttcgggttcccgtttaaacccggtttacgggttttaccccggggggaaggggttaaaccggggtaaaccggtaaagggggtttaacggaaacgggttacgttaaacggaacgggttaaccggttaaaccgggg

SEQ ID NO: 299615 - DNA, 584 bp, Homo sapiens
  misc_feature: GZ8MTXP01DIJYF.38.23.C01.1.454.CMB.2.raw
  modified_base (304)..(304): a, c, t, g, unknown or other
  misc_feature (304)..(304): n is a, c, g, or t
  modified_base (320)..(320): a, c, t, g, unknown or other
  misc_feature (320)..(320): n is a, c, g, or t
  modified_base (329)..(329): a, c, t, g, unknown or other
  misc_feature (329)..(329): n is a, c, g, or t
  modified_base (339)..(339): a, c, t, g, unknown or other
  misc_feature (339)..(339): n is a, c, g, or t
  modified_base (353)..(353): a, c, t, g, unknown or other
  misc_feature (353)..(353): n is a, c, g, or t
  modified_base (360)..(360): a, c, t, g, unknown or other
  misc_feature (360)..(360): n is a, c, g, or t
  modified_base (386)..(386): a, c, t, g, unknown or other
  misc_feature (386)..(386): n is a, c, g, or t
  modified_base (391)..(391): a, c, t, g, unknown or other
  misc_feature (391)..(391): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcttgggttttccttgttgcttattttagaaggtgtccagtgtgaggtgctagttggtggaatcgtaggggtaaacttggtcagccgtgggggtcctgagctctcctgtgcagcctctggattcatattagtatcattggatgtagttggtccncagctcgagggacggntggagtggngcatataacngatgaatagaaaanctaatgnggactgtagtagaggcatccacgtcncaganacacgacaagatcactgttattagactaaagtcgaaacacgacctagaagacgtacgaaacgaccgacggtacctaattaattaaatttagttaggtaaagttaaaacggtaaattcttaaagtttcgttaaagtttaaggtagggtaacggtacccgggtaagggttaccggggttcggttaacgtttaagg

SEQ ID NO: 299616 - DNA, 646 bp, Homo sapiens
  misc_feature: GZ8MTXP01BU3RC.38.23.C01.1.454.CMB.2.raw
  modified_base (306)..(306): a, c, t, g, unknown or other
  misc_feature (306)..(306): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtagggggaaacttagtccaggccgtggggggtccctgagctctcctgtgcagcctctggattcatattagtaatcaattggatgagttggtccncaggctccgagggacgggctggagtgggtggccacgtaataaaccacgatggaaactagaaaaagctaatgtggacttcgtggtggaaacggggcctattccaccggttcctaccgaagaacggaaccaaacggacccaaagtaacttcaacttagttaatttagacaaagttacgaaacgacgacccgtaggaacgacggtacgaaaacggcaaaccgggacctaatattaaactttaatttacgggtaattaaaacggtattaccttaagtttcggaaattaagggtagggttcgggaacggtacggggttaaccgggggtggttaaccgtttaaggg

SEQ ID NO: 299617 - DNA, 570 bp, Homo sapiens
  misc_feature: GZ8MTXP01AYNIJ.38.23.C01.1.454.CMB.2.raw
  modified_base (336)..(336): a, c, t, g, unknown or other
  misc_feature (336)..(336): n is a, c, g, or t
tcagtcgatcacgtcacgaccggtgctcgatttagtacacgtgattagggattgggggtctcagagaggagccttagccctggactccaaggcctttgcacttggtgatcagtactgagcacagaggactcaccatggaattggggctgagctgggttttccttgttgctattttagaaggtgtccagtgtgaggtgcagttggtggaatctgggggaaacttggtccagccgtggggggtccctgaagctctcctgtgcagcctctggattcattattagtaatcattggatgaggttggtccgcaggctcgaggggacggggctgggagtgggnggccactaataaaccacgatcggaaactagaaaaagctatagtgggaactcgtggtagaaggggccgtattcgaccgtctaccagacgacaacgcaaagatcactcgtattagacaaatggaacagcctgagagtacgaagacacggccaagtataattaattagttagtaaaagatactaattcgattagtaagggtggaacgtacggtacggggttggtcgttaagtttcgg

SEQ ID NO: 299618 - DNA, 592 bp, Homo sapiens
  misc_feature: GZ8MTXP01BVKLV.38.23.C01.1.454.CMB.2.raw
  modified_base (501)..(501): a, c, t, g, unknown or other
  misc_feature (501)..(501): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagcctgggggtccctgagctctcctgtgcagcctctggattcatattagtaatcattggatgagttgggtccgcaggctccgagggacgggctggagtgggtggccacgtaataaaccacgaatgggaaactagaaaaaagactaaatacggtggactcgtggtaggaaacggggccgatttccaaccggttctacccgagacgaccaaacgaccaaagtaacttcacttgtactttagacctaaagtgaactagacctagagagtacgaaanacgacgaccaatataatttaattagttaagttaaaagtatacgttaattcgataagttgggcgggacgtagggttaccgggtggcgttaag

SEQ ID NO: 299619 - DNA, 733 bp, Homo sapiens
  misc_feature: GZ8MTXP01EH13J.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcgtggtttctgttgctattttagaaggtgtcagtgtgaggtgcagttggtggaatcgtgggggaaacttggtcagccgtggggggtccctgagctctcctgtgcagcctctggattcatatttagtaatcaatttggatggagttgggtccgcaggctccggagggggacgggggcttgggaggttgggggtcggacctaactaataaaaccccgaggaacgttacgggaaacttaggaaaaaaagccttaaagtggtggaccttgtaggtaggaaacgggggtccctagtttcccgaacccggttctacccgaaggaacggaaccaaaccggaaccctaaaggtaaactttccgtaacttagttaatttttaggaaaccctaaaagttacggaaactaacgaccgttaaggacgaaggttaaccggaaaacggaccgtaaccgggaaccctaagttaaattaaattttaagtttaggtaaagttaaaaaacggtattaaccgttaaagtttacgttaagttaaggttgggggttcggggacgggtaacggggttaccgggggtaagggttccgtttaaggg

SEQ ID NO: 299620 - DNA, 558 bp, Homo sapiens
  misc_feature: GZ8MTXP01A70A5.38.23.C01.1.454.CMB.2.raw
  modified_base (371)..(371): a, c, t, g, unknown or other
  misc_feature (371)..(371): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctctgggcgagaggccaccatcaactgacaagtccagccagtagttcttttgtcagctaccaaagaatatgagttcgttagcttggtaccagcaagaaagcaacgacacgtcccctaagttgctactatttatggtcatctacgtcgggtcgtcccggggtcctgaccgtatcgagcgacagcgatcgngggacagtacttcactctcaccatcagcacgcctgcagactagaagtagtggggtcggtacttaagtttattaccgtgtactaagtactaaattattagtggtaccgtccgtcgttcttacgttacggtttcgggcggaagggaccgttaagggtggactaagtacgaagttccgtaacgttggcgg

SEQ ID NO: 299621 - DNA, 577 bp, Homo sapiens
  misc_feature: GZ8MTXP01CZ2AD.38.23.C01.1.454.CMB.2.raw
  modified_base (293)..(293): a, c, t, g, unknown or other
  misc_feature (293)..(293): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctctgggcgagaggccaccatcaactgcaagtccagccagagtctttgtcagctccaaagaatatgagttcgtagcttggtacagcagaaagcagacagtcccctaagttnctactattatgtctatactacgtcggtcggtccggtccgtccgacgtactcgcgcgacgacgcgacgtcgtaggacgagtacttctactactacacactacacgacacgctcgacacgacgtagaagagtgggtgtacgtaagtttaagttacgtacgtacgtacgtaactaaattaattagttaggttacgtccgtcggttcgtcgttaccgttaccggtacgggaacgggacggttaaacgggtaaggtaagtaacgtacgaacgacgtaacgttcggtcgg

SEQ ID NO: 299622 - DNA, 587 bp, Homo sapiens
  misc_feature: GZ8MTXP01BSCXQ.38.23.C01.1.454.CMB.2.raw
  modified_base (380)..(380): a, c, t, g, unknown or other
  misc_feature (380)..(380): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtgggggtccctgagctctcctgtgcagcctctggattcatatttagtaatcagttggatgagttgggtccgcgaggctccgaggggacggggctgggaggtgggtcggccactaataaaccacgagtaggaactagaaaagctaangtggactcgtgtgagggccgattcaccgtctccagacgacaacgaccaagacttacacttgtatttagactaaagtacgaaacgtacgccgtaggagagtaccgaaagaccacgggacctattattaattagttagtaaagttaaaagtattacttaagttcgattaagtgggtcgggcggtacgggttacgggtggttcgttaagg

SEQ ID NO: 299623 - DNA, 746 bp, Homo sapiens
  misc_feature: GZ8MTXP01B4R27.38.23.C01.1.454.CMB.2.raw
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctgtggcgaggacggccacatacaactgacaacgtccagaccaagtacgtttcttttgtacacgtcctacgaaagtaattagtaggttacggtttcgtaaggtcgtttacggaacccaggacgaaaggtaaacgacccgaaccggaaccttacccggttacccccgtttaaaggtttcgacccctttacgtttaattttaggtttaccggtactaacgtttccgttaccgggttccgggttcgggttcccggggttccctacggaccgtattcgacgtcgggaacaggccggtattcggacggggtaaacaggttacttcctactcctacacctagcgagtactacggtcctgacgaagtacgtaagaagtacgttggggtcggttaatttaacggtttaacttgtacgtaccgagtaacttaattaggtttaccgtagggttacctcccggtcgttaccgttcgttacgggtttaccgggaacgggggttaaccggttacggttagggtaagggtaaccgtaagttaaccggaaggttaccggtaacgtttcgggggtaaccg

SEQ ID NO: 299624 - DNA, 565 bp, Homo sapiens
  misc_feature: GZ8MTXP01BGOC0.38.23.C01.1.454.CMB.2.raw
  modified_base (347)..(347): a, c, t, g, unknown or other
  misc_feature (347)..(347): n is a, c, g, or t
  modified_base (358)..(358): a, c, t, g, unknown or other
  misc_feature (358)..(358): n is a, c, g, or t
  modified_base (400)..(400): a, c, t, g, unknown or other
  misc_feature (400)..(400): n is a, c, g, or t
tcagtcgatcacgtcacgaccggtgctcgatttagtacacgtgattagggattgggggtctcagagaggagccttagccctggactccaaggcctttgcacgtggtgatcagcactgagcacagaggactcaccatggaattggggctgagctgggttttccttgttgctattttagaaggtgtccagtgtgaggtgcagttggtggaatcgtgggggaaacttggtccagccgtgggggtccctgagctctcctgtgcagcctctggattcatatttagtaatcattggatgagttggccgccaggctccgaggggacgggctggagtggtggccactataaaccncgatggaaacngaaaaagctaatgtggactctgtgaagggccgattcaccgtntaccagagacaacgaccaaagtacttcactagtatttagacaaagtagaaacagacccttagagacgtacgaacgaacgaccggaccaagttaataatttaattggtaaaggttaaagatacttaagttcgataagtggtgacggtacggttacgggtgcgtaag

SEQ ID NO: 299625 - DNA, 593 bp, Homo sapiens
  misc_feature: GZ8MTXP01BXG3I.38.23.C01.1.454.CMB.2.raw
  modified_base (393)..(393): a, c, t, g, unknown or other
  misc_feature (393)..(393): n is a, c, g, or t
  modified_base (411)..(411): a, c, t, g, unknown or other
  misc_feature (411)..(411): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctcgtgggcgagacgggccaccatcaactgacaagtccagccagagttcttttgtcagctacaaagatatgtagttcgtagcttaggtaccagacaagaaagcaacgacacgtacccctaagttcgacttactatttagtcggtactatccgttacggtcgggttcggtcccggggtccctggaccgtattcgacggcgacaggcgatcgngggactagtcttcactcncacatcacgcacgcctgaccagacgtagaagtagtggtaggtacttagtttacttagcggttacagtactaaattactttagtcggttaacgtccgtacgttcttaccgttacggtttcggggcgggttaacgggttacgttaagggtgggagtaagtaccggagttacgaacgttggtcgg

SEQ ID NO: 299626 - DNA, 759 bp, Homo sapiens
  misc_feature: GZ8MTXP01DFQKU.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcttgggttttccttgttgctattttagaaggtgtcagtgtgaggtgcagttggtggaatcgtagggggaaacttggtccagccgtgggggtccctgaagctctcctgtgcagcctctggattcatattagtaatcattggatggagttcgggtccgcgaggctccgaggggacggggctgggagggtgggtcggacctaactaaacgtaaacccgacggtaacttaacgggaaaactaaggaaaaaaagtaccttaaagtggtcgggtaacttacgtagggttagggaaaccggggtccgtaatttcccgaacccgtcgtaccgaagggaacgaaccaaaccgaacccgtaaaaggtaacttaccgtaaccgttaagttaagtttacgaaaccttaaaaaagttcggaaaacgtacgtacccggttaaggaacggtaaacggttaccgaaaacggaccgaaaccggtaccctaaattaaagttaattttaaagtttaggttaaaacggttaaaaagtaagtttaaccttaaagtttcgttaaagttaaggtaggggttaacggtaacggggtaacgggttaccgggggttgggttaaccttttaaggg

SEQ ID NO: 299627 - DNA, 530 bp, Homo sapiens
  misc_feature: GZ8MTXP01B0VHS.38.23.C01.1.454.CMB.2.raw
  modified_base (346)..(346): a, c, t, g, unknown or other
  misc_feature (346)..(346): n is a, c, g, or t
  modified_base (498)..(498): a, c, t, g, unknown or other
  misc_feature (498)..(498): n is a, c, g, or t
  modified_base (508)..(508): a, c, t, g, unknown or other
  misc_feature (508)..(508): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagcctggggggtccctgagctctcctgtgcagcctctggattcatatttagtaatcattggatgagttgggccgcaggctccgagggacgggctggagtgggtggccactataaaccncgactaggaactagaaaaagtctaaatgtggactcgtgtgaagggccattcaccgtctccgagagacaacgaccaagaattcacttgtatttgactaaagtgaacagcctagagagtcgaagacacggccatataattattgtagttaaagntcattcgatntggtgcgaggttcgggtgcgtg

SEQ ID NO: 299628 - DNA, 542 bp, Homo sapiens
  misc_feature: GZ8MTXP01AE54P.38.23.C01.1.454.CMB.2.raw
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctctgggcgagacggccaccatcaactgacaagtccagccagagtcttttgtcagctacaagatatgagttcgtagcttggaccagcagaaagcacgacacgtcccctaagtgctctatttatgtcattctacgtcgggtcgtccgggtcctgaccgtattcgagcggacaggcgtatcgtagggacagtacttcactctacaccatacagcacgctgacagactagaagatggtaggtactagtttactacgtcgtcacgtactaaattagttagtcggtacgtccgtcggttctcgttacgtttacgggcggaagggaccgttagggtgagtaacgtacgaacgcgtaacgttggtgg

SEQ ID NO: 299629 - DNA, 627 bp, Homo sapiens
  misc_feature: GZ8MTXP01BWIGY.38.23.C01.1.454.CMB.2.raw
  modified_base (395)..(395): a, c, t, g, unknown or other
  misc_feature (395)..(395): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagccgtacggggacatcgtgatcgacccagtctccagacctccctggctgtgtctcgtgggcgagacgggccaccatcaactgacaagtccagccagtagttcttttgtcagctacaaagtatatgtagttcgtagcgttggtaaccagacaagaaagcaacgactacgtacccctaagtcgtctatatttagttggtactattccgtacgtcggggttaccggtcccccggggtcctagaccgtatcgaacggccgngacgcggactcggtagggactagtacttcactctaccacctatcacgtcacgtccagcaagtactaggaaagtgttaggtcgtacgttaagtttactacgtgtaccgatacttaagtagtttagaacgggttacgttccgttcgggctttaccggtacgggttcccgggggaaggggttaaccgggtaaccggtaaggggtggtaagaccgttaggtaacgggcggttaacg

SEQ ID NO: 299630 - DNA, 548 bp, Homo sapiens
  misc_feature: GZ8MTXP01DJX4T.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagccgtgggggtccctgaagctctcctgtgcagcctctggattcatatttagaatcattggatgagttgggtccgccaggctccgaggggacgggggctgggagtggggtggccactataaaccacgatggaaactgaaaaaagctaatgtggactctgtgaagggccattccaccgtctccagacgacaacgaccaaagaacttcactgtatttgacaaatgaaacagcctaggagagtacgaaagacacggccaatataattattgtagttaaaagatcagttcataagtggtcggcggacggttacgggtggctaag

SEQ ID NO: 299631 - DNA, 528 bp, Homo sapiens
  misc_feature: GZ8MTXP01BUNR3.38.23.C01.1.454.CMB.2.raw
  modified_base (272)..(272): a, c, t, g, unknown or other
  misc_feature (272)..(272): n is a, c, g, or t
  modified_base (409)..(409): a, c, t, g, unknown or other
  misc_feature (409)..(409): n is a, c, g, or t
  modified_base (434)..(434): a, c, t, g, unknown or other
  misc_feature (434)..(434): n is a, c, g, or t
  modified_base (484)..(484): a, c, t, g, unknown or other
  misc_feature (484)..(484): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctctgggcgagaggccaccatcaactgcaagtccagccagagtctttgtcagctcaaagatatgagttctagcttggtaccagcagaaancacgacagtcccctaagttgctcaatttatggtcatctacttcgggtgtccggggtcctgaccgtatcgagcgacagcggatcgtgggacagtactttcactctcacctatcagcaacgcctgcagactagaaagtntggggtggtctaagtttacttacgngtacgagactaatattagtgtacgtcctcggttcttacgacgtttccggnggttaacgggccagggtaagagtaatacaagcgtaacgttgtgg

SEQ ID NO: 299632 - DNA, 643 bp, Homo sapiens
  misc_feature: GZ8MTXP01D9IH3.38.23.C01.1.454.CMB.2.raw
tcagtcgatcacgtcacgaccggtgctcgatttagtacacgtgattagggattgggggagctacaacaggcaggcaggggcagcaagatggtgttgcagacccaggtcttcatttctctgttgctctggatctctggagccgtacggggacatcgtgatgacccagtctccagacctccctggctgtgtctcgtgggcgagacggccacatcaactgcaagtccagccagtagttctttgtcagtctacaaagtatatgtagttcgttagcttaggaccagacaagaaacgcaacgactacgtacccctaagttcgcttactattttagttggtactatttccgtaccgttcgggggtccgtccccccgggggttccctacggtaccgtattccgaaacgggccggcgaggtccgggtatcgggtaggggacctagttactttccactctacactatacagcagcctggccaagtactagaaggtgttggtaggtacttagttttacttcgtgtacctgtactaattaacaagtttaaccgtcggttcccttacggttacggtcggttaccgggttcgggccggttaacggggtaaccgtaagggtaacggtaaaactaccggaaaacgtcgttggtaaccgg

SEQ ID NO: 299633 - DNA, 562 bp, Homo sapiens
  misc_feature: GZ8MTXP01A4IYC.38.23.C01.1.454.CMB.2.raw
  modified_base (458)..(458): a, c, t, g, unknown or other
  misc_feature (458)..(458): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctcgtgggcgagagggccacatcaactgcaagtccagccagagttctttgtcagctacaagatatgagttcgtagcttggtaccagcagaaagcacgacacgtcccctaagtgctactatttatggtcatctacgttcgggtcgtcccggggtcctgaccgtatcgagccggacaggcggatcgtagggactagactttcactctcacatcagcacgcctgacagactagaagtagtgggtaggtacttagtttactacgtgtcagtactaaattnttagtggtactccgtcggttctaccgttacggttcgggacgggacgggaccgttaagggtcgggagtaacgtacggaacggttacggtaacgttcgggtaacgg

SEQ ID NO: 299634 - DNA, 561 bp, Homo sapiens
  misc_feature: GZ8MTXP01ENQW9.38.23.C01.1.454.CMB.2.raw
  modified_base (338)..(338): a, c, t, g, unknown or other
  misc_feature (338)..(338): n is a, c, g, or t
  modified_base (493)..(493): a, c, t, g, unknown or other
  misc_feature (493)..(493): n is a, c, g, or t
  modified_base (518)..(518): a, c, t, g, unknown or other
  misc_feature (518)..(518): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggtttcctgttgctatttagaaggtgtccagtgtgaggtgcagttggtggaatcgtgggggaaacttggtccagccgtgggggtccctgaagctctcctgtgcagcctctggattcatattagtaatcattggatgagttggtccgcaggctccgagggacggggctggagtgggtggccatanaaaccacgataggaactagaaaagactaatgtggactcgtggtaggaacggggtcccgattccgaccgtctaccagacgaacaacgaccaaagtaacttacacttgtatttagacaaagtgaacagcctagagagtacgaaagacacggaccatnttaattattagtaagttaaagatanattcgattaagtgggtggacggagggttacgggtggcgttaag

SEQ ID NO: 299635 - DNA, 538 bp, Homo sapiens
  misc_feature: GZ8MTXP01B9AUX.38.23.C01.1.454.CMB.2.raw
  modified_base (446)..(446): a, c, t, g, unknown or other
  misc_feature (446)..(446): n is a, c, g, or t
  modified_base (491)..(491): a, c, t, g, unknown or other
  misc_feature (491)..(491): n is a, c, g, or t
tcagtcgatcacgtcacgaccggtgctcgatttagtacacgtgattagggattgggggtctcagagaggagccttagccctggactccaaggcctttgcacttcggtgatcagcactgagcacagaggactcaccatggaattggggctgagctgggttttccttgttgctattttagaaggtgtccagtgtgaggtgcagttggtggaatctgggggaaacttggtccagcctggggggtccctgaagctctcctgtgcagcctctggattcatatttagtaatcattggatgagttgggtccgccaggctccgagggacgggctggagtgggtggccatataaaccacgatggaactagaaaagctaatgtggactctgtagagggccgattccacgtctccagagacacgaccaagattcacttgtatttgacaaagtgaacngcctgagacgtcgaagcacggccatataattattgtattaaagtnttcagttcgaattaagtgggtggcggacggttacggggtgcgttaag

SEQ ID NO: 299636 - DNA, 603 bp, Homo sapiens
  misc_feature: GZ8MTXP01AKA4H.38.23.C01.1.454.CMB.2.raw
  modified_base (558)..(558): a, c, t, g, unknown or other
  misc_feature (558)..(558): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcttgggttttccttgttgctattttagaaggtgtcagtgtgaggtgcagttggtggaatcgtagggggaaacttggtccgagccgtgggggtccctgagctctcctgtgcagcctcgtggtattcatatttagtatcattggatggtagttggtccgcgaggcctcgaggggacgggggctggggaggtggggtcggaccctaactaacgtaaacccgacggaattacgggaaactaaagaaaaagtctaaagtggtcggtactacgttggtagggaacggggccgtaattcccgaccgtctaccgagacgaaccaacgacaaagtatcacttgtattgaactaaagtgaacgagaccgtgaacgtagacgaagcctacgacattaataattattagtaagaaactntacttagttcgatgtgggtaagacggaggttacgggtgcgttaag

SEQ ID NO: 299637 - DNA, 562 bp, Homo sapiens
  misc_feature: GZ8MTXP01C315O.38.23.C01.1.454.CMB.2.raw
  modified_base (284)..(284): a, c, t, g, unknown or other
  misc_feature (284)..(284): n is a, c, g, or t
  modified_base (306)..(306): a, c, t, g, unknown or other
  misc_feature (306)..(306): n is a, c, g, or t
  modified_base (309)..(309): a, c, t, g, unknown or other
  misc_feature (309)..(309): n is a, c, g, or t
  modified_base (401)..(401): a, c, t, g, unknown or other
  misc_feature (401)..(401): n is a, c, g, or t
  modified_base (408)..(408): a, c, t, g, unknown or other
  misc_feature (408)..(408): n is a, c, g, or t
  modified_base (421)..(421): a, c, t, g, unknown or other
  misc_feature (421)..(421): n is a, c, g, or t
tcagtcgatcacgtcacgaccggtgctcgatttagtacacgtgattagggattgggggacaacaggcaggcaggggcagcaagatggtgttgcagacccaggtcttcatttctctgttgctctggatctctggagcctacggggacatcgtgatgacccagtctccagactccctggctgtgtctctgggcgagaggccaccatcaaactgcaagtccagccagagttcttttgtcagctaccaaagaatatgagttcgttagcttaggtaccagacaagaaanccaacgacacgtcccctaagtnctntatttatgtctatcgtacgtcgggtcgtccggggtcctgaccgtatcgagcggcagcggatcgagggacagtacttcactctacaccatcancagcctnacagactagaagntggggtgtacttagtttatactgtacagactaattattagtggttactccgtcggttacttcgttaccggtttcgggacgggttaacgggaccgttaagggtaacggaagtaacgtacgaagttccgtaagttggtaacgg

SEQ ID NO: 299638 - DNA, 599 bp, Homo sapiens
  misc_feature: GZ8MTXP01EC4E8.38.23.C01.1.454.CMB.2.raw
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagagttcttttgtcagctaccaaagatatgagttcgttagcttggtaccagcagaaagcacgacagtcccctaagttgctctatttattggtcatcgtactcgggtcgtccggggtcctgaccgtattcgagcggcagcggatcgtaggggactaggtactttcactctcaccatcagcacgcctagcagactaggaaagtagtggggttacggtacgttaagttttacttaacgttggtacctaggtactaaattaatttaagttgggttaacgttcccgttcggttccgttacgttacgttttacggggacggggttacgggaccggttaaggggtaaggtaggaagttacgaaggttacgtaaacgttggtcggg

SEQ ID NO: 299639 - DNA, 567 bp, Homo sapiens
  misc_feature: GZ8MTXP01ASNXW.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggtttccttgttgctatttagaaggtgtccagtgtgaggtgcagttggtggaatcgtgggggaaacttggtccagccgtggggggtccctgaagctctcctgtgcagcctctggattcatattagtaatcattggatgagttggtccgcgaggctccgagggacggggctggagtgggtggccacgtataaaccacgactaggaactaggaaaaagctaaatgtggactcgtggtaggaacgggccgtattccgaaccgtctaccagacgaacaacgacccaaagaattcactgttatttagacaaagttgaaacagcctagagagtacgaaagcgacgacatataattagttgtaagttaaagatacagttcgataagtgggtgggcgtacgggttacggggtgcgttaagg

SEQ ID NO: 299640 - DNA, 579 bp, Homo sapiens
  misc_feature: GZ8MTXP01ADTVW.38.23.C01.1.454.CMB.2.raw
  modified_base (280)..(280): a, c, t, g, unknown or other
  misc_feature (280)..(280): n is a, c, g, or t
  modified_base (342)..(342): a, c, t, g, unknown or other
  misc_feature (342)..(342): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagacctcctggctgtgtctcgtgggcgagaggccaccatcaactgcaagtccagccagtattcttttgtcagctacaaagaatatgtagttcgtagcttaggtaccagcaagaancacgacacgtccctaagtgctctatttgtgtcatctacgtcggtcgtccgggtcctgaccgntcgagcgacaggcgtatcgtagggactagtactttcactctcacatcagcacgcctagacgacgtactaggaagtagtcgggtacggtacttaaggttttaactacgtgtacgtaatactaaagttgtttaacgtcggttaacgttccgtcggttccttacgttacggtttcggggacggttaacgggttaccttaaggggtgtagaacgtaacgacggacgtaacgttggtaaccg

SEQ ID NO: 299641 - DNA, 612 bp, Homo sapiens
  misc_feature: GZ8MTXP01ESXST.38.23.C01.1.454.CMB.2.raw
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctcgtgggcgagacggccaccatcaactgacaagtccagccagtagttcttttgtcagctacaaagatatgtagttcgttagcttaggtaccagacaagaagcacgacacgtcccctaagtcgctactatttagtgtctattctacgttcgggtcgtcccgggtcctgaccgtatcgagtccggacacggcggtatcgtacgggactaggttacttcaccttcctaccaacctagtccacggcaacgcccgttagaccgaagtacgtagaaagtgttggggtacggttactttaaggtttactacgtgtacgtagtaacttaattagtttagtcgggtacttccgtcggttcctcgttaccggttcgggaacgggttacgggacggttaagggtggaacgtaacgtaccgaaggccgtaagttcggaacg

SEQ ID NO: 299642 - DNA, 714 bp, Homo sapiens
  misc_feature: GZ8MTXP01CGJ9N.38.23.C01.1.454.CMB.2.raw
  modified_base (344)..(344): a, c, t, g, unknown or other
  misc_feature (344)..(344): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcttgggttttccttgttgctattttagaaggtgtccagtgtgaggtgctagttggtggaatcgtagggggaaacttggtccagccgtggggggtccctgaagctctcctgtgcacgcctctggattcatattagtaatcattggatgtagttggccgcgaggctccgaggggacggggcgtgggaggtggggnggcccaactaacgtaaaccgacgtaacgtaggaaactaagaaaaaacgacgttaaatggtcgggactcgtgggtacggaaacgggtcccgtaattcccgacccgttcaccgaagaacgaaccgaaaccgaacctaaaagtaaacttaccaacgttagttaatttacggaacctaaaaggttacggaaacgtacgtaccgtaaggaacgtaacggtaaccggaaaacgaaccgaaccgggtaacccttaaattaagtttaaatttaagttttaggtaaagttaaaaaggtactttacgttaagtttcgttaagttaacggtagggttaacgggacgggtacgggttaccggggtaagggttcgtttaacgg

SEQ ID NO: 299643 - DNA, 515 bp, Homo sapiens
  misc_feature: GZ8MTXP01C1JE0.38.23.C01.1.454.CMB.2.raw
  modified_base (277)..(277): a, c, t, g, unknown or other
  misc_feature (277)..(277): n is a, c, g, or t
  modified_base (408)..(408): a, c, t, g, unknown or other
  misc_feature (408)..(408): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctctgggcgagaggccaccatcaactgcaagtccagccagagtctttgtcagctccaaagaatatgagttcgttagcttggtaccagcaagaaancagacagtcccctaagtgctcatttatgtctatctacgtcgggtcgtccggggtccctgaccgtattcgagcgcagcggatcgtgggactagtactttcactctcacatcagcagcctgcagactagaagntggtggtctagtttatactgtcagactaatattatcggtagtccgtcgcttcgacgtttcgggcggacgggttccgaaggtggagcgtacgagacgtaacgttgtgg

SEQ ID NO: 299644 - DNA, 547 bp, Homo sapiens
  misc_feature: GZ8MTXP01CGZZU.38.23.C01.1.454.CMB.2.raw
  modified_base (303)..(303): a, c, t, g, unknown or other
  misc_feature (303)..(303): n is a, c, g, or t
  modified_base (457)..(457): a, c, t, g, unknown or other
  misc_feature (457)..(457): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagccgtggggggtccctgaagctctcctgtgcagcctctggattcatatttagaatcattggatgagttggtccncaggctccgagggcgggctggagtgggtgccactataaacacgatggaactagaaaaagctaatgtggactcgtgtagaagggccgattcaccgtctccagagacaacgaccaaagaattcactgtattgacaaagtgaaacagtaccagacgngtacgaaagacaacggccatataattaattgaagttaaaacgatcagttcgattaatagggttggacgaaggttaccggggtgcgttaag

SEQ ID NO: 299645 - DNA, 666 bp, Homo sapiens
  misc_feature: GZ8MTXP01CFBOY.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtagggggaaacttggtccaggccgtggggggtccctgagctctcctgtgcagcctctggattcatattagtaatctattggatggtagttgggcccgccgaggctccggaggggacggggcgtgggaggtgggtggaccaacgtaataaaccgacggtaatacgggaaaacgttaggaaaaaaacgcgtaaagttcggtgggtaacttcgtgggtaggaacggggtcccggtattccgaacccgttcctccgaacggaacgaccgaaaccggaccaaagtaacttccaacttagtatttacgaactaaacggttagaaaccgagtaccctagaacgtaagtacgaaagaccgaacggcctaattaattaattaagttaggtaaaggttaaaagtatacttagttcgttagttaagtacgggttggaacgtagggttacgggtggttgttaacgg

SEQ ID NO: 299646 - DNA, 602 bp, Homo sapiens
  misc_feature: GZ8MTXP01A01GU.38.23.C01.1.454.CMB.2.raw
  modified_base (406)..(406): a, c, t, g, unknown or other
  misc_feature (406)..(406): n is a, c, g, or t
tcagtcgatcacgtcacgaccggtgctcgatttagtacacgtgattagggattggggacaacaggcaggcaggggcagcaagatggtgttgcagacccaggtcttcatttctactgttgctctggatctctggagcctacggggacatcgtgatgacccagtctccagactccctggctgtgtctcgtgggcgagaggccaccatcaactgcaagtccagccagtagttcttttgtcagctaccaaagatatgattcgtagcttggtaccagcaagaaagcacgacacgtcccctaagtcgctctatttatggtcattctacgttcggggtgtcccggggtcctcggaccgtattcgaggcgacagcggatcgagggacagtatttcactcctacaccatcgaacnctacgcctagaccagactaggaagtagtcggggtaggtaccttaaggttttacttacgtcgtacgtagacttaaattagttagttcgggtacgtcccgttcgggttcctaccgttccgtttacggggcggggttaccggggaaccgttaaggggtgggaagtcgtaacggacggttaaccggtaagttcgggtcgg

SEQ ID NO: 299647 - DNA, 702 bp, Homo sapiens
  misc_feature: GZ8MTXP01AXUEA.38.23.C01.1.454.CMB.2.raw
  modified_base (303)..(303): a, c, t, g, unknown or other
  misc_feature (303)..(303): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtgggggtccctgagctctcctgtgcagcctctggattcatatttagtaatcattggatgagttggtccncaggctcgaggggcgggctgggaggtggggtcggacctaacgtaataaaacccgacggtaagtagggaaaactaaggaaaaaacgtactaaagtggttggactcgtggtacgggaacggggcctattcccaccgtctaccaaggacgaaccgaaccgaccgaaagtaacttaccgacttagttaatttacggacctaaaagttacggaaaccgtacgtacccgttaaggaacggtaacggtaaccgggtaaacgaccgtaaccgggtaacctaagtttaaattaaacgttttaagtttacggttaaagttaaaaaggtattaccgttaaagtttcgttaaagttaaggttcggggtaaggtccggggtaccgggttagggggtcgttaacgtttaaggg

SEQ ID NO: 299648 - DNA, 607 bp, Homo sapiens
  misc_feature: GZ8MTXP01EIHPF.38.23.C01.1.454.CMB.2.raw
  modified_base (340)..(340): a, c, t, g, unknown or other
  misc_feature (340)..(340): n is a, c, g, or t
  modified_base (355)..(355): a, c, t, g, unknown or other
  misc_feature (355)..(355): n is a, c, g, or t
  modified_base (566)..(566): a, c, t, g, unknown or other
  misc_feature (566)..(566): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaggtgtccagtgtgaggtgctaggttggtggaatcgtaggggggaaacttggtccaggtccgtggggggtccctgagctctcctgtgcagcctctggattcatattagtaatcattggatggagttgggtccgcaggctccgaggggacgggctggagtgggnggccataataaaccncgatggaaactagaaaaagctaaagtgtgggactcgtaggtaggaacggggccgtatttcccgacccgttctacccaaggacgaaccaacgacccaaagtaacttccaacttagttatttacgaactaaaggttacgaaacgacgtacccgtagaaggaacgtacggaaaacgacgaccggacctaatataattagttagtaagttaaagntacagttgatgtggcggtcgacggttagggtcgctttaagg

SEQ ID NO: 299649 - DNA, 786 bp, Homo sapiens
  misc_feature: GZ8MTXP01CURO1.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcttgggttttccttgttgctattttagaaggtgtcagtgtgaggtgctaggttggtggaatcgtagggggtaaacttggtccgaggccggtcgggggtccctgaagtctctcctgtgcacgcctctggtattctatatttaagtaatctagttggtatggtaggttcgggtcccgcgacggtccgtaccgggagggggaccgggggtcgtaggggtagggttcgggggtacggaccctaaacgttaaacgtaaacccgacgtaaacgtacgggtaaaacgtaaggaaaaaaacggtacttaaagttagggttcggtacttacgtagggttacgggaacggggtcccgtaacgttacccgtacccgttccaaccgaacggaacgaaacccgaaaccgggtaacccctaaaaggttaaacttaccgtaacgttagtttaacgtttaacgaaacctaaaaggttaccgaaaacgttaacggaccgttaaggaacgtaacggtaacggaaaacgaccgaaccggtactaaattaatttaagtttaagttaaggttaaattaaaggttactcgttaaacgttgttaaagttaaggtcggggttcggtacgggtacggttacggggtaacgcgttttaacg

SEQ ID NO: 299650 - DNA, 609 bp, Homo sapiens
  misc_feature: GZ8MTXP01EAKE3.38.23.C01.1.454.CMB.2.raw
  modified_base (306)..(306): a, c, t, g, unknown or other
  misc_feature (306)..(306): n is a, c, g, or t
  modified_base (329)..(329): a, c, t, g, unknown or other
  misc_feature (329)..(329): n is a, c, g, or t
  modified_base (341)..(341): a, c, t, g, unknown or other
  misc_feature (341)..(341): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcttgggttttccttgttgcttattttagaaggtgtccagtgtgaggtgctaggttggtggaatcgtagggggtaaacttggtccagccgtggggggtccctgagctctctgtgcagctctgattcatattagatcattggatgtagttcgggccncgaggctcggagggggacggggntgggaggtgggngacctaactaactaaaccgacgtagtaggaaactaagaaaaagtctaaatgtcggactcgtggtaggaacggggctacttccaccgtctaccgaagaacgaaccaaacgacctaaagtaacttcaacttgttaatttagaactaaagtagaactagcctagagtagtacgaagacacgactaatattaattagttagtaaagttaaaagactattagttgttataagtgggtaacggtacggtacgggttacgggtcggttctttaag

SEQ ID NO: 299651 - DNA, 645 bp, Homo sapiens
  misc_feature: GZ8MTXP01B32B6.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcttgggttttccttgttgctattttagaaggtgtccagtgtgaggtgcagttggtggaatcgtagggggaaacttggtccagccgtggggggtccctgaagctctcctgtgcagcctctggattcatatttagaatctagttggatgtagttgggtcccgcgaggcctcgaggggacggggctggaggtgggcggaccaactaactaaaccgacgaataggaaactaagaaaaaagctaaatgtcgactcgtaggtaggaacgggccgtatccgacccgttctacccgaagacgaaccaacggaccaaagtaacttacacttagttaactttagaacctaaaagtcgaaaccgtacgtacccgtaggaagtacgtaacggaaacgaccgtaaccggacctaagttaattaattaagtttagtaaagttaaagtattcttaagttgattaagtggggtcggacggtacggttaccggggttggaaccgtttaagg

SEQ ID NO: 299652 - DNA, 666 bp, Homo sapiens
  misc_feature: GZ8MTXP01DF8BT.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcttgggttttccttgttgcttattttagaaggtgtccagtgtgaggtgctagttggtggaatcgtgggggaaacttggtcagccgtgggggtccctgagctctcctgtgcagcctctggtattcatatttagtaattcagttggatgtaggttggccgcgaggctccgagggggacgggggctgggaggttggggtcggaccaacgttaaactaaaacccgcggaagttacgggaaaacttaggaaaaaaacgtcttaaagttggtcgggtacttcgttagggtacggaaacggggtcccgtattaccgtacccgttctacccgaagaacgaacgaaaccgaacaaacgtaattccaattacgttatttagactaaagtagaacgacgccttaggaagtacgtacgaaacgcgaacggtaccaattattaatttagttagtaaagttaaaagattaccttagtttcgaattaaggtgggtcggacggtaccggttaaggggtgaacgttttaagg

SEQ ID NO: 299653 - DNA, 581 bp, Homo sapiens
  misc_feature: GZ8MTXP01DXSBT.38.23.C01.1.454.CMB.2.raw
  modified_base (253)..(253): a, c, t, g, unknown or other
  misc_feature (253)..(253): n is a, c, g, or t
  modified_base (416)..(416): a, c, t, g, unknown or other
  misc_feature (416)..(416): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagacctccctggctgtgtctcgtgggcgagagggccacatcaactgcaagtccagccagtagttctttgtcagctacaagatntgtagtcgtagcttggaccagcaagaagcaacgacacgtcccctaagttcgacttcgtattttacgttggtactagttccgtacgtcgggggttccggttcccccgggggtccctaggacccgtattcgaacgcggcaggcgggatcgagggacagtacttcnctctcaccatcgagcacgtccagcgagaacgtagaaggtagttggtacgtacgttagtttacttcgttgtacctagtactaattagttaagtcggttacttccggtcgttcgtctcggtttcggcgggacggtaacgtagggtcgaagcgttacgaacgcgtaag

SEQ ID NO: 299654 - DNA, 626 bp, Homo sapiens
  misc_feature: GZ8MTXP01BZHSR.38.23.C01.1.454.CMB.2.raw
  modified_base (177)..(177): a, c, t, g, unknown or other
  misc_feature (177)..(177): n is a, c, g, or t
  modified_base (256)..(256): a, c, t, g, unknown or other
  misc_feature (256)..(256): n is a, c, g, or t
  modified_base (266)..(266): a, c, t, g, unknown or other
  misc_feature (266)..(266): n is a, c, g, or t
  modified_base (280)..(280): a, c, t, g, unknown or other
  misc_feature (280)..(280): n is a, c, g, or t
  modified_base (402)..(402): a, c, t, g, unknown or other
  misc_feature (402)..(402): n is a, c, g, or t
  modified_base (444)..(444): a, c, t, g, unknown or other
  misc_feature (444)..(444): n is a, c, g, or t
  modified_base (483)..(483): a, c, t, g, unknown or other
  misc_feature (483)..(483): n is a, c, g, or t
  modified_base (504)..(504): a, c, t, g, unknown or other
  misc_feature (504)..(504): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcgtggtttctgtgctatttagaggtntcagtgtgaggtgcagttggtggaatcgtgggggaaacttggtccaggccggtcggggtcctagactctctcgtgtgcncgcctgtgtntatatatagtactntagtggtatggtaggttcggccgtcgcggtcgaccgggacgggggacgggtcggtgggtaggtcgggtacggactaacgtaaacaacgacgtagtacggaaagtaagaaaacgtgttaaagnggtaacggtacgtcggtaggacggtacggtccgtacgtaccnccggtcaacgagacgaaccacgaacaagttactgtactnttaagtacaacagtacgaacngtgagagacgaagaaaccgtcgacgtactaatttataatttagttaccggtaaattaaagacttacgttagttacgttagttgggcggtcggtacggtacggggttacgtcgttaacgtttg

SEQ ID NO: 299655 - DNA, 557 bp, Homo sapiens
  misc_feature: GZ8MTXP01AESRX.38.23.C01.1.454.CMB.2.raw
  modified_base (231)..(231): a, c, t, g, unknown or other
  misc_feature (231)..(231): n is a, c, g, or t
  modified_base (248)..(248): a, c, t, g, unknown or other
  misc_feature (248)..(248): n is a, c, g, or t
  modified_base (470)..(470): a, c, t, g, unknown or other
  misc_feature (470)..(470): n is a, c, g, or t
  modified_base (489)..(489): a, c, t, g, unknown or other
  misc_feature (489)..(489): n is a, c, g, or t
  modified_base (513)..(514): a, c, t, g, unknown or other
  misc_feature (513)..(514): n is a, c, g, or t
  modified_base (524)..(524): a, c, t, g, unknown or other
  misc_feature (524)..(524): n is a, c, g, or t
  modified_base (537)..(537): a, c, t, g, unknown or other
  misc_feature (537)..(537): n is a, c, g, or t
  modified_base (540)..(541): a, c, t, g, unknown or other
  misc_feature (540)..(541): n is a, c, g, or t
  modified_base (545)..(545): a, c, t, g, unknown or other
  misc_feature (545)..(545): n is a, c, g, or t
  modified_base (557)..(557): a, c, t, g, unknown or other
  misc_feature (557)..(557): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctctgggcgagacggccaccatcaactgcaagtccagccggatgtttanacaactcaagaataagngttcttagcttggaccagacaagaaaccacgacagcctactaagctgctcgtttactgggccctacgtacccgggtaatcccgggggtaccctagaaacgattcgaggtcgggccggcgggtctaggggacctaaggtaacttttccaactcctacaacccaattccgaagccagccgtggcgggctagaagagtgtaggttacggtttattactgtacagntagtattatagttactctnactagtttcgcgtacgggacaagnngagattcganaaccgaagttggngcnncacncttctcgttctn

SEQ ID NO: 299656 - DNA, 569 bp, Homo sapiens
  misc_feature: GZ8MTXP01EDQ2U.38.23.C01.1.454.CMB.2.raw
  modified_base (326)..(326): a, c, t, g, unknown or other
  misc_feature (326)..(326): n is a, c, g, or t
  modified_base (344)..(344): a, c, t, g, unknown or other
  misc_feature (344)..(344): n is a, c, g, or t
  modified_base (363)..(363): a, c, t, g, unknown or other
  misc_feature (363)..(363): n is a, c, g, or t
  modified_base (526)..(526): a, c, t, g, unknown or other
  misc_feature (526)..(526): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtagggggaaacttggtccagccgtgggggtccctgagctctcctgtgcagcctctggattcatattagtaattcattggatgagttggtccgcaggctcgagggacgggctggngtgggtgccatataaacncgatggaaactagaaaaanctaaatgtggactcgtgtagaaggggccagttccaccgtctaccagacgacaacgacccaaagtaatcacttgtatttagactaaagtacgaaacacgtccgtaggaagacggtacgaaacgaacgaaccggactaagtattaattattagtaagttaaaagnttacagttgataagtggtggcggacggttacgggtggcttaag

SEQ ID NO: 299657 - DNA, 606 bp, Homo sapiens
  misc_feature: GZ8MTXP01AQRMP.38.23.C01.1.454.CMB.2.raw
  modified_base (352)..(352): a, c, t, g, unknown or other
  misc_feature (352)..(352): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtgggggtccctgagctctcctgtgcagcctctggattcatattagtaatcattggatgagttggtccgccaggctccgagggacggggctgggagtggggtggccacgtataaacccngacgtaggaactagaaaaagctaaagtggtggactcgtagtaggaacggggccgtattccacccgtctacccgaaggagacccgaaacggacccaaaggtaaacttcgaacttagtatttagaccaaaacttgaaaccagacctagaagacgtaccgaaacgacgacggacctaataattaattaattagtaagttaaaagtatacttaagttcgataagtgggttggacggacggttaccggggtggcgtaag

SEQ ID NO: 299658 - DNA, 573 bp, Homo sapiens
  misc_feature: GZ8MTXP01EW6I9.38.23.C01.1.454.CMB.2.raw
  modified_base (349)..(349): a, c, t, g, unknown or other
  misc_feature (349)..(349): n is a, c, g, or t
  modified_base (426)..(426): a, c, t, g, unknown or other
  misc_feature (426)..(426): n is a, c, g, or t
  modified_base (527)..(527): a, c, t, g, unknown or other
  misc_feature (527)..(527): n is a, c, g, or t
  modified_base (544)..(544): a, c, t, g, unknown or other
  misc_feature (544)..(544): n is a, c, g, or t
tcagtcgatcacgtcacgaccggtgctcgatttagtacacgtgattagggattgggggtctcagagaggagccttagccctggactccaaggcctttgcacttggtgatcagcattgagcacagaggactcaccatggaattggggctgagctgggttttccttgttgctatttagaaggtgtccagtgtgaggtgcagttggtggaatcgtgggggaaacttggtccagccgtggggggtccctgagctctcctgtgcagcctctggatcatatttagaatcattggatgagttgggtccgccaggctccgaggggacgggggctgggagtggggtcggccacttaanaaaccacgataggaaactaagaaaaacactaaatgtgggactcgtagtaggaagggccgattccacgtctccaaganaacaacgaccaaagtaatcactgtaattacgacaaagtgaaacagcctagaagaggtacgaacgacacggacaataattaattaattgtaaagttaaaagntacattgataagtgggnggtacggacgggttacgggtgaagttaag

SEQ ID NO: 299659 - DNA, 574 bp, Homo sapiens
  misc_feature: GZ8MTXP01EXJYQ.38.23.C01.1.454.CMB.2.raw
  modified_base (262)..(262): a, c, t, g, unknown or other
  misc_feature (262)..(262): n is a, c, g, or t
  modified_base (286)..(286): a, c, t, g, unknown or other
  misc_feature (286)..(286): n is a, c, g, or t
  modified_base (307)..(307): a, c, t, g, unknown or other
  misc_feature (307)..(307): n is a, c, g, or t
  modified_base (327)..(327): a, c, t, g, unknown or other
  misc_feature (327)..(327): n is a, c, g, or t
  modified_base (567)..(567): a, c, t, g, unknown or other
  misc_feature (567)..(567): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcgtggttttctgttgctatttagaaggtgtcagtgtgaggtgctagttggtggaatcggtagggggaaacttgggtccgaggccgtgggggtccctgaagctctctgtgcngcctctggattcatattagtaatnattggatgagttgggtccgcnggcctcgaggggacggggtntgggacggtggggtcggcctaactaacgtaaaccacggtaatagggaaaactagaaaaaagctaaagtggtggactcgtggtagaacggggtccatttccacgtctacagagacaacgaccaaagtatacatgtattgacaaagtgaaacagcctagagacgtagaaacgcacgactatataatttaattgtaagttaaatatattagttcgatggtggtgggacgacgggttaggtggnttaacgg

SEQ ID NO: 299660 - DNA, 544 bp, Homo sapiens
  misc_feature: GZ8MTXP01BHKCV.38.23.C01.1.454.CMB.2.raw
  modified_base (260)..(260): a, c, t, g, unknown or other
  misc_feature (260)..(260): n is a, c, g, or t
  modified_base (349)..(349): a, c, t, g, unknown or other
  misc_feature (349)..(349): n is a, c, g, or t
  modified_base (372)..(372): a, c, t, g, unknown or other
  misc_feature (372)..(372): n is a, c, g, or t
  modified_base (445)..(445): a, c, t, g, unknown or other
  misc_feature (445)..(445): n is a, c, g, or t
  modified_base (456)..(456): a, c, t, g, unknown or other
  misc_feature (456)..(456): n is a, c, g, or t
  modified_base (483)..(483): a, c, t, g, unknown or other
  misc_feature (483)..(483): n is a, c, g, or t
  modified_base (503)..(503): a, c, t, g, unknown or other
  misc_feature (503)..(503): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtgggggtccctgagctctcctgtgcngcctctggattcatatttagtaatcattggatgagttcgggtccgcgaggctccgagggacgggctggagtgggtggccatataaaccncgatggaactagaaaagctaaangtgactcgtgtgaagggccgattcaccgtctccagacgacaacgaccgaatatcacttgtactttgacaagtnaacagcctagngagtacgaaacgactacggacctaatntaatttattgtaattaaagnttacagttcgatgtaggtggcgaggttacgggtgcgttaag

SEQ ID NO: 299661 - DNA, 568 bp, Homo sapiens
  misc_feature: GZ8MTXP01EDHOZ.38.23.C01.1.454.CMB.2.raw
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagacctccctggctgtgtctcgtgggcgagagggcccaccatcaactgcaagtccagccagagttctttgtcagctaccaagaatatgagtcgttagcttaggtacagcagaaagcaacgacacgtcccctaaagtcgctctatttattggtcattctacgtcgggtcgtccccgggtcctgaccgtattcaagcggcagcggatcgtagggacagtacttcactctcacatcagcagcctgacagactgaaggtattggtggactagtttataacgtgtacagtctaaattagttataagggttacgttcccgttcgggttaccttcgtaaccggtttcggggaccgggttaggggaacccgtaagggtcgggtaagagttacggaacgcggtaacg

SEQ ID NO: 299662 - DNA, 536 bp, Homo sapiens
  misc_feature: GZ8MTXP01BENRQ.38.23.C01.1.454.CMB.2.raw
  modified_base (365)..(365): a, c, t, g, unknown or other
  misc_feature (365)..(365): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagacctccctggctgtgtctcgtgggcgagagggccaccatcaactgcaagtcccagccagtagttcttttgtcagctaccaagaatatgagtcgtagcttggaccagcagaaagcacgacacgtcccctaagtgctctatttatgtcatctacgtcgggtcgtcccccggggtcctagacccgtatcgaagcgnaggcgatcgtgggacagtacttcactctcaccatcagcagcctgacagactagaaggtatggtagactagtttatactgtacagtactaattattagtggtacgttcctcggcttcgtcgtttcgggcggttacgggaaccgtaagggtggagacgttacgaagcgtaacg

SEQ ID NO: 299663 - DNA, 586 bp, Homo sapiens
  misc_feature: GZ8MTXP01AHGW2.38.23.C01.1.454.CMB.2.raw
  modified_base (477)..(477): a, c, t, g, unknown or other
  misc_feature (477)..(477): n is a, c, g, or t
  modified_base (514)..(514): a, c, t, g, unknown or other
  misc_feature (514)..(514): n is a, c, g, or t
  modified_base (538)..(538): a, c, t, g, unknown or other
  misc_feature (538)..(538): n is a, c, g, or t
  modified_base (557)..(557): a, c, t, g, unknown or other
  misc_feature (557)..(557): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtggggggtccctgaagctctcctgtgcagcctctggattcatatttagtaatcattggatgagttgggtccgcaggctccgaggggacggggctggagtgggtcggccacgtaactaaaccgacgactagggaactagaaaaaagctaaatggtggaactcgtaggtggaacggggccattccacccgtctcccaagacgaacaacggaccaagtaattcacttgtattgacaaagtgaaacngcctaggagacgtacgaaagacgaccggacctaattntaattagttagtaagttaaaagtntacagttcgataagtgggngtcggtacgggttacggggtgcgtttaag

SEQ ID NO: 299664 - DNA, 566 bp, Homo sapiens
  misc_feature: GZ8MTXP01ASR1I.38.23.C01.1.454.CMB.2.raw
  modified_base (480)..(480): a, c, t, g, unknown or other
  misc_feature (480)..(480): n is a, c, g, or t
  modified_base (507)..(507): a, c, t, g, unknown or other
  misc_feature (507)..(507): n is a, c, g, or t
  modified_base (521)..(521): a, c, t, g, unknown or other
  misc_feature (521)..(521): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccaggccgtggggggtccctgagctctcctgtgcagcctctggattcatatttagtaatcattggatggtagttgggtccgccgaggctcgaggggacggggcgtggagtggggtggccactaataaaccgacgataggaaactagaaaaagactaagtgtgactcgtagtagaacgggctattccacccgtctccgaagacgacgaacgaccaaagatcacttgtatttgacaaagtgaactagcctagagngtacgaagacgacggccatagtaattnttaggtattaaagnttacgattgaattgtgggtcgcgtacggttacggtggttcttaag

SEQ ID NO: 299665 - DNA, 641 bp, Homo sapiens
  misc_feature: GZ8MTXP01ARZ6Z.38.23.C01.1.454.CMB.2.raw
  modified_base (562)..(562): a, c, t, g, unknown or other
  misc_feature (562)..(562): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtgggggtccctgaagctctcctgtgcagcctctggattcatatttagtaatctagttggatgaggttgggtcccgcgaggctccgaggggacgggggcgtgggagtggggtcggccactaactaaaccacggagtacggaaactaggaaaaagctaaagtggtggaactcgtaggtacggaacggggtccaagtttccacccggttctacccgaagaacggaaccaaacggacccaaagtaacttccaacttgttatttacgaactaaaggtcgaaacgacgacccgtagaacgtagacgaaagaccgacggacctaattataatttnttagtaagttaaagtactacttattcggattaagggtgggtcgggtaccggtacgggttacggggtcgttcgtttaagg

SEQ ID NO: 299666 - DNA, 609 bp, Homo sapiens
  misc_feature: GZ8MTXP01D6ILZ.38.23.C01.1.454.CMB.2.raw
  modified_base (551)..(551): a, c, t, g, unknown or other
  misc_feature (551)..(551): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcttgggttttccttgttgctattttagaaggtgtccagtgtgaggtgcagttggtggaatcgtagggggtaaacttggtccagccgtgggggtccctgagctctctgtgcagcctctggtatcatattagtaatcattggatggtagttcgggtccgcgaggcgtccggagggggacggggcgtgggaggtggggtcggaccaactaacgaaaccgacgtagtacggaaactaagaaaaagtactaatggtggactcgtggtaggaacgggcgtattccaccgttcaccagacgaacaacgaccaaagtactccaattgtattagactaaagtgaaacagacctagaagagtacgaaacgacgacggactaatattaattagttagtaaacgttaaaagnttacttaagttgaagttaagttggggtggacggtacgggttacggggtggctttaagg

SEQ ID NO: 299667 - DNA, 612 bp, Homo sapiens
  misc_feature: GZ8MTXP01CRASW.38.23.C01.1.454.CMB.2.raw
  modified_base (401)..(401): a, c, t, g, unknown or other
  misc_feature (401)..(401): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagccgtacggggacatcgtgatcgacccagtctccagacctccctggctgtgtctcgtgggcgagagggccacatcaactgacaagtccagccagtagttctttgtcagcctacaagaatgtgtagtcgttagcgttgaccagacaagaaagcaacgactacgtacccctaagttgaccttatattttagttcggtactattcgttacggtcggggttcggtccccccgggggttccctaggaccgtagttcgaacgggccggngacgggtccggtagttcggtaggggactagtactttccactcctcactatccagcacgcctgcaagactaggaagtaggttgtacggtacttagtttactacgtggtacagtacttatagttggtggttacttcccggtcgttaccgttcggttcggttcggggcgggaacggtaacgagggttcgagtacttacgaacggttccgtaagg

SEQ ID NO: 299668 - DNA, 602 bp, Homo sapiens
  misc_feature: GZ8MTXP01DIA0B.38.23.C01.1.454.CMB.2.raw
  modified_base (414)..(414): a, c, t, g, unknown or other
  misc_feature (414)..(414): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagacctccctggctgtgtctcgtgggcgaggacgggccaccatcaactgacaacgtccagccagtagttcttttgtcagtctaccaaagatatgtagttcgttagcgttaggaccagacaagaaagcacgacacgtacccctaagtgctacttatttgtgtcatcgttacgtcgggtcgtcccgggtcctcgaccgtatcgagcggtacgaggccggtatcgtagggactgtacttcactctaccactntcgactcacgtcctagacacgacgtaagaagtagttaggggtacggtactttaagtttacttacgtcgtagacgtattaaagttattagtacggttcgttaacccgttcgttcttccgttccgtttacggggacggttacggaccggttaagggtaagagtaagacgtacggacgtaacggttcgtcg

SEQ ID NO: 299669 - DNA, 577 bp, Homo sapiens
  misc_feature: GZ8MTXP01EWX8S.38.23.C01.1.454.CMB.2.raw
  modified_base (303)..(303): a, c, t, g, unknown or other
  misc_feature (303)..(303): n is a, c, g, or t
  modified_base (442)..(442): a, c, t, g, unknown or other
  misc_feature (442)..(442): n is a, c, g, or t
  modified_base (462)..(462): a, c, t, g, unknown or other
  misc_feature (462)..(462): n is a, c, g, or t
  modified_base (523)..(523): a, c, t, g, unknown or other
  misc_feature (523)..(523): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtgggggtccctgagctctcctgtgcagcctctggattcatattagtaatcattggatgagttgggtccncaggctcgaggggacggggctgggagtggggtggccaactaataaaccacgaatggaaactagaaaaagctaaatggtcggactcgtgtagaacgggcgattccaccgtctaccagagacaacgaccaaagtatcactntattagaacaagtacgaacncgacctagaagtacgtacgaaacgacgacgacaattataatttagttagtaagttaaagtntattagttgattaaggtgggtaacggacggtagggttagggtggaacgtttaag

SEQ ID NO: 299670 - DNA, 538 bp, Homo sapiens
  misc_feature: GZ8MTXP01C87PX.38.23.C01.1.454.CMB.2.raw
  modified_base (467)..(467): a, c, t, g, unknown or other
  misc_feature (467)..(467): n is a, c, g, or t
  modified_base (475)..(475): a, c, t, g, unknown or other
  misc_feature (475)..(475): n is a, c, g, or t
  modified_base (498)..(498): a, c, t, g, unknown or other
  misc_feature (498)..(498): n is a, c, g, or t
  modified_base (520)..(520): a, c, t, g, unknown or other
  misc_feature (520)..(520): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaggtgtccagtgtgaggtgcagtttggtggaatcgtgggggaaacttggtccagccgtgggggtccctgagctctcctgtgcagcctctggattcatattagtaatcattggatgagttggtccgccaggctccgagggacggggctggagtgggtgccaactataaaccacgataggaactagaaaaagctaaagtgtggactcgtgtgaaggggcattcaccgtctccagagacaacgaccaagtaatcactgtaatttgacaaatgtaacagcctgagagtcgaaancacgcatntaatttattagtagttaaaacgntacttattcgataagtggtggngacggttagggtgcgttg

SEQ ID NO: 299671 - DNA, 613 bp, Homo sapiens
  misc_feature: GZ8MTXP01DEX1A.38.23.C01.1.454.CMB.2.raw
  modified_base (339)..(339): a, c, t, g, unknown or other
  misc_feature (339)..(339): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtagggggaaacttggtccagccgtggggggtccctgaagctctcctgtgcagcctctggattcatatttagtaatcattggatgagttgggtccgcaggctccgaggggacggggctgggagtgggnggccactaataaaccacgataggaactagaaaaagactaatgtggaactcgtaggtggaacggggccgattccaccgttctacccgaagacgaacaaacgacctaaagaacttacacttgttaatttgactaaagtgtaaacagcctaggagaggtacgaaagactacggacctaataattaatttaattaggttaaagttaaaagtacttcttaagttcggattaagtcggggtgggaccggtaacggggttacggggtcggttctttaaggg

SEQ ID NO: 299672 - DNA, 639 bp, Homo sapiens
  misc_feature: GZ8MTXP01EYASR.38.23.C01.1.454.CMB.2.raw
  modified_base (356)..(356): a, c, t, g, unknown or other
  misc_feature (356)..(356): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggtttccttgttgctatttagaggtgtccagtgtgaggtgcagttggtggaatcgtagggggaaacttggtccagccgtgggggtccctgagctctcctgtgcagcctctggattcatatttagtaatcattggatgagttggccgcgaggcctccgagggggacgggtcgtgggagtgggtcggcctaactaacgaaaccncgagtaggaaactaggaaaaaagtctaaaagtggtggactcgtggtagggaaacggggtccgtaattcccgacccgtactacccgagacgaaccaacggaccaaagtaacttcaactagttatttagaccaaagttacgaaacgacgaccgttaggaacgtagtacggaaacgcgaaccggtccaataataagtttaagttaggtaagttaaaagtattaacttacgttgttagttaagtggtaacgggtcgggtaacgggttaccggggtggttcgtttaag

SEQ ID NO: 299673 - DNA, 553 bp, Homo sapiens
  misc_feature: GZ8MTXP01DWHVE.38.23.C01.1.454.CMB.2.raw
  modified_base (362)..(362): a, c, t, g, unknown or other
  misc_feature (362)..(362): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcatgatgacccagtctccagactccctggctgtgtctcgtgggcgaggacgggccaccatcaactgacaagtccagccagtagttcttttgtcagcctacaaagtatatgagttcgtagtcgttaggtaccagacaagaaagcacgacacgtcccctaagtcgctatatttatgtacatcgtacgtcggggtcgtccggggtcccctaggacgtntcgaggcgcaaggcgatcgtagggactagtactttcactctacacatcagcacgctgacagtacagaagtgtgggtacgtacttaagtttagtacgttgtacaagtataaattagtagtggtaactcgttcggtcttacgtacgttcgggaggacgggacgaagggtgaagatacggagtcgttaacgtgg

SEQ ID NO: 299674 - DNA, 813 bp, Homo sapiens
  misc_feature: GZ8MTXP01BJ17Y.38.23.C01.1.454.CMB.2.raw
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagacctccctggctgtcgtctcgtgggcgagacggccaccatcaactgacaagtccagccagtagttcttttgtcagtctaccaaagatatgtagttcgtagcttggtaaccagacaagaaacgccaacgaacctaaccgtacccccgttaaagttcgaccttacgttaatttttacgtttcggtaccttacgttaccgtttaccggttccgggggttccggttcccccggggggttccccctacgggtaaccccggtacgtttcccgaacggggtcccgggaaaccgtacgggtccggggtaaacgtttccgggtacggggaaacgttaacgggtttactttttaccccgaaaccttcccttaaccaaaccctacttccgaacgaccgaaccggtccccgttaggaacccgaaggtaacccgtaaggtaaaacgtcggtttagggggttacgggttaacgtttaaacggtttttaactttaaccgttagtaccgtaaggtaaaccttaaagtttacgtttagttacgggttaaccgttccggttccggttaccgttccggttacggtttccgggggacgggaaacggggttaccgttaagggggtaagtacgtaagtaccgaaggttccgtaacgttgggtaaccgg

SEQ ID NO: 299675 - DNA, 551 bp, Homo sapiens
  misc_feature: GZ8MTXP01BSOV0.38.23.C01.1.454.CMB.2.raw
  modified_base (464)..(464): a, c, t, g, unknown or other
  misc_feature (464)..(464): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctcgtgggcgagagggccaccatcaactgcaagtccagccagagttctttgtcagctacaagaatatgtagtcgtagcttggaccagcaagaaagcaacgacacgtacccctaagttcgactctatttattggtcatctacgtcgggtcgtccccgggtcctgacccgattcgaagcggcgaggcggatcgtgggactagtatttcactctcacatcagctacgcctgacagactagaaggattggtcggtacttagtttactacgtgtaccaagtntaaattattgtcggtacttccgtcggttctcgtaacgtttcgggcgggttacgggaacgtaaggtgggatagttacgaagcgtaagg

SEQ ID NO: 299676 - DNA, 670 bp, Homo sapiens
  misc_feature: GZ8MTXP01A38FM.38.23.C01.1.454.CMB.2.raw
  modified_base (302)..(302): a, c, t, g, unknown or other
  misc_feature (302)..(302): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggtttccttgttgctatttagaaggtgtccagtgtgaggtgcagttggtggaatcgtagggggaaacttggtccagccgtgggggtccctgaagctctcctgtgcagcctctggatcatattagtatctattggatgagttcggtccncgaggcctcgagggacgggctggagtgggtgccaactataaaccgacgaagtacggaaactagaaaaacgtctaaagtgtggactgtggtaggacgggccgtattccacccgtctaccgagacgacaacggaccaaagtaacttacaacttagttaacttacgaactaaagtcgaaacgtacgtacccgttaggaacggtaggtaaccggaaaacgaccgaaccgggtaccctaaagttaattaaagttttaagttagggttaaagttaaaaaggttacttaaaccgttaagttttaccgttaaagttaaggttggggtaacgggtaccgggtaacgggttaccgggggtgttaacccgttttaaggg

SEQ ID NO: 299677 - DNA, 547 bp, Homo sapiens
  misc_feature: GZ8MTXP01BC2KH.38.23.C01.1.454.CMB.2.raw
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagacctccctggctgtgtctcgtgggcgagaggccaccatcaactgcaagtccagccagagttcttttgtcagctccaagaatatgagttcgtagcttggtaccagcaagaaagcacgacacgtcccctaagtgctctatttatgtcatctacgtcgggtcgtcccggggtcctcgaccgtatcgagcggacacgcggtatcgtgggactagtacttcactctacaccatcagcacgcctgacagacgtagaagtagtgggtggtactagtttacttacgtgtcgagtactaattattagtggtacgtccgtcggttctccgttacgttcgggacggttaggaccgttagggtaagagaatacgaaggcgtaacgttggtcg

SEQ ID NO: 299678 - DNA, 579 bp, Homo sapiens
  misc_feature: GZ8MTXP01EU9HG.38.23.C01.1.454.CMB.2.raw
  modified_base (305)..(305): a, c, t, g, unknown or other
  misc_feature (305)..(305): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagtagttcttttgtcagctacaaagaatatgtagttcgtagcttaggaccagacaagaaagcacgacacgtcccctaagtgctntatttatgtcatctacgtcgggtcgtccggggtcctcgaccgtatcgagcggacaggcgtatcgtagggactagtactttcactctacactatcagcacgcctagacagactagaaagtgtacggggtggtacttaagttttactactagtacgtaagtacttaaattattagttcgggtacgtcccgtcggttcctaccgttacgtttcggggacgggaacgggaccgttaagggttggaagtaagtaccgaaggacgtaacgttggtaacgg

SEQ ID NO: 299679 - DNA, 590 bp, Homo sapiens
  misc_feature: GZ8MTXP01EBATI.38.23.C01.1.454.CMB.2.raw
  modified_base (320)..(320): a, c, t, g, unknown or other
  misc_feature (320)..(320): n is a, c, g, or t
  modified_base (343)..(343): a, c, t, g, unknown or other
  misc_feature (343)..(343): n is a, c, g, or t
  modified_base (360)..(360): a, c, t, g, unknown or other
  misc_feature (360)..(360): n is a, c, g, or t
  modified_base (529)..(529): a, c, t, g, unknown or other
  misc_feature (529)..(529): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtgggggtccctgagctctcctgtgcagcctctggattcatatttagaatcattggatgagttggtccgcaggctcgagggacgggntggagtgggcgcactataaaccncgatggaactagaaaanactaatgtggtactcgtagtagggaacgggtccgtattccgacccgtacctccaacgagaaccaacgaccaaagtaacttacacttagtacttagacaaagttagaacagtccgtagacgagtacgaaacgacgacggccaatattaatttagttagtaaggttaaaanattacaagtttcgattaagttagggtgggaccggtacgggttacggggtggccgtttaagg

SEQ ID NO: 299680 - DNA, 671 bp, Homo sapiens
  misc_feature: GZ8MTXP01ACA5L.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctatttagaaggtgtccagtgtgaggtgcagttggtggaatcgtgggggaaacttggtccagccgtggggggtccctgaagctctcctgtgcagcctctggattcatatttagtaatcattggatgagttgggccgccgaggctccgagggggacggggctgggagtgggggtcggccaacgtaataaacccgacgaagtagggaaacttaaggaaaaaagacgttaaagtcggttgggaccttacgtgggttacggaaacgggggtccccgtaagtttcccgacccgttccgtacccaaggaacgaaccgaaaccgacccaaagtaacttcaacttgttaatttagaccgaaagttagaaaccagacccgttagaaggaacgtacggaaagaccgaaccgggtacccaattattaattaagtttggtaagttaaaagtataccttaagtttccgaattaaggtgggtcgggtacggacccggttagggggtcgttcgttaag

SEQ ID NO: 299681 - DNA, 756 bp, Homo sapiens
  misc_feature: GZ8MTXP01CNBW5.38.23.C01.1.454.CMB.2.raw
  modified_base (312)..(312): a, c, t, g, unknown or other
  misc_feature (312)..(312): n is a, c, g, or t
  modified_base (672)..(672): a, c, t, g, unknown or other
  misc_feature (672)..(672): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgcttattttagaaggtgtccagtgtgaggtgctagttggtggaatcgtagggggtaaacttggtcagccgtcgggggtccctgagctctctgtgcagcctctggattctatatttagtaatcattggatggtaggttcgggcccnccgaggtcctaccggagggggacgggggtcgtggggtagggtcgggggtcgggaccctaactaaaccgtaaaccgacggtaagtacgggaaactaaggaaaaaagtacgtaaagttacggtcggtaacttcgtagggttacgggaacggggtacccgtacgttacccacccggttacctacccggaagaaacgaacccgaaacccgaaaccgtaaacgtaaacttcctaaaccgttggttaaactttagaaaccttaaaaggtacgaaaacgtaccggtaccggtaggggtaacgtaccggaaagaacccgaaccggtacaaacttaattagtttaagttaaggttaaagtaaaaagttnttaaccgtaagttacgttagttaaggttggggtacgggtaaccggtacggggttacggggttcggtaacgttaaggttttccgg

SEQ ID NO: 299682 - DNA, 573 bp, Homo sapiens
  misc_feature: GZ8MTXP01E1E0R.38.23.C01.1.454.CMB.2.raw
  modified_base (282)..(282): a, c, t, g, unknown or other
  misc_feature (282)..(282): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctcgtgggcgagacggccaccatcaactgcaagtccagccagtattcttttgtcagctacaaagatatgtagttcgtagcttggtaccagacaagaaacncaacgacacgtcccctaagtgctctatttatgtactatcgtacgtcgggtcggtcccgggtcctggaccgtatcgagccggacaggcgtatcgagggacagtcttcacttcacactatcaacgcacgcctagaccagactaggaaagtgttggggtacggtacttagtttaactaccgtgtcaagtactaaattgttagtcggtacgtcgtcggttctcggttacgttcgggacgggaacggttccgaagggtggagtaacgaacgacggttacgtaacgttgggtaaccg

SEQ ID NO: 299683 - DNA, 678 bp, Homo sapiens
  misc_feature: GZ8MTXP01BE6HN.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtagggggaaacttggtccagccgtggggggtccctgagctctcctgtgcacgcctctggattcatattagtaatcattggatggtaggttcgggtcccgccgacggtcgtacccggagggggaccgggggcgttaggggagggttgggggtcggaccctaacgtaacgtaaaacccgacggaacgtagggaaactaaggaaaaaacgtcttaaagtcggtgggactcgtagggtacggaacgggccgtattcccgacccgtctacccgagacgaacaacgaccaaagtacttcacttgtaatttagaactaaagtacgtaaacacgccgtaggagtacggtacggaaacgaccgtaccggacctaataattaatttattaggttaaaggttaaaagtcttacgttagttgttagttaaggtcgggtaagggtaccggtacgggttcggggtaacgttcgtttaagg

SEQ ID NO: 299684 - DNA, 570 bp, Homo sapiens
  misc_feature: GZ8MTXP01APNNR.38.23.C01.1.454.CMB.2.raw
  modified_base (533)..(533): a, c, t, g, unknown or other
  misc_feature (533)..(533): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattgggctgagctggtttccttgtgctatttagaggtgtccagtgtgaggtgcagttggtggaatcgtggggaaacttggtccagccgtgggggtccctgagctctcctgtgcagcctctggattcatatttagtaatcattggatgaggttgggtcccgccgaggctccgaggggacgggctgggagtgggtggccacgtataaaccacgatagggaactagaaaaagctaaagtgtggactcgtaggtgaaacggggccaatttccgaccgttctaccgagacgaacaacgtaccaaagaacttcacttgtatttagacaaagtagaacagacctgagagtacgaaagacacggaccatataattagttagtaagttaaagtatacttattnattaagtggtggacgacgggttacgggtggttaactg

SEQ ID NO: 299685 - DNA, 665 bp, Homo sapiens
  misc_feature: GZ8MTXP01BFART.38.23.C01.1.454.CMB.2.raw
  modified_base (271)..(271): a, c, t, g, unknown or other
  misc_feature (271)..(271): n is a, c, g, or t
  modified_base (332)..(332): a, c, t, g, unknown or other
  misc_feature (332)..(332): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcttgggttttccttgttgcttattttagaaggtgtcagtgtgaggtgctaggttggtggaatcgtagggggaaacttggtccaggtccgtgggggtccctgagctctcctgtgcagcctntggtatcatattagtaatcattggatgagttggtccgcgagctcgaggggacgggctgggngtgggtcggacctaacgtaactaaaccgacggtaagtaggaaactaaggaaaaaacgtctaaagtgggtggtactacgtggtagggaaacggggccgtacttaccgacccgtcgtaccaaggaacgaaccaaacgtacccaaagtaacttcaccttagttactttacgaacgtaaagttacgaaacgtgaacccgttggaaacgtaacggtacgaaaacgacgtaaccggactaaattaataagtttaacttaggttaaacgttaaaagtattacagttcgaagttaagtggggttaacggaccggtacggggttaacggggtgccgtttaag

SEQ ID NO: 299686 - DNA, 752 bp, Homo sapiens
  misc_feature: GZ8MTXP01BRV7X.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtgggggtccctgagctctcctgtgcagcctctggattcatatttagtaatcattggatgagttggccgccaggctcgagggacgggctggaggtggggtcgaccactaactaaacccgagaacgtaggaaactaagaaaaacgtacttaaagtggtcgggtaaactcgtaggtacgggaaacggggtcccgtagtttacccgacccgttaccgtaccccgaagacgaaaccgaaaccgggaaccctaaaacggtaaactttccgaaccgttagttaagttttacggaacctaaaacgttaggaaacccgtaggaccccgttagggaacggtaacggttaacggaaaaccggaaacgtacccgggtaaccctaaagttaatttaaatttaacgttttaaaggttaaacggttaaaaaagtacgttaacgttaaacgttttccggttaagttaaggttacggggtaacggggtaaccggttacggggttacccgggggtaaggttaacccgttttaaggg

SEQ ID NO: 299687 - DNA, 555 bp, Homo sapiens
  misc_feature: GZ8MTXP01AYIMQ.38.23.C01.1.454.CMB.2.raw
  modified_base (520)..(520): a, c, t, g, unknown or other
  misc_feature (520)..(520): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggtttccttgttgctattttagaaggtgtccagtgtgaggtgcagttggtggaatcgtgggggaaacttggtccagccgtgggggtccctgagctctcctgtgcagcctctggattcatatttagaatcattggatgagttggtccgcaggctccgaggggacggggctggaggtgggtcgccaactaataaaccacgataggaactaagaaaaagactaatgtggactcgtagtacggaacgggccgattccaccgtctacccaagacgaactaacgaccaagaacttcacttagtatttagactaaagtagaacagcctagagagtacgaaagacacggaccatataattattgtaagttaaantacattgatgtggtgccgaggttacgggtgcgttg

SEQ ID NO: 299688 - DNA, 652 bp, Homo sapiens
  misc_feature: GZ8MTXP01BO34K.38.23.C01.1.454.CMB.2.raw
  modified_base (352)..(352): a, c, t, g, unknown or other
  misc_feature (352)..(352): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtgggggtccctgagctctcctgtgcagcctctggattcatatttagtaatcattggatgagttgggtccgccaggctcgaggggacggggctggagtgggtcggccactaataaaccncgataggaactagaaaaagctaaagtgtggaactcgtaggtaggaaacggggccgtaattcccgaacccgttcgtacccgaaggacggaaaccaatacggaaccccaaaggtaaactttacaaccttagttaattttacggacctaaaagttaggaaacctaggccctaggaacgtacggttaccgaaacgtaccgaaccggacctaattaattaatttagttaagttaaggtaaaagtacttacttatttacggaattagtgggtacgggcggttacgggtaaccggggttggtaaccg

SEQ ID NO: 299689 - DNA, 575 bp, Homo sapiens
  misc_feature: GZ8MTXP01CNTDY.38.23.C01.1.454.CMB.2.raw
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctcgtgggcgagacgggccacatcaactgacaagtccagccagtagttcttttgtcagtctacaagaatatgtagtcgtagcttggtaccagacaagaaagcgaacgacacgtacccctaagttcgctctatttatgtctatctacgtcgggtcgtcccccggggtcctacggaccgtattccgaaggtcggcagggcggatcggtagggacagtacttcactctacacatcagctacgcctgacacgacgtagaaggtatggtagtacgtaagttttaattaccgtgttacagtactaaattattaagtggtacgttccgttacggcttaccgtacgtttcgggcgttacggtaacgaacgtaagggtgagactaacgaagtaacgg

SEQ ID NO: 299690 - DNA, 607 bp, Homo sapiens
  misc_feature: GZ8MTXP01DW12L.38.23.C01.1.454.CMB.2.raw
  modified_base (556)..(556): a, c, t, g, unknown or other
  misc_feature (556)..(556): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtgggggtccctgagctctcctgtgcagcctctggtattcatatttagtaatcattggatggagttgggtccgcgaggctccgaggggacggggcgtgggaggtgggtggaccactaacaaacacgataggaaactagaaaagactaagtgtggactcgtagggtaggaacggggccgtacgttccgacccgttctaccgaagacgaacaacgaccaaagtaactacacttacgttattacgataaagttacaaacgacgtcctagaagagtacgaaagaccgaccggctaagtattaattaattaggtaagttaaaagtatnttacgttgattaaggtggtggccggtacgggttacgggttggcgtttaagg

SEQ ID NO: 299691 - DNA, 601 bp, Homo sapiens
  misc_feature: GZ8MTXP01E1NSN.38.23.C01.1.454.CMB.2.raw
  modified_base (307)..(307): a, c, t, g, unknown or other
  misc_feature (307)..(307): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcttgggttttccttgttgctattttagaaggtgtccagtgtgaggtgcagttggtggaatcgtagggggaaacttggtccaggccgtggggggtccctgaagctctcctgtgcagcctctggattcatatttagtaatcattggatgagttggccnccaggctccgagggggacggggctgggagtggggtcggaccaactaataaaacccgcgatagggaaactaggaaaaaagactaaagtgtggactcgtaggtggaaggggcccgtattccgacccgtctaccgagacgaacaaacgccaaagtaacttcaactgttaatttgaacaaagtgaaacagtcctaagagagtacgaaagcacggaccaagtattaattattagtaaggttaaacgattcagtttgaattgttcgggtggacggtacgggttacgggtaaggcgttaag

SEQ ID NO: 299692 - DNA, 816 bp, Homo sapiens
  misc_feature: GZ8MTXP01CW5N2.38.23.C01.1.454.CMB.2.raw
  modified_base (274)..(274): a, c, t, g, unknown or other
  misc_feature (274)..(274): n is a, c, g, or t
  modified_base (285)..(285): a, c, t, g, unknown or other
  misc_feature (285)..(285): n is a, c, g, or t
  modified_base (301)..(301): a, c, t, g, unknown or other
  misc_feature (301)..(301): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcgtagttggtggaatcgtagggggaaacttgggtccgacggtccgggtcggggtccgtagacgtctctcgtgtcgcncgtctcgtgtntactatattagtactntagttggtagtggtaggtcggtccgacgtacgtccgtacgggagggggacgggtcggtgggtagggttgggccggtacctaacgttaaacgaaacgaacgtaacggtaacggtaaacgtaaaggtaaaaacgtacgtaaagttaggtcggtacgttcggtagggtaaggggaaccgggaccgttacgtacccgtaccgttccaacgaaggaaccgaaaccgaacccgaaactaaacgttacttaccgtaagtttagttaactttaacgaaaccgtaaaagggttaccgaaaacgttaccgtacgttaaaggaaccggttaacggtaacggaaaaacccgtccggaaacccggtactttaaaaggtttattaaaacttttttaagggttaaagttttaaaaaacgggttaaagttaacgttacctttaaagggtttacgaaagtttaaggggtacggggtcgggtaaccccgggggtttaggggttaacgggggtttccgttaagtttttccgggg

SEQ ID NO: 299693 - DNA, 618 bp, Homo sapiens
  misc_feature: GZ8MTXP01COJG8.38.23.C01.1.454.CMB.2.raw
  modified_base (396)..(396): a, c, t, g, unknown or other
  misc_feature (396)..(396): n is a, c, g, or t
  modified_base (404)..(404): a, c, t, g, unknown or other
  misc_feature (404)..(404): n is a, c, g, or t
  modified_base (552)..(552): a, c, t, g, unknown or other
  misc_feature (552)..(552): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagacctccctggctgtgtctcgtgggcgagacggccacatcaactgacaagtccagaccagtagttcttttgtcagtctaccaaagtaatagtgtagttcgttagcttaggaccagacaaggaaagcaacgacacgtacccctaagttcgcttactatttagttggtactatcgtacgtccgggtgtcccggggtcctcgaccgtatcgacggtcggacaggcggtatcgngggtaacngtaacttcgacttctacacctatcacgactacgcctggactagactagaagtgttaggggtagtacgttagttaacgttacgtgtactagtaactaaagttagttagtggtaacgtccgttcggacttaccgttaggtttaccggggngggttaacgggttaccgaagggttaagggaactaacgacggaaggttaccgtaagttgggtaacgg

SEQ ID NO: 299694 - DNA, 580 bp, Homo sapiens
  misc_feature: GZ8MTXP01AJNO1.38.23.C01.1.454.CMB.2.raw
  modified_base (348)..(348): a, c, t, g, unknown or other
  misc_feature (348)..(348): n is a, c, g, or t
  modified_base (523)..(523): a, c, t, g, unknown or other
  misc_feature (523)..(523): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtggggggtccctgaagctctcctgtgcagcctctggattcatatttagtaatcattggatgagttggtccgcgaggctcgagggacggggctggagtgggtgccatataaaccncgatggaactagaaaaagctaaatggtggactcgtaggtaggaacgggccagttccacccggtctacccgagacgacaacgaccaagaatcacttgtatttgacaaagtgaacagccttagagacggtacgaaagaccacggtaccaattataattaagttggtaagttaaaagnttaacagtttcgagttcgtagggtcggacggtacggttaccggggtggcgtttaagg

SEQ ID NO: 299695 - DNA, 584 bp, Homo sapiens
  misc_feature: GZ8MTXP01B6VFJ.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtgggggtccctgaagctctcctgtgcagcctctggattcatattagtaatcattggatgagttggccgcgacggctccgagggacggggctgggagtgggtcggccacgtaactaaaccgacgactaggaaactagaaaaagtactaaagtgtggactcgtgtaggaagggccgtattccaccgtctaccgagagaacaacgaccaaagtaattcactgttatttagactaaagtcgaaacacgaccgtagagacgtacgaaagaccgacggactaatattaattattagtaaagttaaagatcgttaattgaattgtggtcggcggtacggttacgggtgttcgttaag

SEQ ID NO: 299696 - DNA, 671 bp, Homo sapiens
  misc_feature: GZ8MTXP01D8LVZ.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcttgggttttccttgttgcttattttagaaggtgtccagtgtgaggtgctaggttggtggaatcgtagggggaaacttggtccagccgtgggggtccctgagctctcctgtgcacgcctcgtggtattcatatttaagtaatctagttggatgtaggttcgggtccgccgaggctccggagggggacgggcgtgggaggttggggacggacctaactaactaaaccgacgtaagtaggaaacgtaagaaaaagactaaagttggtgtactcgtaggtaggaacgggaccgtattacccgaccgtctaccgaagacgaaccgaaacgaccaaagtaacttccgtaattagttaatttacgaactaaagtagtaaacgacgtccgtaagaacggagtaacggaaacgaccgacggtactaattaagttaatttaagttaacggttaaagaaaagtacttacttaagtttgaattaaggttcgggtaagggtacgtagggttaccgggtggttaacgtttaag

SEQ ID NO: 299697 - DNA, 777 bp, Homo sapiens
  misc_feature: GZ8MTXP01DX7KE.38.23.C01.1.454.CMB.2.raw
  modified_base (379)..(379): a, c, t, g, unknown or other
  misc_feature (379)..(379): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcgttggttttccttgttgcttatttagagtgtcagtgtgaggtgcgtagttggtggaatcgtaggggtaaacttcggtccaggccggtcgggggtccctagacgtctctcctgtgcagcctctggtattcatatttagtaatcgtaattggattggagttcgggtcccgccgaggcgtccggaggggacgggggctgggggaggttggggtcggaccctaacgttaanaaaacccgacggtaataacgggtaaaactaaggaaaaaaacgtaccttaaaagttcgggtaacgggtaacttcggttagggtacgggaaaccggggtcctacgtttacccgacccggtttacacccggaagaacgaaccgaaaccgaacctaaacgtaactttccaacgtttagttaattttacgaacctaaaaggttacgaaaccgtacggtacccgttaaggaaggttaccggtaacggaaaacgtaacccgaaaccgggtaaccttaaattaacgtttaaagtttaagttaggtttaaacgttaaaaaggttattaaccttaaggtttacgaagtttaagggttggttaacggggtcggtaaccggggttacggggttgggttaacttttaaggg

SEQ ID NO: 299698 - DNA, 645 bp, Homo sapiens
  misc_feature: GZ8MTXP01DCH5P.38.23.C01.1.454.CMB.2.raw
  modified_base (266)..(266): a, c, t, g, unknown or other
  misc_feature (266)..(266): n is a, c, g, or t
  modified_base (272)..(272): a, c, t, g, unknown or other
  misc_feature (272)..(272): n is a, c, g, or t
  modified_base (282)..(282): a, c, t, g, unknown or other
  misc_feature (282)..(282): n is a, c, g, or t
  modified_base (302)..(302): a, c, t, g, unknown or other
  misc_feature (302)..(302): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttgggtccagcctgggggtccctgaagctctcctgtgcagcctnggattnatattatatnagtgatgtgttcggccgcgngcgcggagggcgggcgtggaggtggtcggacgacgtaacgtaaacgaacgacgtaggaacgtaaagaaaagaacgtaaagtagtgtacgtacgtagtaggaacgggacgtacgtaccgtaccgtaccgtaccgaacgaacgaacgaaaccgaaccgaaacgtaactactaacgttagttaagttacgtaacgtaaacgtaacgaacgtaacgtacgtagaagacgtacgaaacgaacgtaccgacgtaactaattaagttaagttaagttaaagttaaagtaagtacttacgttacgttagtaagtaggtaaggtacggtacggttacgggtcggttcgtaag

SEQ ID NO: 299699 - DNA, 637 bp, Homo sapiens
  misc_feature: GZ8MTXP01BT0LN.38.23.C01.1.454.CMB.2.raw
  modified_base (313)..(313): a, c, t, g, unknown or other
  misc_feature (313)..(313): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgcttattttagaaggtgtccagtgtgaggtgcaggttggtggaatcgtgggggtaaacttggtccgagccgtggggggtccctgagctctcctgtgcagcctctggtattcatatttagtaatcagttggatggaggttgggcccnccgaggccgtccgagggggacggggctgggaggtggggtcggccaactaacgaaaccacgagtaggaactaaggaaaacgtctaaagtggtggacctggtaggtacgggaccggtacttacgtacccgtaccgtaccacgagacgaaccgaccgaacgaaagtactactacgtatttagactaactaaggtacgaagcgtacgtagacgtagaacgaagaccgacgtactatttactaagtttaagttaggtaaattaaagtactacgttagttagttagttaaggtgggtccgaagggtacgggttacggtgcgttttaacgg

SEQ ID NO: 299700 - DNA, 546 bp, Homo sapiens
  misc_feature: GZ8MTXP01ES099.38.23.C01.1.454.CMB.2.raw
  modified_base (304)..(304): a, c, t, g, unknown or other
  misc_feature (304)..(304): n is a, c, g, or t
  modified_base (494)..(494): a, c, t, g, unknown or other
  misc_feature (494)..(494): n is a, c, g, or t
  modified_base (531)..(531): a, c, t, g, unknown or other
  misc_feature (531)..(531): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtggggggtccctgaagctctcctgtgaagcctctggattcatattagaatcattggatgagttgggtccncaggctccgaggggacggggctgggagtggggtgccatataaaccacgatcggaactagaaaaagctatgtggaactctgtgaagggtccattcaaccgtctccagacgacaacgcaaagattcactgtattgacaaatgaactagcctagagagtcgaagacacggccatatataattgttagtaaagntactaattcgattagtgggtggcggacggtacggggngtcgttaagtttcgg

SEQ ID NO: 299701 - DNA, 641 bp, Homo sapiens
  misc_feature: GZ8MTXP01CE2G3.38.23.C01.1.454.CMB.2.raw
  modified_base (245)..(245): a, c, t, g, unknown or other
  misc_feature (245)..(245): n is a, c, g, or t
  modified_base (320)..(320): a, c, t, g, unknown or other
  misc_feature (320)..(320): n is a, c, g, or t
  modified_base (353)..(353): a, c, t, g, unknown or other
  misc_feature (353)..(353): n is a, c, g, or t
tcagtcgatcacgtcacgaccggtgctcgatttagtacacgtgattagggattggggggagctacaacaggcaggcaggggcagcaagatggtgttgcagacccaggtcttcatttctctgttgctctggatctctggagcctacggggacatcgtgatgacccagtctccagactccctggctgtgtctcgtgggcgagacgggccacgatcaactgacaagtccaggccggtagttgtttaanacaactccaaagaataagagttcttagctaggaccagacaagaaaccacgacagcctaccaagctgctcgttacnggcctcgtacccgggatccgggtcctagaacgnttccgaggtgggcggtcgggtctaggggactggtactttccgacttccgaccaacctatccgacgacgacgccgtcgggcgggacgtaggaagtagtcggttagggtacgtttaacttacgttggttacgtaggtactaagttaatttacgttacgttaaccttccgttacgtacgttacgggtttacgggaccggtaacgggggtaacccgaaaggttcggtaggacgtacgtccggacgttaaccgttaacgtgggtacggtctcggccttacctaacttcgttcg

SEQ ID NO: 299702 - DNA, 615 bp, Homo sapiens
  misc_feature: GZ8MTXP01A4SHO.38.23.C01.1.454.CMB.2.raw
  modified_base (312)..(312): a, c, t, g, unknown or other
  misc_feature (312)..(312): n is a, c, g, or t
  modified_base (379)..(379): a, c, t, g, unknown or other
  misc_feature (379)..(379): n is a, c, g, or t
  modified_base (383)..(383): a, c, t, g, unknown or other
  misc_feature (383)..(383): n is a, c, g, or t
  modified_base (400)..(400): a, c, t, g, unknown or other
  misc_feature (400)..(400): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagacctccctggctgtgtctcgtgggcgaggacggccaccatcaactgacaagtccagccagtagttcttttgtcagctaccaaagatatgtagttcgtagcgttggtaccagacaagaaacgcacgactacgtacccctaagttcnctactatttagtgtctatcgtacgtcgggtcgtcccggggtcctcgacctatcgagcggacaggcgntcgnggactagtcttcactcncacatcagacacgcctagacagtacagaagtacgtggggtacgtacgttaagtttactacgtcgtacgtaagtacttaagttagttaagttcgggttacgtcccgttccgggttacttaccgttaccggtttaccggggaccggggttaacgggttaccgttaaaggggtcggaagtaacgtaacggaacggttaccgtaacggttggtaaccgg

SEQ ID NO: 299703 - DNA, 704 bp, Homo sapiens
  misc_feature: GZ8MTXP01AK7R7.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcttgggttttccttgttgctattttagaaggtgtccagtgtgaggtgcagttggtggaatcgtagggggaaacttggtccagccgtgggggtccctgagctctcctgtgcacgcctcgtggtattcatattagtaatctagtggtatggtagttcgggccgccgaggcgtccgagggggtacgggcgtgggagggtggggtcggacctaactaacgtaaacccacggtaagtaggaaacgtaaaggaaaaaacgtctaaagttggtcggtactcgtagggttacgggaacggggtaccctactttacccgacccgttactcccgaagaacgaaccgtaaacccgacctaaaggtaacttaccaacgttgttagtttagaaacaaagtaacgaaactacgtaccgtaagaacggtacgtaacggaaaccgaacgaacccggtactaaattagttaaatttagttagtaaaagttaaagtaattacgttacgttgaagttggttacggggtaacggaccggggttaacgggttaccggggtgttaaccgtttggg

SEQ ID NO: 299704 - DNA, 772 bp, Homo sapiens
  misc_feature: GZ8MTXP01EM16F.38.23.C01.1.454.CMB.2.raw
  modified_base (263)..(263): a, c, t, g, unknown or other
  misc_feature (263)..(263): n is a, c, g, or t
  modified_base (299)..(299): a, c, t, g, unknown or other
  misc_feature (299)..(299): n is a, c, g, or t
  modified_base (339)..(339): a, c, t, g, unknown or other
  misc_feature (339)..(339): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcgtggtttcctgtgctatttagaggtgtcagtgtgaggtgcaggttggtggaatcgtaggggggaaacttgggtccagccgtggggggtccctgagctctctgtgcagctcnggattcatattagaatcattggatgagttgggtccncaggctccgagggacgggggctggagtgggtggccaatanaaaccacgatgggaaactagaaaagtctaaagtgtggaacttcgtaggttggaaacggggtccgtaaagttttccaacccggttcgtacccaaggacggaaaccaaaccgtaccccgaaaacgggtaatttaccgaacctttagggttaaatttttaggaacccgtaaaaacgtttaggggtaaaaccctaaggtaccccgtaaagggtaacggtaagggtaacccgggtaaaaaaggtaacccgtaaacccgggggtaacccttaaacgttaaagtttaaagtttttaaactttaagggtttaaacggtttaaaaaaaaacccgggaattttaaacgttaacttttaaacgggttaatttaaacgggttggggtttaagggggccccgggtaaaacggggttacggggggttaacggttaacgggttttaag

SEQ ID NO: 299705 - DNA, 608 bp, Homo sapiens
  misc_feature: GZ8MTXP01AOG96.38.23.C01.1.454.CMB.2.raw
tcagtcgatcacgtcacgaccggtgctcgatttagtacacgtgattagggattgggggagctacaacaggcaggcaggggcagcaagatggtgttgcagacccaggtcttcatttctctgttgctctggatctctggacgccgtacggggacatcgtgatgacccagtcctccagacctcccgtggctgtgtctcgtgggcgagacggccaccatcaactgacaagtccagccagtattctttgtcagctaccaaagtatagtgtagtcgtagcttaggtaccagcaagaacgcaacgactacgtcccctaagttcgacttactatttacgtggtactacgttcgtacgtcggggttcgtccccccggggtcctggaccgtatcgaagcgtcgaggcgtatcggtgggactagtacttccactcctacacccatcacgcacgtctcgacaacgtactagaaagggtgttagggtacggacctttaagtttactacgtcgtacacgtactaaattagtagtggtacgttccccgtgttcgtccgtaacgttccgggacggacgggtaaccgtagggtggtaacgacgttacgaacgttaacgtaaccgg

SEQ ID NO: 299706 - DNA, 647 bp, Homo sapiens
  misc_feature: GZ8MTXP01EM9BO.38.23.C01.1.454.CMB.2.raw
  modified_base (202)..(202): a, c, t, g, unknown or other
  misc_feature (202)..(202): n is a, c, g, or t
  modified_base (259)..(260): a, c, t, g, unknown or other
  misc_feature (259)..(260): n is a, c, g, or t
  modified_base (269)..(269): a, c, t, g, unknown or other
  misc_feature (269)..(269): n is a, c, g, or t
  modified_base (274)..(274): a, c, t, g, unknown or other
  misc_feature (274)..(274): n is a, c, g, or t
  modified_base (278)..(278): a, c, t, g, unknown or other
  misc_feature (278)..(278): n is a, c, g, or t
  modified_base (299)..(299): a, c, t, g, unknown or other
  misc_feature (299)..(299): n is a, c, g, or t
  modified_base (318)..(318): a, c, t, g, unknown or other
  misc_feature (318)..(318): n is a, c, g, or t
  modified_base (324)..(324): a, c, t, g, unknown or other
  misc_feature (324)..(324): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcgtggtttcctgttagctatttagaaggtgtcagtgtgaggtgcagttggnggaatcgtgggggaaacttggtccagccgtgggggtccctgaagctctcctgtcgcnncgctgatanatatntatnatgagtggtgtcggtcggccncgcgtcggacggacggggngtgggnggtcggtacggtacgaaccgtacgtaaaccctaacggaaacgtaggaaaacgtacgtaaaaaaagtaaacgtaagtacgtggtacggtacgtacgggtacggtaaggtaccgaccgttactacccgtacgtaccgaacgaacgaaccgaaacgaactacgaacgttacgtaacttagtacttaagtacgaaactaagaacgtacgacgtacgtacgaacgacgtaacgaccgacgacgtaattaattagttaagttaaagtaagtaaagttaagttacttataagtagtaagtggtacggttacggtaacggttaacggtaag

SEQ ID NO: 299707 - DNA, 692 bp, Homo sapiens
  misc_feature: GZ8MTXP01A5RP9.38.23.C01.1.454.CMB.2.raw
  modified_base (269)..(269): a, c, t, g, unknown or other
  misc_feature (269)..(269): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcttgggttttccttgttgctattttagaaggtgtccagtgtgaggtgcagttggtggaatcgtagggggaaacttggtccagccgtggggggtccctgaagctctcctgtgcagcctntggattcatattagtaatcattggatgtagttggtccgcaggcctccgaggggacggggtcgtgggaggtggggtcggccctaactaacgtaaaaccgacgaatacgggaaactaaggaaaaaacgtactaaagtgtggaacttcgtaggtggaaacggggcccgtattacccgacccgttcaccgaacgacgaaccgaaaccgtaccaaacgttaacttccaacgttagttattagaactaaaacgggttgaaacgacgtaccctaggaacgtacgtaccggaaagaaccgaaccggtaccctaaagttaattaagtttaagtttagtaaacggttaaaaagtataaccttaagtttcgttaattaaggttcggggtaacggtaccgggtaccggttaaccgggggtgttaacggtttaagg

SEQ ID NO: 299708 - DNA, 586 bp, Homo sapiens
  misc_feature: GZ8MTXP01DGNF2.38.23.C01.1.454.CMB.2.raw
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctctgggcgagacggccaccatcaactgcaagtccagccagagtctttgtcagctccaaagaatatgagttcgtagcttggtaccagacagaaagcagacagtcccctaagtgctcatttatggtctatctactcgggtgtccggggtcctcgaccgattcgagccggcagcggatccgtagggacagtatttcactctcactatcagcagcctgcagactagaaagagttggggtggtcttaagttttacttacgtgtacgtagtaactaaatttattagttagggtaacgttcccgtcggttccttacggttaacgtttccggggacgggttaaacggggttcccgttaaaaggggttcggaaagtcgtacgaaacggttacgtaaacgttggttaaccggg

SEQ ID NO: 299709 - DNA, 804 bp, Homo sapiens
  misc_feature: GZ8MTXP01AGXI5.38.23.C01.1.454.CMB.2.raw
  modified_base (740)..(740): a, c, t, g, unknown or other
  misc_feature (740)..(740): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtagggggaaacttggtccagccgtgggggtccctgaacgctctcctgtgcagcctctggattcatattagtatcagttggatgaggttcgggccgccgaggcctccggagggggacggggtcgtgggtagggtggggtcggaccctaaactaacgtaaaacccgacggtaacgtacgggtaaaacgttaaaggaaaaaaaacggtaccgttaaaagtcgggtaacgggtaccgtttaccgggttagggttaacggggaaaaccgggggtccccggtaaacgttttacccccgaaccccgggttttacccttaaccccgggaaacgggtaaaccgggaaacccccgttaaaacccgggaaacccccgtaaaaagggtttaaacctttacccgtaaaccgtttacggtttaaagttttacggaaacctaaaagggttacggaaaccgacgtacccgttaaggacgtaaacggacgaaacgaccgtaaccggacctaaagttaataagtttattaggtaaagttaaaagtnttacgttacttgttacttaaggtggggaacggtacgtacggggttcgggtaagttcgtttaacg

SEQ ID NO: 299710 - DNA, 644 bp, Homo sapiens
  misc_feature: GZ8MTXP01DWWP6.38.23.C01.1.454.CMB.2.raw
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctcgtgggcgagacggccaccatcaactgacaagtccagccagtagttcttttgtcagctaccaaagatatgtagttcgtagcttggtaccagacaagaaacgcaacgacaacgtccccttaaagttcgacctttactaattttagttggtacctaattccgttacgttccggggttacggtcccggggtccctaggacccgtatttccgaggtcccggaacaggtcggatcggtagggactagtactttcacttctacacctatcagcacgcctgaccagacgtagaaatgtggggtacgtactttaagtttactacgtgtacagtaacttaagttagtttagtcggttaacttcccgttggttccttacggttacgtttaccggggacgggttaaacggggttaccgttaaagggttggaaagtaacgttacgaaacggttaccgtaacgttggtaacgg

SEQ ID NO: 299711 - DNA, 587 bp, Homo sapiens
  misc_feature: GZ8MTXP01ACF3U.38.23.C01.1.454.CMB.2.raw
  modified_base (439)..(439): a, c, t, g, unknown or other
  misc_feature (439)..(439): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagacctccctggctgtgtctctgggcgagagggccaccatcaactgacaagtccagccagtagttcttttgtcagctaccaaagaatatgagttcgtagcttaggtaccagcaagaaacgcaacgacacgtcccctaagttcgctactattttatggtctatctacgtcgggtcgtcccggggtcctgaccgtattcgaggcggacagcggtatcgtggggaccagttactttcaactcctacaaccatcagcacgcctgaccagactagaagngtggggtggtacttagtttactactgtacagtactaattacttaggtcggttacgttcccgtcggttacttccgttacggtttccgggacgggttacgggaccgttagggtggaactaacgtacgaacggcgtaacgttggtaaccgg

SEQ ID NO: 299712 - DNA, 575 bp, Homo sapiens
  misc_feature: GZ8MTXP01AX6YU.38.23.C01.1.454.CMB.2.raw
  modified_base (342)..(342): a, c, t, g, unknown or other
  misc_feature (342)..(342): n is a, c, g, or t
  modified_base (373)..(373): a, c, t, g, unknown or other
  misc_feature (373)..(373): n is a, c, g, or t
  modified_base (399)..(399): a, c, t, g, unknown or other
  misc_feature (399)..(399): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattgggctgagctgggttttctgttgctatttagagtgtcagtgtgaggtgcagttggtggaatcgtagggggaaacttggtccagccgtgggggtccctgaagctctcctgtgcagcctctggattcatatttagtaatcattggatgagttggtccgcgaggctcgagggggcgggctggaggtggtgccactataaaccncgtataggaaactagaaaagctaaatggtgntcgtgtggacggggccattcaccgtntaccgagacgacaacgtaccaagtatcacgtagttattagacaaagtgaaacgcgacgttaggacgtaggtacgaaagacgaacggacctaagttacttaattagttagtaagttaaacgtataccttagttcagtaacgtgggtcggtacggacggttacgggtgttcgtttaag

SEQ ID NO: 299713 - DNA, 560 bp, Homo sapiens
  misc_feature: GZ8MTXP01BKFB4.38.23.C01.1.454.CMB.2.raw
  modified_base (275)..(275): a, c, t, g, unknown or other
  misc_feature (275)..(275): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacgggacatcgtgatgacccagtctccagactccctggctgtgtctctgggcgagagggccaccatcaactgcaagtccagccagagtcttttgtcagctccaaagatatgagttcgtagcttggtaccagcagaaancaacgacacgtcccctaagttgctctatttattggtcatctacgtcgggtgtccggggtcctgaccgtattcgagcggacagcggatcgtgggacagtatttcactctacaccatcagctacgccctgcaacgtactaggaaagtgtaggggtgtactagttttaacttagtgtcagtactaaattattaagttggtaagtcctggttcttacgttacgtttccgggacgggttacgggaccgttaaggggtgtagaacgttaccgaaggacgtaacgttggtgg

SEQ ID NO: 299714 - DNA, 743 bp, Homo sapiens
  misc_feature: GZ8MTXP01AX36K.38.23.C01.1.454.CMB.2.raw
  modified_base (203)..(203): a, c, t, g, unknown or other
  misc_feature (203)..(203): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctatttagaaggtgtcagtgtgaggtgcagttggnggaatcgtgggggaaacttggtccagccgtggggggtccctgaagctctcctgtgcagcctctggattcatattagtatcattggatgagttggtccgcaggctcgagggacggggctgggaggtgggtggaccaacgtaactaaaccgagaacgtagggaaaactaaggaaaaacgtacttaaagtggtcggtacctcgtagggtaggaacggggaccgactttaccgacccgtctacccgaagacgaaccgaaacgaccaaacgtaacttactaaccgttaggttaactttacggaaacctaaaagggttacggaaaaccgtacggtacccgttaggaaacggtaggttaaacccgggaaacggtaacccgaaacccggggtaccttaaacttaaagtttaaacgttttaagtttaaggggttaaaaccttaaaaaagggtaccttaagttaacccgttttaacggagtttaaaggtcggggttaacgggaccgggttaacgggggttaacccgggggtgggttaacccgtttaaggg

SEQ ID NO: 299715 - DNA, 588 bp, Homo sapiens
  misc_feature: GZ8MTXP01DLOGC.38.23.C01.1.454.CMB.2.raw
  modified_base (478)..(478): a, c, t, g, unknown or other
  misc_feature (478)..(478): n is a, c, g, or t
  modified_base (483)..(483): a, c, t, g, unknown or other
  misc_feature (483)..(483): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctatttttagaaggtgtccagtgtgaggtgcagttggtggaatctgggggaaacttggtccaggccgtgggggtccctgaagctctcctgtgcagcctctggattcatatttagaattcaattggatgagttggtccgccaggctccgaggggacggggcgtggaggtgggtggaccactataaaaccacgaatagggaaactagaaaagtactaaagtgtggactcgtaggtagaacggggtccgatttccacccgtctaccgaagacgaccaacggaccaagtaactctactgtatttagacaaagtnaaacngacctggagacgtacgaaagtacacggactatataatttaagttagtagttaaaagattacaagttcgattgtgggtcgccggtaggttacggggttggcttaag

SEQ ID NO: 299716 - DNA, 559 bp, Homo sapiens
  misc_feature: GZ8MTXP01AY3ZC.38.23.C01.1.454.CMB.2.raw
  modified_base (331)..(331): a, c, t, g, unknown or other
  misc_feature (331)..(331): n is a, c, g, or t
  modified_base (385)..(385): a, c, t, g, unknown or other
  misc_feature (385)..(385): n is a, c, g, or t
  modified_base (392)..(392): a, c, t, g, unknown or other
  misc_feature (392)..(392): n is a, c, g, or t
  modified_base (483)..(483): a, c, t, g, unknown or other
  misc_feature (483)..(483): n is a, c, g, or t
  modified_base (515)..(515): a, c, t, g, unknown or other
  misc_feature (515)..(515): n is a, c, g, or t
  modified_base (532)..(532): a, c, t, g, unknown or other
  misc_feature (532)..(532): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattgaggctgagcttgggttttccttgttgctattttagaaggtgtccagtgtgaggtgctaggttggtggaatcgtagggggtaaacttggtccagccgtgggggtccctgagctctcctgtgcagcctctggattcattatttagaatcagttggatgagttcggtccgcaggctccgaggggacggggntgggaggtgggtgccaatactaaaccacggataggaactaagaaaagctagtgngactcgngtgaacgggtcgattccacgtctccagacacaacgctaagtaactcactgtattagactaaatagaacacgtccagtagagacgaacgacncggactataacttattagtagttaagtaaagnttagttacttgaatagngggtaggcgaacggtcgggttggtaac

SEQ ID NO: 299717 - DNA, 654 bp, Homo sapiens
  misc_feature: GZ8MTXP01A77PL.38.23.C01.1.454.CMB.2.raw
  modified_base (609)..(609): a, c, t, g, unknown or other
  misc_feature (609)..(609): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccgagccgtgggggtccctgaagctctcctgtgcagcctctggattcatattagtatcattggatgagttcggtccgcgaggctcgagggacgggctggaggtggtcggccaactaacgtaaaccgacgaagtacggaaactaaggaaaaacgactaaagtaggtggacttcgttagggtaggaacggggtcctagtttacccgacccgtacgtaccgaaggaacgaaccgaaaccgaccctaaaaggtaacttaccgtaaccgttagttaactttagaacctaaagttacgaaacgtacgaccgtaggacgacgtacggaaacgaccgacggaccctaattaattaagttattagtaaaggttaaatacgtaattacttanaagttaagtgggtcggacgtacgggttacgggtggttcgtttaag

SEQ ID NO: 299718 - DNA, 635 bp, Homo sapiens
  misc_feature: GZ8MTXP01ARTG0.38.23.C01.1.454.CMB.2.raw
  modified_base (314)..(314): a, c, t, g, unknown or other
  misc_feature (314)..(314): n is a, c, g, or t
  modified_base (354)..(354): a, c, t, g, unknown or other
  misc_feature (354)..(354): n is a, c, g, or t
  modified_base (371)..(371): a, c, t, g, unknown or other
  misc_feature (371)..(371): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctcgtggcgagacgggccaccatcaactgacaagtccagccagtagttctttgtcagtctaccaagaatagtgtagtcgttaagcgttacggtaccaacaagaaacgcacgacacgtacccctagtnctactatttatgtcatctacgtcggtggtcccggtccccnggacgtatcgagcggcngcgatcgtggacagtcttacactctaccacctataccagaccacgtccctgaccgacgtaacgtagtaaacgtatcggggtacggtagttaacggttttaaaccttgtagtactacggtaactaatttaagttaaacgtgggtaacttcccggttcgggtccttcgtaaccgggtttccccggggaggggttaaccggggaaacccggtaaaggggttcgggaagtaaacggacccgttaaaaggccggttaaaccggttgggg

SEQ ID NO: 299719 - DNA, 722 bp, Homo sapiens
  misc_feature: GZ8MTXP01AI7IQ.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtagggggaaacttggtccagccgtgggggtccctgagctctcctgtgcagcctctggattcatattagtaatcattggatgagttgggtcccgcgaggctccgaggggacgggggcgtggaggtgggggtcggaccctaacgtaataaacccacggatacggggaaacttagaaaaaagtactaaaagttggtaaggaacttcgtagggtacggtaacggggtccgtaacttcccgtaaccccgttcgttaccccgaaggtaaaccggaacccgtaaacccgggaacccccaaaagggttaaacctttaccctaacccgtttagttaacgtttttaacggaaccctaaaaggttacgaaaaccgtacgtacccgtaaggttacggaacgtacggaaacggaaccgaccgggtacctaaattattaaattagttagtaaacggttaaagtactacttagttacgttataaggttgggtggacccggtagggttaccgggttgcgtttaagg

SEQ ID NO: 299720 - DNA, 628 bp, Homo sapiens
  misc_feature: GZ8MTXP01BL7H1.38.23.C01.1.454.CMB.2.raw
  modified_base (506)..(506): a, c, t, g, unknown or other
  misc_feature (506)..(506): n is a, c, g, or t
  modified_base (527)..(527): a, c, t, g, unknown or other
  misc_feature (527)..(527): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcaggttggtggaatcgtagggggaaacttggtccaggccgtgggggtccctgagctctcctgtgcagcctctggtattcatattagatcattggatggtagttcgggcccgcgaggctaccggagggggacggggctgggaggtggggtcgacccacgtaactaaacccgacgtatacgggaaactaaggaaaaacgtacgtaaagttggtggtacttcgtagggtacgggtaacgggccgtattcccaccgtctaccgagacgaacaacgaccaaagtacttcacttgttattagactaaagtgaacngaccgtagagacgtacgaaanccgacgactaagttactaatttagttaggtaaagttaaagtatcttaacgttgattaaggtggggtcggacggtacgggttacggggtgttccgtttaagg

SEQ ID NO: 299721 - DNA, 599 bp, Homo sapiens
  misc_feature: GZ8MTXP01CQ09N.38.23.C01.1.454.CMB.2.raw
  modified_base (341)..(341): a, c, t, g, unknown or other
  misc_feature (341)..(341): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaagtgtccagtgtgaggtgcagttggtggaatcgtagggggaaacttggtccaggccgtgggggtccctgaagctctcctgtgcacgcctctggattcatattagtaatcattggatgtagttgggtccgcgaggctccgaggggacgggcgtgggaggtgggngccactaataaaccacgaactggaactagaaaaagctaagtgtgactcgtggtaggaagggccgattccaccgtctacccgagacgaaccaacgacaagaacttcacttagtattgaactaaagtacgaaactgacccgttagaacggtacggtacgaaacgacgaaccggacctaattaataatttaattaggtaattaaacgtatcttagttcgataagtgggtaacggcggtacgggttacgggtgcgtttaacg

SEQ ID NO: 299722 - DNA, 672 bp, Homo sapiens
  misc_feature: GZ8MTXP01BRS2A.38.23.C01.1.454.CMB.2.raw
  modified_base (598)..(598): a, c, t, g, unknown or other
  misc_feature (598)..(598): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcaggttggtggaatcgtagggggaaacttggtccagccgtgggggtccctgagctctcctgtgcagcctctggattcatatttagtaatcagttggatgtagttgggtccgccgaggctccgagggggacgggctgggagtggggtcgacctaactaactaaaccacgtaagtacggaaaacgtaagaaaaaacgtcgtaaagttgggtcggtacttcgtagggttacggaacggggtccgtattccgacccgttctacccgaagaacgacaaccgacctaaagtaacttcaacgttgttaactttagaaccaaagttcgaaactacgaccgttaggacgtacgtacgaaacggaactaccggactaagttacttaaattagttaaggtaagttaaaagtnttacgttaagtttcgaatttaaggtacggggtcggaacgggtacggggttaacggggtggttaaccgtttaagg

SEQ ID NO: 299723 - DNA, 631 bp, Homo sapiens
  misc_feature: GZ8MTXP01B0DRZ.38.23.C01.1.454.CMB.2.raw
  modified_base (208)..(208): a, c, t, g, unknown or other
  misc_feature (208)..(208): n is a, c, g, or t
  modified_base (307)..(307): a, c, t, g, unknown or other
  misc_feature (307)..(307): n is a, c, g, or t
  modified_base (397)..(397): a, c, t, g, unknown or other
  misc_feature (397)..(397): n is a, c, g, or t
  modified_base (407)..(407): a, c, t, g, unknown or other
  misc_feature (407)..(407): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcttgggttttccttgttgcttattttagaaggtgtccagtgtgaggtgcaggttggnggaatcgtagggggaaacttggtccaggccgtggggggtccctgagctctcctgtgcagcctctggattcatattagaatcattggatgagttgggccncgaggctcgagggggacgggctggaggtgggtcggaccaactaacgtaaaccacggaatagggaaactaaggaaaaaagtctaaattggnggacttacgngtagggaagggtcccgagttcccaccgtctaccgaaggacgaaccaaacgacccaaagtaacttagacttagttaatttacgaactaaaggtacgaaacacgtaccgtaagacgaggttacgaaacggacgtaacggacctaattaagttaatttagtttagtaagttaaaagatcttattcgattaagtgggtcggcgtacgggttacggtgttaacgttaag

SEQ ID NO: 299724 - DNA, 629 bp, Homo sapiens
  misc_feature: GZ8MTXP01D9C56.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcttgggttttccttgttgcttattttagaaggtgtccagtgtgaggtgctagttggtggaatcgtagggggtaaacttggtccaggccgtggggggtccctgaagctctctgtgcagcctctggattcatatttagaatctattggatgagttgggtccgccgaggtctcgagggggacgggctggggaggtgggtcggacctaactaactaaaacccacggtatagggaaaactaagaaaaaagtactaaagtgtcggaattccgtaggtggaaacgggcctattccaccgtctaccgaagaacgaccgaaacgacctaaaagaactttccattagtactttagaacaaaagtcgaaacacgtcgtagaagacgtacgaaaagcgaacgcctaagtaataagtttaattggtaaagttaaaagattcgatttggaattgtggggtaaggccggtaggttacggggttcggctttaag

SEQ ID NO: 299725 - DNA, 588 bp, Homo sapiens
  misc_feature: GZ8MTXP01ASKN4.38.23.C01.1.454.CMB.2.raw
  modified_base (283)..(283): a, c, t, g, unknown or other
  misc_feature (283)..(283): n is a, c, g, or t
  modified_base (400)..(400): a, c, t, g, unknown or other
  misc_feature (400)..(400): n is a, c, g, or t
  modified_base (405)..(405): a, c, t, g, unknown or other
  misc_feature (405)..(405): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagacctccctggctgtgtctcgtgggcgagacgggccaccatcaactgcaagtccagccagagttcttttgtcagcctaccaaagatatgtagttcttagcttgtaccagcaagaaancagacacgtcccctaagtcgctctatttagttgtcattcgtacgtcgggttcggtcccgggtcctcggacgtacgttcgaggcggacagcggatcgtggggactagtacttcactcncaccntcagctacgcctgcagactagaaagtcgtggtggacgtttagtttaacttcgagtctaagtataatttagttagtcggttacgtccttggccttcgttacggtttacggggcgggttaacggggaccgttaaggggtaacgaggtaaccgtaacgtaacgttacggtaacgttgggtaaccgg

SEQ ID NO: 299726 - DNA, 579 bp, Homo sapiens
  misc_feature: GZ8MTXP01BI3YB.38.23.C01.1.454.CMB.2.raw
  modified_base (290)..(290): a, c, t, g, unknown or other
  misc_feature (290)..(290): n is a, c, g, or t
  modified_base (432)..(432): a, c, t, g, unknown or other
  misc_feature (432)..(432): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatcgacccagtctccagactccctggctgtgtctcgtgggcgagacggccacatcaactgacaagtccagccagtattctttgtcagctacaaagaatatgtagttcgtaagcttaggtaaccagacaagaaancaaacgacacgtaccctaagttcgactactatttagttgtacagttcgtacgtcggggtacgtcccccggggtcctaggaccgtattcgacggcgcgagtacggtatcgtaggggaactagtacttcacttcacacatcgancagcctgacagactagaagtagtggacgtattaagtttctactgtacagtactaaagttatgtaaggtacttccggtcgttctacgtacggttcgggcgggaacggtaacgtaagggtgaaggacttacggaacgttaacgtaacgg

SEQ ID NO: 299727 - DNA, 761 bp, Homo sapiens
  misc_feature: GZ8MTXP01BA8TF.38.23.C01.1.454.CMB.2.raw
tcagtcgatcacgtcacgaccggtgctcgatttagtacacgtgattagggattggggggagctacaacaggcaggcaggggcagcaagatggtgttgcagaccccaggtcttcatttctctgttgctctggatctctggagcctacggggacatcgtgatcgacccagtctccagacctccctggctgtgtctcgtgggcgaggacgggccaccatcaactgacaagtccagccagtagttcttttgtcagcctaccaagtaatagtgtagttccgttagctttacggtaaccagacaaggaaacgcaacgacctacgtacccctaagttcgaccttatatttattcggtacctattaccgtacggttcggggttccggtccccccgggggtcccctaggaccccggtattccgaaacgggtcgggaacacgggcccgggtagtccgggtaggggactaaggttacttttacccaaccgttcctaccgaaccctaactcgacgaccgttaaccggtccctacggacgaaccggtacgttaagggaaacggtggtttaggggtcgttaaccgttttaagggtttaacttaacctgggtttacccaaaggtacccttaaaacttacgggtttagttaacggggttaaccttcccggttaccggccgttacccgttacggggtttacccgggggcgggggaaccggggtaaaccggttaaagggtccggtaaaggaccgttacggaacggttaaccgtaacggg

SEQ ID NO: 299728 - DNA, 801 bp, Homo sapiens
  misc_feature: GZ8MTXP01BW6TA.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcttgggttttccttgttgctattttagaaggtgtccagtgtgaggtgctagttggtggaatcgtagggggaaacttggtccagtccgtgggggtccctgagctctctgtgcagcctcgtggattcatatttagtaatctagttggatggaggtttcgggtccccgcgacggtccgtaccggagggggacggggtcgttggggaggttcgggggtcgggaccctaacgttaaacgtaaaacccgacgtaagtacgggaaaacgttaaggaaaaaaacgtcgttaaattgggtcggtaaaccttcgtaggtacgggaaacggggtcccgtaacgtttacccgtacccgttaccgtaccgtaaacggaacgtaacccgaaaccggaacccgtaaaacggttaactttaccgtaaaccgttagggtttaacttttaacgaaaccgttaaaaggtacggtaaaaccgtaccgggtacccgttaagggaaacgtaacggttaaccggaaaaccggtaaccgaaaccgggtaccctaaatttaaacttaagttttaaagtttaggttaaacgttaaaagttacttaacgttaagtttacgttagttaaggttgggtaacgggtacgggtacgggttacggggtggttaacgtttcgg

SEQ ID NO: 299729 - DNA, 620 bp, Homo sapiens
  misc_feature: GZ8MTXP01BFHQE.38.23.C01.1.454.CMB.2.raw
  modified_base (475)..(475): a, c, t, g, unknown or other
  misc_feature (475)..(475): n is a, c, g, or t
tcagtcgatcacgtcacgaccggtgctcgatttagtacacgtgattagggattgggggagctacaacaggcaggcaggggcagcaagatggtgttgcagaccccaggtcttcatttctctgttgctctggatctctggagcctacggggacatcgtgatcgacccagtctccagacctccctggctgtgtctcgtgggcgagacggccaccatcaactgacaagtccagccagtagttcttttgtcagctaccaaagtatatgtagttcgtagcgttaggtaccagcaagaaacgcaaccgactacgtacccctaagtcgactactatttattgtctatctacgtcgggtcgtcccccgggtcctagacgtctcgaagcggcgagcgagtcgtgggactagtacttcacgtcctacgacagtcaacgctacgcctagacagactaggaaatgtagggtacgtcgtttaaagtttnttaccgagttaccgataacttaaatttggttaaacgttcgggttaaccttccggtaacgttcccgtaaccgtttacgttccgggggaacggttaaccgggaaccgttaaggggcgtagtacgttacgaaacggttcgttaacggg

SEQ ID NO: 299730 - DNA, 667 bp, Homo sapiens
  misc_feature: GZ8MTXP01AJG20.38.23.C01.1.454.CMB.2.raw
tcagtcgatcacgtcacgaccggtgctcgatttagtacacgtgattagggattgggggtctcagagaggagccttagccctggactccatggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtggggggtccctgaagctctcctgtgcagcctctggattcatatttagtatcattggatgagttgggtccgcgaggctccgagggacgggctggaggtgggtgccatataaaccacgatggaactagaaaaagtctatgtggactctgtgaagggccgtatcaccgtctccagacgaacacgacaagtaactctaactgttatttacggactaaaactgtaaaccacgtacccttaggaacgtacggttaaccgaaacgtacccgaacggggtacccctaagttaaacgtttaaattttaaaggtttaggttaacgtttaaaaaaagggtacttaacccgttaaagttttaccggaagtttaaacggttcgggggtttaggggaaacccgggttaacggggtttaaccggggggttcggggtttaaacccggg

SEQ ID NO: 299731 - DNA, 590 bp, Homo sapiens
  misc_feature: GZ8MTXP01EBVHT.38.23.C01.1.454.CMB.2.raw
  modified_base (310)..(310): a, c, t, g, unknown or other
  misc_feature (310)..(310): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagacctccctggctgtgtctcgtgggcgaggacggccaccatcaactgacaagtccagccagtattcttttgtcagctaccaaagatagtgtagttcgtagcttaggacagacaagaaacgcacgacacgtaccctaagtcgctntatttgtgctatcgtacgtcgggtcgtcccggtcctcgacctatcgacggcgaacgagcggtatcggtagggactagtacttccgactctaccgacctatcgaagcaacgcctaggacacgactagaacgtatggggttacgtacgtttaagtttactacgtcgtacaacgtaataacttagttacgtcgtacgttcctgttccgtcgttacgggttacgggacggttacggaccgttaagggtcgagtaacgtacgaaggttcgtaacgttgggtaacg

SEQ ID NO: 299732 - DNA, 721 bp, Homo sapiens
  misc_feature: GZ8MTXP01DIW3B.38.23.C01.1.454.CMB.2.raw
  modified_base (660)..(660): a, c, t, g, unknown or other
  misc_feature (660)..(660): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagtcttgggttttccttgttgctattttagaaggtgtccagtgtgaggtgcgtaggttggtaggaatcgtagggggaaacttggtccagccgtgggggtcccctaggaacgtctctcctgtcgcacgtcctcgtggtattactatagtttaacgtatcgtagttgggattggtaggtttcgggtccccgcgacggtcctaccggagggggacggggtctagggaggttggggtcggaccctaaacgttaaacgtaaacccgacggtaaagttacgggaaaacttaaggaaaaaacgtcgttaaagtagttcggaacttcggtaggtaacgggaacgggtacctactccgaacccgttcacccggaagaacggaaccgaaacgaccctaaagtacttacgacttagttattacgactaaaggtcgaaacacgtccgtaaggaagacgtacgaaaacgtccgaaaccggtaccaaatttaattaatttaagttagtaaaggttaaaaacgttnttaacttagttacgaagttggtacgggtcggtaacggtagggttacgggtcgttcgttaag

SEQ ID NO: 299733 - DNA, 578 bp, Homo sapiens
  misc_feature: GZ8MTXP01CZP5S.38.23.C01.1.454.CMB.2.raw
  modified_base (286)..(286): a, c, t, g, unknown or other
  misc_feature (286)..(286): n is a, c, g, or t
  modified_base (323)..(323): a, c, t, g, unknown or other
  misc_feature (323)..(323): n is a, c, g, or t
  modified_base (369)..(369): a, c, t, g, unknown or other
  misc_feature (369)..(369): n is a, c, g, or t
  modified_base (414)..(414): a, c, t, g, unknown or other
  misc_feature (414)..(414): n is a, c, g, or t
  modified_base (434)..(434): a, c, t, g, unknown or other
  misc_feature (434)..(434): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcttgggttttccttgttgctattttagaaggtgtcagtgtgaggtgcagttggtggaatcgtagggggaaacttggtccagccgtgggggtccctgagctctcctgtgcagcctctggattcatatttagtaatnattggatgagttggccgcgaggctccgagggcgggcnggagtgggcgaccaataataaaccagacgtaggaaactagaaaaanctaaatgtggactcgtgtagaagggcctaatccacgtctacaganaacacgacaagtatacactnttattagacaaagtgaaactagaccgtagaagacgtagaaacgtacgaacgacctaagtattaagttaattagtaagttaaaaagtataacttattcgttaaagtgtagggtaacgtcgggaggttaccggggtgccgtttaag

SEQ ID NO: 299734 - DNA, 641 bp, Homo sapiens
  misc_feature: GZ8MTXP01ATA0W.38.23.C01.1.454.CMB.2.raw
  modified_base (463)..(463): a, c, t, g, unknown or other
  misc_feature (463)..(463): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctcgtggcgagaggccaccatcaactgacaagtccagccagtagttcttttgtcagctaccaaagatatgtagttcgtagcttaggtaccagacaagaaagtccaacgactacgtacccctaagttcgctactatttacgtggtctattccgtacggttcgggtacggtcccggggtccctggaccgtattacgacgtcggacgaagcggtatccgtgggaactagtctttcaccttctaccaccgatcacggtcacgcctagacgaacgactagaaagtntggggtacgtacgttagtttaactcgtagtacgtaagtataagttagttacgtggtaaccttcccgtcggttcccttacgttaccggtttccgggggacgggttaacggggttaaaccgttaaggggttaacgaaggtaaccgttaacgaacggacccgtaaggtttcggtaaccggg

SEQ ID NO: 299735 - DNA, 662 bp, Homo sapiens
  misc_feature: GZ8MTXP01B1T79.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgctagttggtggaatcgtagggggaaacttggtccagccgtgggggtccctgagctctcctgtgcagcctctggattcatatttagtaatctattggatggtacgttgggtccgccgtacggccgtccgagggggacgggggcgtgggaggtgggtcgacctaactaacgtaaaccgacgaagtaggaaactagaaaaaagctaaagtggtcggacgtcgtaggtaggaacggggtccgtacttcccgtacccgtctaccgaagacgaaccgaacgaccccaaagtaacttccagttacgttaagtttagaacctaaaaggttacgaaacgtacgtaccgtaggaggtacgtacgaaacgactaccggacctaattagtaatttaagttagttaagttaaagtactattagttcgttattaaggtggggtaacgtcgggtacgggttacggggtgaacgtttaacg

SEQ ID NO: 299736 - DNA, 703 bp, Homo sapiens
  misc_feature: GZ8MTXP01E10YT.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtgggggtccctgagctctcctgtgcagcctctggattcatatttagtaatcattggatgagttgggtccgcgaggctccgagggggacgggggcgtgggaggtggggtcggcccaactaagtaaacccacggactagggaaactagaaaaaagctaaatggtggactcgtagtagggaacggggtccgtattcccgacccgttctacccgaaggaacgaaccgaaaccggacccaaaagtaaactttaccgaacttagttaatttagaacctaaaaggttacgaaaccgtacgacccgttaaggaacgtacggtaaccgaaaacggaaccgaaccgggaccctaattaattaatttaagtttaggtaaagttaaaaaaggatttaaccttaagtttccggaagtttaaggtggggttaacggggtaccgggtaccggggttacgggggttcggttaaccgtttaacggg

SEQ ID NO: 299737 - DNA, 810 bp, Homo sapiens
  misc_feature: GZ8MTXP01BIYQ7.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcttgggttttccttgttgcttattttagaaggtgtccagtgtgaggtgctagttggtggaatcgtagggggtaaacttggtccaggtccgtgggggtccctagagtctctcctgtcgcacgcctctggattcatattagtatcattggatgagttcggtccgcgaggctccgaggggacgggtcgtgggagttcgggggtcggaccctaaacgtaacgttaaaaccccgaggtaacttacggggaaaaccttaaggaaaaaaaacggtacccttaaaggttacgggttaacgggtaaacctttcgttaggggttacgggtaaaccgggggtcccgttaaacgttttaccccgaacccccggttccgttaccccgaaaggaaccggaaacccgaaacccggaaaccccgtaaaaggtaaactttacctaaccgtttagtttaaacgtttcgaaaccgtaaacggttaacggaaacctaacggtaccccgttaaggaggtaacggtaacgaaaaccggtaacccgaccgggacctaaacttaagttaaagtttaagtttaagtaaacgttaaaaaggtacttaacgttacgtttacggttaagttaacggtggggtaaccgggacggacggggttaccggggtggttaacccgtttaaggg

SEQ ID NO: 299738 - DNA, 688 bp, Homo sapiens
  misc_feature: GZ8MTXP01BRR08.38.23.C01.1.454.CMB.2.raw
  modified_base (276)..(276): a, c, t, g, unknown or other
  misc_feature (276)..(276): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcttgggttttccttgttgcttattttagaaggtgtccagtgtgaggtgctaggttggtggaatcgtagggggtaaacttggtccaggtccgtgggggtccctggaagctctcctgtgcacgcctntggtattctatattagtaatctattggatggtacgttggcccgcgaggcctaccggagggggacggggcgtgggaggtcggggtcggaccaactaaactaaaccgaggaacgttaggaaactaaaggaaaaagtactaaagtaggtcggtactcgtagggtacgaacgggtccgtacttaccgaccgtctaccgaagacgaaccaacggacctaaagtaacttaccaacgttcgttaacttgaaacctaaagtacgaaaccgacgtacccgtaaggaacgtacggttacggaaaacggaccctaaccgggtaaccctaattaaaggttaatttaagtttagtaaagttaaaactgtaaccttagttccgaattggtcgggtaacgacggaccggttagggtcgttgttaacg

SEQ ID NO: 299739 - DNA, 643 bp, Homo sapiens
  misc_feature: GZ8MTXP01CV52L.38.23.C01.1.454.CMB.2.raw
  modified_base (461)..(461): a, c, t, g, unknown or other
  misc_feature (461)..(461): n is a, c, g, or t
tcagtcgatcacgtcacgaccggtgctcgatttagtacacgtgattagggattgggggagctacaacaggcaggcaggggcagcaagatggtgttgcagaccccaggtcttcatttctctgttgctctggatctctggagcctacggggacatcgtgatgacccagtctccagacctcccgtggctgtcgtctcgtggggcgaggacgggccacatcaactgacaagtccagccaagtacgtttcttttgtacacgactacaaagtatatgtagtcgttagcttaggaccagacaagaaacgccaacgactaccgttacccctaagttcgacttactattttagttggtactacttcgtacgtcggggttccggtccccccggggtcctagaccgtactcgaacggccgcgtagcggtaagtcggtaggaactagttacttccactcctacacactacganaccagtcctagacgtagacgtagaaggtacgttggtacggtatttaagtttactgtacttacgatactaattagttgtaaggttaaccttcggttacgcttaccggttcggttaaccgggcggggaaacggtaaccggtaaagggtccgaaagtacgttacgaacggttaacccggttaagg

SEQ ID NO: 299740 - DNA, 692 bp, Homo sapiens
  misc_feature: GZ8MTXP01EJNA0.38.23.C01.1.454.CMB.2.raw
  modified_base (261)..(261): a, c, t, g, unknown or other
  misc_feature (261)..(261): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcttgggttttccttgttgctattttagaaggtgtcagtgtgaggtgcagttggtggaatcgtagggggaaacttggtccagccgtgggggtccctgagctctcctgtgcngcctctggattcatatttagtaatcagttggatgagttgggccgcgaggctccgaggggcgggtctgggaggtgggtcggacctacgtaactaaaccgacgtaagtacggaaactaaggaaaaaacgtaccgtaaataggtcgggtaaccttcggttaggtacgggaaacggggtccgtaacttcctaccggtcctacgaagacgaaccaaacggaccctaaagtacttacaacgttagttaagtttacgactaaaacggttcgaaacgtacgaccgtaggaacgtaacgtaccggaaacaccgaaccggtacctaattaattaagtttaagtttaagtaaagttaaaaagtacttaacttaacgttttacggaattaaggtcgggtcgggtaacgggtacggggttacgggggtaacgttcgtttaacgg

SEQ ID NO: 299741 - DNA, 668 bp, Homo sapiens
  misc_feature: GZ8MTXP01EVVIP.38.23.C01.1.454.CMB.2.raw
  modified_base (190)..(190): a, c, t, g, unknown or other
  misc_feature (190)..(190): n is a, c, g, or t
  modified_base (248)..(248): a, c, t, g, unknown or other
  misc_feature (248)..(248): n is a, c, g, or t
  modified_base (420)..(420): a, c, t, g, unknown or other
  misc_feature (420)..(420): n is a, c, g, or t
  modified_base (424)..(424): a, c, t, g, unknown or other
  misc_feature (424)..(424): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctgttactacaggtgcctacggggacatcgtgatgacccagtctccagactccctggctgtntctcgtgggcgaggagggccaacgatcaactgacaagtccagccggtagtgttttaanacaactcaaagaataagagttcttagcttaggtaccagacaagaaaccacgacagcctactagctcgtccttcgtttaacgcgggtccctacgtaccccggggattcccgggggtcctaggtaacgtcttcgaggtcgggccggtcgggtcgagggaacagtacttcactcncacntcagcagcgtggcggtacgtagaaggtgtaggtcggttacgtttaattacgtcgggtacgtagtactaaggttacttaagttcgttaaccttcctacgtaacgttacggttttacgggcccggtaaacgggggtaacccgttaaagggtccggttaggaaacggtaacgttaccggttacgttaaacccgggtaaaccgttgggtaacgtaccgtaccggacctaacccggttaacttaacccg

SEQ ID NO: 299742 - DNA, 533 bp, Homo sapiens
  misc_feature: GZ8MTXP01EZDOD.38.23.C01.1.454.CMB.2.raw
  modified_base (255)..(255): a, c, t, g, unknown or other
  misc_feature (255)..(255): n is a, c, g, or t
  modified_base (341)..(341): a, c, t, g, unknown or other
  misc_feature (341)..(341): n is a, c, g, or t
  modified_base (345)..(345): a, c, t, g, unknown or other
  misc_feature (345)..(345): n is a, c, g, or t
  modified_base (374)..(374): a, c, t, g, unknown or other
  misc_feature (374)..(374): n is a, c, g, or t
  modified_base (445)..(445): a, c, t, g, unknown or other
  misc_feature (445)..(445): n is a, c, g, or t
  modified_base (447)..(450): a, c, t, g, unknown or other
  misc_feature (447)..(450): n is a, c, g, or t
  modified_base (492)..(492): a, c, t, g, unknown or other
  misc_feature (492)..(492): n is a, c, g, or t
  modified_base (497)..(497): a, c, t, g, unknown or other
  misc_feature (497)..(497): n is a, c, g, or t
  modified_base (530)..(530): a, c, t, g, unknown or other
  misc_feature (530)..(530): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagctgggggtccctgagctctctgtncagcctctggattcatattagtatcattggatgagttgggcctccgaggctcgagggacgggctggagtgggtgcactataaaccncganagaacgtagaaaaagctaaatgtcgtacntgtacgaaaggggccattcaaccgtctaccgagacacaacgaccaaagaattcatgaatttagacaaatanannnnagagagagacgagacatataattattagtagttaaagtatanacttnttagtaagtggtggcggtacggttacgggtcgngtg

SEQ ID NO: 299743 - DNA, 559 bp, Homo sapiens
  misc_feature: GZ8MTXP02FSKYC.38.23.C01.1.454.CMB.2.raw
  modified_base (388)..(388): a, c, t, g, unknown or other
  misc_feature (388)..(388): n is a, c, g, or t
tcagtcgatcacgtcacgaccggtgctcgatttagtacacgtgattagggattgggacaacaggcaggcaggggcagcaagatggtttgcagacccaggtcttcatttctctgttgctctggatctctggagcctacggggacatcgtgatgacccagtctccagactccctggctgtgtctctgggcgagagggccaccatcaactgcaagtccagccagagtctttgtcagctccaagatatgagttcgtagcttggtaccagcagaaagcacgacagtcccctaagttgctcatttatggtcatctactcgggtgtccggggtcctgaccccgattcagcggcagcggatcgtggacagtattcactctcacatcacgcacgccncgacacgacgtagaagtagtggtcgtacgttagtttacttacgttagtacgacgtaactaaagtttaagttagttacggtacgttccgtcgtcttacgttacggttcgggacggtacggtaacgtaaggtaggaacgtacgtaacggaacgtacgtaacgtcggtacgtcg

SEQ ID NO: 299744 - DNA, 539 bp, Homo sapiens
  misc_feature: GZ8MTXP02I8IT5.38.23.C01.1.454.CMB.2.raw
  modified_base (301)..(301): a, c, t, g, unknown or other
  misc_feature (301)..(301): n is a, c, g, or t
  modified_base (373)..(373): a, c, t, g, unknown or other
  misc_feature (373)..(373): n is a, c, g, or t
  modified_base (381)..(381): a, c, t, g, unknown or other
  misc_feature (381)..(381): n is a, c, g, or t
  modified_base (409)..(409): a, c, t, g, unknown or other
  misc_feature (409)..(409): n is a, c, g, or t
  modified_base (419)..(419): a, c, t, g, unknown or other
  misc_feature (419)..(419): n is a, c, g, or t
  modified_base (423)..(423): a, c, t, g, unknown or other
  misc_feature (423)..(423): n is a, c, g, or t
  modified_base (427)..(427): a, c, t, g, unknown or other
  misc_feature (427)..(427): n is a, c, g, or t
  modified_base (432)..(432): a, c, t, g, unknown or other
  misc_feature (432)..(432): n is a, c, g, or t
  modified_base (435)..(435): a, c, t, g, unknown or other
  misc_feature (435)..(435): n is a, c, g, or t
  modified_base (442)..(442): a, c, t, g, unknown or other
  misc_feature (442)..(442): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcgtggtttccgtgtaggctatttagaaggtgtccagtgtgaggtgcagttggtggaatctgggggaaacttggtccagcctgggggtccctgaagctctcctgtgcagcctctggattcatatttagaatcattggatgagttgggtccnccaggctccgaggggacggggctgggaggtggggtggccactataaaccacgatggaactagaaaagctaangtggactntgtgaagggccgattcacgtctccaganacaacgcaanaatnactntattntanaataganagacagagagacgagacgacgacatatattattagtagtaaagtaatactactagtataagtaggtacggtacggtacggtacggtacggtacgtag

SEQ ID NO: 299745 - DNA, 553 bp, Homo sapiens
  misc_feature: GZ8MTXP02IFY2V.38.23.C01.1.454.CMB.2.raw
  modified_base (296)..(296): a, c, t, g, unknown or other
  misc_feature (296)..(296): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagagtcttttgtcagctccaagaatatgagttcgtagcttggtaccagcagaaagcacgacacgtcccctaagtnctcatttatggtcattctacgtcgggtgtccggggtcctgacccgtattcagcggcagcggatcgtggggacagtactttcactctcaccatcagcagcctgcagactgaaagtatgtggtactagttttatactgtacagtctaaattattagtggtacttccgtcggtcttacgtacgtttcgggacggtaacgggtaacccaaggggttaacggaacgtaacgtacgaaaaggtccggtaaaacgttggtacgg

SEQ ID NO: 299746 - DNA, 531 bp, Homo sapiens
  misc_feature: GZ8MTXP02HSTGQ.38.23.C01.1.454.CMB.2.raw
  modified_base (379)..(379): a, c, t, g, unknown or other
  misc_feature (379)..(379): n is a, c, g, or t
  modified_base (426)..(426): a, c, t, g, unknown or other
  misc_feature (426)..(426): n is a, c, g, or t
  modified_base (443)..(443): a, c, t, g, unknown or other
  misc_feature (443)..(443): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcgtggtttcgtgtagctatttagaaggtgtcagtgtgaggtgcagttggtggaatctgggggaaacttggtccagcctggggggtccctgaagctctcctgtgcagcctctggattcattatttagtaatcattggatgagttgggtccgccaggctccgaggggacggggctggagtggggtggccactataaaccacgatgggaactgaaaaagctatgtggactntgtagaaggggcattcaccgtctccagagacaacgcaagaattcatntatttgcaaatgacaanacgagagagagagacgacgacatatattattagtagtaaagtatactactagtataagtggtacggcgtacggtacggtcggtacgtg

SEQ ID NO: 299747 - DNA, 536 bp, Homo sapiens
  misc_feature: GZ8MTXP02JVQ8Z.38.23.C01.1.454.CMB.2.raw
  modified_base (303)..(303): a, c, t, g, unknown or other
  misc_feature (303)..(303): n is a, c, g, or t
  modified_base (494)..(494): a, c, t, g, unknown or other
  misc_feature (494)..(494): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcgtgggttttcctgttgctattttagaaggtgtccagtgtgaagtgcagttggtggaatctgggggaaacttggtccagcctgggggtccctgaagctctcctgtgcagcctctggattcatatttagtaatcattggatgagttgggtccncaggctccgaggggacggggctggagtgggtggccactataaaccacgatggaaactagaaaaagactaagtgtgggactctgtgaagggccgattcaccgtctccagagacaacgcaagaattcactgtatttgacaaatgaacagcctagagagtacgaagacacggccatatattatgagtaaaagtntactattcataagtggtacggacggtacggtacgggtgctag

SEQ ID NO: 299748 - DNA, 526 bp, Homo sapiens
  misc_feature: GZ8MTXP02HMGOJ.38.23.C01.1.454.CMB.2.raw
  modified_base (519)..(519): a, c, t, g, unknown or other
  misc_feature (519)..(519): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagcctgggggtccctgaagctctcctgtgcagcctctggattcatattagtaatcattggatgagttgggtccgccaggctccgagggacggggctgggagtggggtggccactataaaccacgatggaactgaaaaagctatgtggactctgtgaagggcgattcaccgtctccagacgacaacgccaaagaattcactgtattgacaaatgaacagcctagagagtcgaaagcacggccaatatattattgtataaaagatacattcgataagtggagcgagtacgggngtactag

SEQ ID NO: 299749 - DNA, 527 bp, Homo sapiens
  misc_feature: GZ8MTXP02GLX7V.38.23.C01.1.454.CMB.2.raw
  modified_base (445)..(445): a, c, t, g, unknown or other
  misc_feature (445)..(445): n is a, c, g, or t
  modified_base (488)..(488): a, c, t, g, unknown or other
  misc_feature (488)..(488): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagcctggggggtccctgaagctctcctgtgcagcctctggattcatattagtaatcattggatgagttgggtccgccaggctccgagggacggggctggagtggggtggccactataaaccacgatggaactagaaaaagctatgtggactctgtgaagggccattcacgtctccagagacaacgccaagaattcactgtatttgacaaatgaaacngcctagagagtcgaagacacggcatatattatgtagtaaaagntacattcgaataagtggtaggcgagtacgggtggactag

SEQ ID NO: 299750 - DNA, 512 bp, Homo sapiens
  misc_feature: GZ8MTXP02FYEWQ.38.23.C01.1.454.CMB.2.raw
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagagttctttgtcagctccaagaatatgagttcgttagcttggtaccagcaagaaagcacgacacgtcccctaagtgctcatttatgtcatctacgtcgggtgtccggggtcctgaccgtattcagcgcagcggatcgtgggacagtatttcactctcaccatcagcagcctgcagactgaaagatgtggctagtttattactgtcagctaaatattagtgtagtcctcggctacgtacgtttcgggcggacgggaccgaaggtggaagagtacgaagacgaactggtagg

SEQ ID NO: 299751 - DNA, 550 bp, Homo sapiens
  misc_feature: GZ8MTXP02GZGD6.38.23.C01.1.454.CMB.2.raw
  modified_base (423)..(423): a, c, t, g, unknown or other
  misc_feature (423)..(423): n is a, c, g, or t
  modified_base (427)..(427): a, c, t, g, unknown or other
  misc_feature (427)..(427): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagagttcttttgtcagctccaaagaatatgagttcgttagcttggtaccagcaagaaagcacgacacgtcccctaagttgctactaattttagtggtacattcctacgtcggggtgtcccggggtcctggacccgattcgagcggcagcggatcgtgggacagtatttcactctcacatcagcagcctgcagactagaaagntagnggtctagtttataactgtcagtacaattattagtagtacgtccgtacggcttacgtacgtttcgggacggtaacgggtaccgaaagggtggaagaacgtacgaaagaccgtaacgtggtacgg

SEQ ID NO: 299752 - DNA, 492 bp, Homo sapiens
  misc_feature: GZ8MTXP02HW7LH.38.23.C01.1.454.CMB.2.raw
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctctgggcgagagggccacatcaactgcaagtccagccagagtctttgtcagctcaagatatgagttcgtagcttggtaccagcagaaagcacgacagtcccctaagtgctcatttatggtcatctactggtcgtcccggggtcctgaccgattcagcgcagcggatctgggacagtattcactctcaccatcagcagcctgcagactagaagatgtggcagtttatactgtcagcaatatatggtagtcctcggctactacgtttcggcgtaggaaccgtaaggtggagatacgaagcgtaacg

SEQ ID NO: 299753 - DNA, 537 bp, Homo sapiens
  misc_feature: GZ8MTXP02G3YEK.38.23.C01.1.454.CMB.2.raw
  modified_base (302)..(302): a, c, t, g, unknown or other
  misc_feature (302)..(302): n is a, c, g, or t
  modified_base (377)..(377): a, c, t, g, unknown or other
  misc_feature (377)..(377): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagcctgggggtccctgaagctctcctgtgcagcctctggattcatatttagaatcattggatgagttgggtccncaggctccgaggggacggggctggagtgggtggccatataaaccacgatggaactagaaaaagctatgtggactntggtgaaggggccattcaccgtctccagagacaacgcaaagactcactgtatttagacaaatgaacagacctagagagtacgaagacacggacatatatattgtagtaaaagactacaattcgaataagtcggtaggacgacggtacggggtcgacttag

SEQ ID NO: 299754 - DNA, 537 bp, Homo sapiens
  misc_feature: GZ8MTXP02GJBYY.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagcctgggggtccctgaagctctcctgtgcagcctctggattcatatttagtaatcattggatgagttgggtccgcaggctccgagggacggggctggagtggggtggccactataaaccacgataggaactagaaaaagctatgtggactctgtgaagggcgattcaccgtctccagacgacaacgacaagaatcgactgtatttgacaaatgaacagacctagacgagtacgaagacacggaccatatattattagtagtaaaagatacattgataagtggtacggcgacggtacgggtcggactag

SEQ ID NO: 299755 - DNA, 707 bp, Homo sapiens
  misc_feature: GZ8MTXP02FVIQ2.38.23.C01.1.454.CMB.2.raw
  modified_base (261)..(261): a, c, t, g, unknown or other
  misc_feature (261)..(261): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcgtgggttttccttgttgctattttagaaggtgtccagtgtgaggtgcagttggtggaatctgggggaaacttggtccagccgtgggggtccctgaagctctcctgtgcngcctctggattcatatttagaatcattggatgagttggtccgccaggctccgaggggacggggctggagtggggtggccactataaaccacgataggaactagaaaaagactaatggtggactctgtaggaaaggggccgtaaatttccgaacccgttctaccccgaagaacggaaacctaaaccgacccaaaaggtaaactttccaaaccttaggttaatttttacggaacctaaaaagttaggaaaacctacggacccgttaggaaaggaacggttaccgaaaacggaaccgaacccgggaccctaaagttaaacttaaacttttaacgtttaaggttaagttaaaaaaaacggtatttaaccgtaaaactttccgggtaaaattaaggttacggggttagggaaccgggtaaccggggtttaacggggggtacggtacgttag

SEQ ID NO: 299756 - DNA, 586 bp, Homo sapiens
  misc_feature: GZ8MTXP02IWH4R.38.23.C01.1.454.CMB.2.raw
  modified_base (337)..(337): a, c, t, g, unknown or other
  misc_feature (337)..(337): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggtttcctgttgctatttagaaggtgtccagtgtgaggtgcagttggtggaatcgtgggggaaacttggtccagccgtgggggtccctgagctctcctgtgcagcctctggattcattattagtatcattggatgagttgggtccgcaggctccgaggggacgggctggagtgggtgccatanaaaccacgatggaactagaaaaagctagtgtgggactcgtgtagaacggggtccgtaattccaacccgtctacccgagaacgaaccgaaaccgactaaacgtaacttctaaccttaggttatttagactaaagtacgaacacgccgtaggagtagtacgaagacacggaccagtatattattagtaagtaaaagattacgtaattcgaattaagtggtacggtacggtacggtacgggtggacgtttag

SEQ ID NO: 299757 - DNA, 550 bp, Homo sapiens
  misc_feature: GZ8MTXP02IK665.38.23.C01.1.454.CMB.2.raw
  modified_base (354)..(354): a, c, t, g, unknown or other
  misc_feature (354)..(354): n is a, c, g, or t
  modified_base (378)..(378): a, c, t, g, unknown or other
  misc_feature (378)..(378): n is a, c, g, or t
  modified_base (418)..(418): a, c, t, g, unknown or other
  misc_feature (418)..(418): n is a, c, g, or t
  modified_base (421)..(421): a, c, t, g, unknown or other
  misc_feature (421)..(421): n is a, c, g, or t
  modified_base (451)..(451): a, c, t, g, unknown or other
  misc_feature (451)..(451): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagagttcttttgtcagctaccaagaatatgtagttcgttagcttggtaccagcaagaaagcacgacacgtcccctaaagttcgctactattttatggtacatctacgtcggggtgtccggggtcctgaccgtnttcagcgcagcggatcgtgggacngtatttcactctcaccatcagcagcctgcagactgaaagntgnggactagtttatactgtacagactaaattnttaagtggtacttccgtcggctaccgtacgtttcgggacgggtaacgggacctaaaggggtcggaagaacgttacgaaaggccgtaaacgttggtacgg

SEQ ID NO: 299758 - DNA, 526 bp, Homo sapiens
  misc_feature: GZ8MTXP02JO969.38.23.C01.1.454.CMB.2.raw
  modified_base (389)..(389): a, c, t, g, unknown or other
  misc_feature (389)..(389): n is a, c, g, or t
  modified_base (412)..(412): a, c, t, g, unknown or other
  misc_feature (412)..(412): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagagtctttgtcagctcaagatatgagttcgttagcttggtaccagcagaaagcacgacacgtcccctaagttgctcatttattggtcatctacgtcgggtgtccccggggtcctgacccgattcgagcgcagcggatcgtgggacagtacttcactctcacntcagcagcctgcagactagaagntagtggactagtttactacgtgtacagactaatattagtcggtagtcctacggtcttcgtacgtttcggacggtacggaaccgtaaggtggacgtagacgtaacggcgtaaacg

SEQ ID NO: 299759 - DNA, 528 bp, Homo sapiens
  misc_feature: GZ8MTXP02J1W90.38.23.C01.1.454.CMB.2.raw
  modified_base (246)..(246): a, c, t, g, unknown or other
  misc_feature (246)..(246): n is a, c, g, or t
  modified_base (349)..(349): a, c, t, g, unknown or other
  misc_feature (349)..(349): n is a, c, g, or t
  modified_base (405)..(405): a, c, t, g, unknown or other
  misc_feature (405)..(405): n is a, c, g, or t
  modified_base (428)..(428): a, c, t, g, unknown or other
  misc_feature (428)..(428): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagagtctttgtcagctccaagaatntgagttcgtagcttggtaccagcagaaagcacgacagtcccctaagttgctctatttatggtcattctacgtcgggtgtccggggtcctgaccgatcagcgcngcgatcgtggacagtatttcactctcaccatcagcagcctgcagactgaaagatgngactagtttactacgtgtacganactaattattagtggtacgtccgtacggcctacgtacgtttccgggacggtacgggaaccgtaaagggtggaaggtactacgaaagcgtaacgtcgtcgg

SEQ ID NO: 299760 - DNA, 531 bp, Homo sapiens
  misc_feature: GZ8MTXP02FY52O.38.23.C01.1.454.CMB.2.raw
  modified_base (493)..(493): a, c, t, g, unknown or other
  misc_feature (493)..(493): n is a, c, g, or t
  modified_base (525)..(525): a, c, t, g, unknown or other
  misc_feature (525)..(525): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagccgtggggggtccctgaagctctcctgtgcagcctctggattcatattagtaatcattgatgagttggtccgccaggctcgagggacggggctggagtgggtggccactataaaccacgatggaactagaaaaagactatgtggactctgtagaagggccgattcaccgtctccagagacaacgaccaagaattcactgtatttgacaaatgaacagacctagagagtacgaagacacggacatatattattgtagtaaaagntacattgaataagtggtggcgacgtacggggngactag

SEQ ID NO: 299761 - DNA, 531 bp, Homo sapiens
  misc_feature: GZ8MTXP02GW5FH.38.23.C01.1.454.CMB.2.raw
  modified_base (295)..(295): a, c, t, g, unknown or other
  misc_feature (295)..(295): n is a, c, g, or t
  modified_base (298)..(298): a, c, t, g, unknown or other
  misc_feature (298)..(298): n is a, c, g, or t
  modified_base (333)..(333): a, c, t, g, unknown or other
  misc_feature (333)..(333): n is a, c, g, or t
  modified_base (411)..(411): a, c, t, g, unknown or other
  misc_feature (411)..(411): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctctgggcgagaggccaccatcaactgcaagtccagccagtagttctttgtcagctacaagatatgagttcgtagcttggtaccagcaagaaagcacgacacgtccctaagtnctntatttatgtcatctacgtcgggtgtcccgggtccngaccgattcgagcggcaggcggtatcgtgggactagtactttcactctcaccatcagcagcctgcagactagaaagtntggtacgcttagtttactactgtacagataaattattagtggtactccgtacggtctcgtacgttcgggacggtaacggaccgtagggtaaggagaacgtacgaagtaccgtaagtggcg

SEQ ID NO: 299762 - DNA, 510 bp, Homo sapiens
  misc_feature: GZ8MTXP02JZTX3.38.23.C01.1.454.CMB.2.raw
  modified_base (413)..(413): a, c, t, g, unknown or other
  misc_feature (413)..(413): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagagtctttgtcagctccaagaatatgagttcgtagcttggtaccagcagaaagcacgacagtcccctaagttgctctatttatggtcatctacgtcgggtgtccccggggtcctgaccgattcagcggcagcggatcgtgggacagacttcactctcacatcagcagcctgcagactagaagatgngactagtttatactgtcagctaatattaagtcggtagtcctcggtctctacgtttcggcggtacggaaccgaggtaggacgaagtcgaagcgtaacg

SEQ ID NO: 299763 - DNA, 522 bp, Homo sapiens
  misc_feature: GZ8MTXP02G8XRN.38.23.C01.1.454.CMB.2.raw
  modified_base (302)..(302): a, c, t, g, unknown or other
  misc_feature (302)..(302): n is a, c, g, or t
  modified_base (362)..(362): a, c, t, g, unknown or other
  misc_feature (362)..(362): n is a, c, g, or t
  modified_base (367)..(367): a, c, t, g, unknown or other
  misc_feature (367)..(367): n is a, c, g, or t
  modified_base (407)..(407): a, c, t, g, unknown or other
  misc_feature (407)..(407): n is a, c, g, or t
  modified_base (434)..(434): a, c, t, g, unknown or other
  misc_feature (434)..(434): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagagttctttgtcagctcaagaatatgagttcgtagcttggtaccagcaagaaagcaacgacacgtcccctaagttcgctnattttatggtacatctacgtcgggtgtccggggtcctgaccgattcagcgcagcgatcgnggacngtatttcactctcaccatcagcagcctgcagactgaaagntgtgtactagtttatactgtacagtanaaattattagtggtaactccgtcggtctactacgtttcgggacggtacggaaccgtaaggtggaagatacgaaagccgtaatcgggcg

SEQ ID NO: 299764 - DNA, 528 bp, Homo sapiens
  misc_feature: GZ8MTXP02JVWRD.38.23.C01.1.454.CMB.2.raw
  modified_base (489)..(489): a, c, t, g, unknown or other
  misc_feature (489)..(489): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagcctggggggtccctgaagctctcctgtgcagcctctggattcatatttagtaatcattggatgagttgggtccgccaggctccaggggacggggctgggagtggggtggccactataaaccacgatggaactgaaaaagctatgtggactctgtgaagggccgattcaccgtctccagagacaacgccaagaattcactgtatttgcaaatgaacagcctgagagtcgaagacacggcatatattattgtagtaaaagntacattcgataagtggtaggcgacggtacgggtggctag

SEQ ID NO: 299765 - DNA, 509 bp, Homo sapiens
  misc_feature: GZ8MTXP02GVM0F.38.23.C01.1.454.CMB.2.raw
  modified_base (372)..(372): a, c, t, g, unknown or other
  misc_feature (372)..(372): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagagtctttgtcagctccaagatatgagttcgtagcttggtaccagcagaaagcacgacagtcccctaagttgctcatttatggtcatctacgtcgggtgtccccggggtcctgaccgattcagcgcagcggatcgtgggacagtntttcactctcacatcagcagcctgcagactgaagatgtgctagtttatactgtcagctaaatattagtggtacgtcctacggtctacgtacgtttcggcggtacggaaccgtaggtcggagatacgaagacgtaacg

SEQ ID NO: 299766 - DNA, 496 bp, Homo sapiens
  misc_feature: GZ8MTXP02JVC0F.38.23.C01.1.454.CMB.2.raw
  modified_base (332)..(332): a, c, t, g, unknown or other
  misc_feature (332)..(332): n is a, c, g, or t
  modified_base (362)..(362): a, c, t, g, unknown or other
  misc_feature (362)..(362): n is a, c, g, or t
  modified_base (402)..(402): a, c, t, g, unknown or other
  misc_feature (402)..(402): n is a, c, g, or t
  modified_base (405)..(405): a, c, t, g, unknown or other
  misc_feature (405)..(405): n is a, c, g, or t
  modified_base (422)..(422): a, c, t, g, unknown or other
  misc_feature (422)..(422): n is a, c, g, or t
  modified_base (424)..(424): a, c, t, g, unknown or other
  misc_feature (424)..(424): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagagtctttgtcagctcaagaatatgagttcgtagcttggtaccagcagaaagcacgacagtcccctaagttgctcatttattggtcatctactcgggtgtccggggtccngaccgattcagcggcagcggatctgggacngtatttcactctcaccatcagcagcctgcagactgaaagntgngatagttatatgtacananatatagtagtacgtcgtcgtctcgtacgtcggacggacggacgaggtaagagacgacgacgacgacgtagtg

SEQ ID NO: 299767 - DNA, 543 bp, Homo sapiens
  misc_feature: GZ8MTXP02IWG01.38.23.C01.1.454.CMB.2.raw
  modified_base (391)..(391): a, c, t, g, unknown or other
  misc_feature (391)..(391): n is a, c, g, or t
  modified_base (395)..(395): a, c, t, g, unknown or other
  misc_feature (395)..(395): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctctgggcgagaggccaccatcaactgcaagtccagccagagttcttttgtcagctccaagaatatgtagttcgtagcttggtaccagcaagaaagcacgacacgtacccctaagttcgctctatttatggtcattctacgtcgggtcgtccggggtcctgaccgtatcgagcggcagcggatcgagggacagtatttcactctcaccntcancacgcctgcagactagaagagtgtggtctagtttatactgtacaagtactaaattattagtagttacgttccgtcggtcctcgtacgtttcgggacgggtaacgggaccgaagggtggacgtactacgaaagccgtaagtcggtacgg

SEQ ID NO: 299768 - DNA, 571 bp, Homo sapiens
  misc_feature: GZ8MTXP02J4GUH.38.23.C01.1.454.CMB.2.raw
  modified_base (251)..(251): a, c, t, g, unknown or other
  misc_feature (251)..(251): n is a, c, g, or t
  modified_base (305)..(305): a, c, t, g, unknown or other
  misc_feature (305)..(305): n is a, c, g, or t
  modified_base (350)..(350): a, c, t, g, unknown or other
  misc_feature (350)..(350): n is a, c, g, or t
  modified_base (408)..(408): a, c, t, g, unknown or other
  misc_feature (408)..(408): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagagtcttttgtcagctacaagatntgagttcgtagcttggacaacagaagcacgacacgtccctaagttgctcatttntgtcatctacgtcgggtgtccggggtcccctgacgatcagcggcngcgatcgtggacagtatttcactctcacatcagctagcctgaccgagactaggaaagngttggtcggtacttaaggttttacttaccgtggttacacggtactaaatttattaacgttcggttacgtccgtccggtccgtacgttaccggtttaccgggacgggtaacggggaaccgtaagggttacggaagacttacgaacggtaccgtaactttcgggg

SEQ ID NO: 299769 - DNA, 542 bp, Homo sapiens
  misc_feature: GZ8MTXP02F2WXF.38.23.C01.1.454.CMB.2.raw
  modified_base (449)..(449): a, c, t, g, unknown or other
  misc_feature (449)..(449): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtggggggtccctgaagctctcctgtgcagcctctggattcatatttagaatcattggatgagttgggtccgcaggctcgaggggacggggctgggagtgggtggccatataaaccacgatggaactagaaaaagctatgtgggactctgtagaaggggcattcaccgtctccagagacaacgccaagaatcactgtatttgactaaaatgaaacngacctagagagtacgaagacacggaccatatattattagtagtaaaagatacaatttcgataagtggtaggacgacggtacgggtggacttag

SEQ ID NO: 299770 - DNA, 564 bp, Homo sapiens
  misc_feature: GZ8MTXP02F66PD.38.23.C01.1.454.CMB.2.raw
  modified_base (460)..(460): a, c, t, g, unknown or other
  misc_feature (460)..(460): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtggggggtccctgaagctctcctgtgcagcctctggattcatattagtaatcattggatgagttgggtccgcaggctccgagggacggggctgggagtgggtggccactataaaccgacgagtaggaactagaaaaagactatgtggactctgtagaagggccgattcgaccgtctccagacgaacaacgaccaagaattcactagtatttagacaaaatcgaaanagacctgaagagtacgaagaacacggacctatataatttagttgtaagtaaaaacgatacaattcgaataagtgggtcggacgacgggttacgggtggacttag

SEQ ID NO: 299771 - DNA, 505 bp, Homo sapiens
  misc_feature: GZ8MTXP02F1QYD.38.23.C01.1.454.CMB.2.raw
  modified_base (358)..(358): a, c, t, g, unknown or other
  misc_feature (358)..(358): n is a, c, g, or t
  modified_base (368)..(368): a, c, t, g, unknown or other
  misc_feature (368)..(368): n is a, c, g, or t
  modified_base (418)..(418): a, c, t, g, unknown or other
  misc_feature (418)..(418): n is a, c, g, or t
  modified_base (440)..(440): a, c, t, g, unknown or other
  misc_feature (440)..(440): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctctgggcgagagggccacatcaactgcaagtccagccagagtcttttgtcagctccaaagaatatgagttcgttagcttggtaccagcaagaaaagcaacgacagtcccctaagttgctcatttatggtcatctactcggtcgtcccggggtccctgaccgattcagcgnagcggatcgngggacagtatttcactctcaccatcagcagcctgacagactgaaagatgnggactagtttatactgtcaganaatattatgtagtctcgtctctacgttcgtcggaggaacgaaggtagagagtacgaagacgaacg

SEQ ID NO: 299772 - DNA, 544 bp, Homo sapiens
  misc_feature: GZ8MTXP02GYVY3.38.23.C01.1.454.CMB.2.raw
  modified_base (500)..(500): a, c, t, g, unknown or other
  misc_feature (500)..(500): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttcctgttgctattttagaaggtgtccagtgtgaggtgcagttggtggaatcgtgggggaaacttggtccagcctggggggtccctgaagctctcctgtgcagcctctggattcatattagtatcattggatgagttggtccgcaggctccgagggacggggctggagtggggtgccatataaaccacgataggaactagaaaagctatgtgggactctgtagaagggccgattccacgtctccagagacacgacaagattcactgtattagactaaatcgaaacacgccgtagagaagtaccgaagacgacggacctaatattattattagtacgtaaaanactactattgaatgtggtacggacgtacggtacggcggtactag

SEQ ID NO: 299773 - DNA, 513 bp, Homo sapiens
  misc_feature: GZ8MTXP02IX1TG.38.23.C01.1.454.CMB.2.raw
  modified_base (340)..(340): a, c, t, g, unknown or other
  misc_feature (340)..(340): n is a, c, g, or t
  modified_base (406)..(406): a, c, t, g, unknown or other
  misc_feature (406)..(406): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagagtctttgtcagctcaagaatatgagttcgtagcttggtaccagcagaaagcaacgacacgtcccctaaagttgctctatttatggtcatctactcgggtgtccgggtcctgaccgnttcagcgcagcggatcgtgggacagtatttcactctacgaccatcagcagcctgcagactgaaagntgtgctagtttatactgtcagactaattattagtgtatcctacggtctcgtacgtttcggacggtacggaccgtagggcgaagtactacgaaagcgtaacgtgtacg

SEQ ID NO: 299774 - DNA, 499 bp, Homo sapiens
  misc_feature: GZ8MTXP02JYDPH.38.23.C01.1.454.CMB.2.raw
tcagtcgatcacgtcacgaccggtgctcgatttagtacacgtgattagggattgggggagctacaacaggcaggcaggggcagcaagatggtgttgcagacccaggtcttcatttctctgttgcttctggatctctggagcctacggggacatcgtgatgacccagtctccagactccctggctgtgtctctgggcgagaggccaccatcaactgcaagtccagccagagtcttttgtcagctcaagatatgagttcgttagcttggtaccagcagaaagcacgacagtccccaagttgctcatttattggtcatctactcggggtgtccccggggtccctgaccgattcagcgcagcggatctgggacagatttcactctcacatcagcagccctgcagactgaaagatgtggcagtttattactgtcagcaatattaatgtagtcctcggctctacgtttcggcggaggaaccgaggtggagatcgaagcgtaaacg

SEQ ID NO: 299775 - DNA, 550 bp, Homo sapiens
  misc_feature: GZ8MTXP02GABB4.38.23.C01.1.454.CMB.2.raw
  modified_base (419)..(419): a, c, t, g, unknown or other
  misc_feature (419)..(419): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagagtctttgtcagctcaagatatgtagttcgtagcttggtaccagacagaaagcacgacacgtcccctaagtgctctatttatgtcatctacgtcggggtcgtccccggggtcctgaccgtattcgaggcggcagcggatcgtgggacagtactttcactctcacatcagcacgcctgaccagactgaaagngtgtgacttagtttattactgtacagactaattagttagtaggttacgtccgtacggtcttccgtacggtttccgggacggtaacggggaaccgtaagggtacggagacgttacgaaacggtacgtaaacg

SEQ ID NO: 299776 - DNA, 531 bp, Homo sapiens
  misc_feature: GZ8MTXP02GGFIP.38.23.C01.1.454.CMB.2.raw
  modified_base (294)..(294): a, c, t, g, unknown or other
  misc_feature (294)..(294): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctctgggcgagaggccaccatcaactgcaagtccagccagagttctttgtcagctcaagatatgagttcgtagcttggtaccagcaagaaagcacgacacgtcccctaagtnctctatttatgtcatctacgtcgggtgtccggggtcctgaccgtattcagcggcagcggatcgtagggacagtatttcactctcaccatcagcagcctgacagactagaaagtgtgtggtactagtttactacgtgtacagtactaaattattagtggtacgtccgtcggtctacgtacgttcgggacggtacggaccgtaagggtgaagtagtacgaagtaccgtaacgtgtacgg

SEQ ID NO: 299777 - DNA, 531 bp, Homo sapiens
  misc_feature: GZ8MTXP02JR9YP.38.23.C01.1.454.CMB.2.raw
  modified_base (441)..(441): a, c, t, g, unknown or other
  misc_feature (441)..(441): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctcgtgggcgaggagggccaccatcaactgacaagtccagccagagttctttgtcagctcaagatatgagttcgtagcttggtaccagcagaaagcacgacacgtcccctaagttgctctatttagttggtcatctacgtcggggtcgtccccggggtccctgaccgtattcgagcgcagcgatcgtgggacagtattcactctcacatcagcagcctgcagactgaagatgtgctagtttatacgtgtcagtntaaatattagtcggtacgtcctacggtctacgtacgtttcgggacggtacgggaaccgtaagggtggacgtagtacgaacggacgtaacg

SEQ ID NO: 299778 - DNA, 514 bp, Homo sapiens
  misc_feature: GZ8MTXP02FNVGL.38.23.C01.1.454.CMB.2.raw
  modified_base (338)..(338): a, c, t, g, unknown or other
  misc_feature (338)..(338): n is a, c, g, or t
  modified_base (402)..(402): a, c, t, g, unknown or other
  misc_feature (402)..(402): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagagtctttgtcagctccaagatatgagttcgtagcttggtaccagcaagaaagcacgacagtcccctaagtgctcatttattggtcatctactcgggtgtccggggtcctgaccgnttcagcgcagcggatcgtgggacagtatttcactctcaccatcagcagcctgcagactgaaagntgtggctagtttatactgtcagctaaatattagtggtatcctcggactcgtacgtttcgggcggtaacgggaccaaagggtggaagacgtacaaaggacgaacgtggtacgg

SEQ ID NO: 299779 - DNA, 532 bp, Homo sapiens
  misc_feature: GZ8MTXP02I70RC.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttcctgttgctattttagaaggtgtccagtgtgaggtgcagttggtggaatctgggggaaacttggtccagcctgggggtccctgaagctctcctgtgcagcctctggattcatattagtaatcattggatgagttgggtcgccaggctccgagggacgggctggagtgggtggccactataaaccacgatggaactagaaaaagactatgtggactctgtagaagggcgattcgaccgtctcccagagacaacgaccaagaattcactagtatttgacaaatgaacagcctagagagtagaagacacggacatatattattgtagtaaaagatacattcgataagtaggtgacggacgtacgggtgacgttag

SEQ ID NO: 299780 - DNA, 539 bp, Homo sapiens
  misc_feature: GZ8MTXP02G9RU9.38.23.C01.1.454.CMB.2.raw
  modified_base (376)..(376): a, c, t, g, unknown or other
  misc_feature (376)..(376): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagcctggggggtccctgaagctctcctgtgcagcctctggattcatatttagaatcattggatgagttgggtccgcaggctccgaggggacggggctggagtggggtggcccacgtataaaccgacgatgggaactgaaaaagactangtggactctgtagaagggccgattcaccgtctccagagacaacgcaagaattcactgtatttgacaaatgaacagcctagagagtcgaagacacggccatatatattagtagtaaaagactacaattcgaataagtggtaggacgacgtacgggtcggactag

SEQ ID NO: 299781 - DNA, 517 bp, Homo sapiens
  misc_feature: GZ8MTXP02ISZ87.38.23.C01.1.454.CMB.2.raw
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctctgggcgagagggccacatcaactgcaagtccagccagagtcttttgtcagctccaagaatatgagttcgtagcttggtaccagcagaaagcacgacagtcccctaagttgctcatttatggtcatctactcgggtgtccggggtcctgaccgtattcgagcgcagcggatcgtgggaccagatttcactctcaccatcagcagccctgcagactgaagatgtggctagtttatactgtcagctaaatattatggtattctcggtctcgtacgtttcggacggaacgggtaccgtaaggtggaagtagtacgaagacggtaaacgtggttcgg

SEQ ID NO: 299782 - DNA, 554 bp, Homo sapiens
  misc_feature: GZ8MTXP02GDU21.38.23.C01.1.454.CMB.2.raw
  modified_base (403)..(403): a, c, t, g, unknown or other
  misc_feature (403)..(403): n is a, c, g, or t
  modified_base (423)..(423): a, c, t, g, unknown or other
  misc_feature (423)..(423): n is a, c, g, or t
  modified_base (426)..(426): a, c, t, g, unknown or other
  misc_feature (426)..(426): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctcgtgggcgagagggccaccatcaactgcaagtccagccagagttcttttgtcagctacaagatatgagttcgtagcttggtaccagcaagaaagcaacgacacgtacccctaagttcgctctatttatggtctatctacgtcgggtcgtccccggggtccctgaccgtattcgagcggcagcgatcgtgggacagtattcactctcaccatcancagcctgacagactgaaagntgngtactagtttatactagtcgagtactaattatagtggttacgtccgtcggtcttcgtaccgtttcgggacgggtaacgggaaccgtaaaggggttacggaacggtacgtaaccgaaggacgtaaacgg

SEQ ID NO: 299783 - DNA, 530 bp, Homo sapiens
  misc_feature: GZ8MTXP02GVXAF.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtggggggtccctgaagctctcctgtgcagcctctggattcatatttagtaatcattggatgagttgggtccgcaggctcgaggggacggggctggagtggggtggccactataaaccacgatggaactagaaaaagctatgtggactctgtgaaggggcgattcaccgtctccagagacaacgaccaagacttcactgtatttgacaaatgaacagcctagagagtacgaagacacggaccatatattatgtagtaaagatacattagataagtggtgcgacggtacgggtgctag

SEQ ID NO: 299784 - DNA, 498 bp, Homo sapiens
  misc_feature: GZ8MTXP02GHPJE.38.23.C01.1.454.CMB.2.raw
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagagtctttgtcagctccaagaatatgagttcgtagcttggtaccagcagaaagcacgacagtcccctaagttgctcatttatggtcatctactcgggtgtccccggggtccctgaccgattcagcgcagcggatctgggacagatttcactctcaccatcagcagcctgcagactgaagatgtggcagtttatactgtctagcaatattaatggtatcctcggcttcactttcggcggtacgggaaccaaggtgagatacaagcgtaaacg

SEQ ID NO: 299785 - DNA, 531 bp, Homo sapiens
  misc_feature: GZ8MTXP02JED0U.38.23.C01.1.454.CMB.2.raw
  modified_base (387)..(387): a, c, t, g, unknown or other
  misc_feature (387)..(387): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagagtctttgtcagctcaagaatatgagttcgtagcttggtaccagcagaaagcacgacagtcccctaagttcgctctatttattggtcatctacgtcggggtcgtccggggtcctcgaccgtattcagcggcagcggatcgtgggacagtatttcactctcaccntcagcagcctgcagactgaagatggtggctagtttattactgtcagtcaaattattagtggtacgtccgtcggtcttacgtacgtttcgggacggaacgggtaccaaggggtcggaacgatacgaaggacgtaacgtggtacgg

SEQ ID NO: 299786 - DNA, 527 bp, Homo sapiens
  misc_feature: GZ8MTXP02IOKDH.38.23.C01.1.454.CMB.2.raw
  modified_base (490)..(490): a, c, t, g, unknown or other
  misc_feature (490)..(490): n is a, c, g, or t
  modified_base (521)..(521): a, c, t, g, unknown or other
  misc_feature (521)..(521): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagcctgggggtccctgaagctctcctgtgcagcctctggattcatatttagaatcattggatgagttgggtccgcaggctcgagggacgggctggagtgggtgccactataaaccacgatggaaactagaaaaaagctaatgtggactctgtagaagggccattcaccgtctccagagacaacgcaagatcactgtattgactaaatgaacagcctagaagagtacgaaagacaacggccaatataattattgtataaaagntacattcgataagtggtagcgacggtacggngactag

SEQ ID NO: 299787 - DNA, 529 bp, Homo sapiens
  misc_feature: GZ8MTXP02G3Y1H.38.23.C01.1.454.CMB.2.raw
  modified_base (403)..(403): a, c, t, g, unknown or other
  misc_feature (403)..(403): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagagtctttgtcagctcaagaatatgagttcgtagcttggtaccagcagaaagcacgacagtcccctaagttgctcatttatggtcatctactcgggtgtccggggtcctgaccgattcaggcgcagcggatcgtgggacagtactttcactctcaccatcagcagcctgcagactgaaagntaggtggctagtttatactgtacagactaaattattaagtggtacgttccgtcggtcttcgtacgtttcgggccggtaagggaccgtaagggtggaagacgtacgaagacgtaaacgttggtacgg

SEQ ID NO: 299788 - DNA, 491 bp, Homo sapiens
  misc_feature: GZ8MTXP02IX997.38.23.C01.1.454.CMB.2.raw
  modified_base (425)..(425): a, c, t, g, unknown or other
  misc_feature (425)..(425): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagagtctttgtcagctccaagaatatgagttcgtagcttggtaccagcagaaagcacgacagtccctaagtgctcatttatggtcatctactcgggtgtccggggtcctgaccgattcagcgcagcggatcgtgggacagtatttcactctcaccatcagcagcctgcagactgaagatgtgctagtttatactgtcagcaatnttatggtatcgtcgctctacgtttcgcggtacggccgaaaggtgagatacgaaggcgaacgtgtgg

SEQ ID NO: 299789 - DNA, 518 bp, Homo sapiens
  misc_feature: GZ8MTXP02IOKO2.38.23.C01.1.454.CMB.2.raw
  modified_base (258)..(258): a, c, t, g, unknown or other
  misc_feature (258)..(258): n is a, c, g, or t
  modified_base (265)..(265): a, c, t, g, unknown or other
  misc_feature (265)..(265): n is a, c, g, or t
  modified_base (267)..(267): a, c, t, g, unknown or other
  misc_feature (267)..(267): n is a, c, g, or t
  modified_base (277)..(277): a, c, t, g, unknown or other
  misc_feature (277)..(277): n is a, c, g, or t
  modified_base (303)..(303): a, c, t, g, unknown or other
  misc_feature (303)..(303): n is a, c, g, or t
  modified_base (309)..(309): a, c, t, g, unknown or other
  misc_feature (309)..(309): n is a, c, g, or t
  modified_base (311)..(311): a, c, t, g, unknown or other
  misc_feature (311)..(311): n is a, c, g, or t
  modified_base (314)..(314): a, c, t, g, unknown or other
  misc_feature (314)..(314): n is a, c, g, or t
  modified_base (320)..(320): a, c, t, g, unknown or other
  misc_feature (320)..(320): n is a, c, g, or t
  modified_base (327)..(327): a, c, t, g, unknown or other
  misc_feature (327)..(327): n is a, c, g, or t
  modified_base (354)..(354): a, c, t, g, unknown or other
  misc_feature (354)..(354): n is a, c, g, or t
  modified_base (357)..(357): a, c, t, g, unknown or other
  misc_feature (357)..(357): n is a, c, g, or t
  modified_base (368)..(368): a, c, t, g, unknown or other
  misc_feature (368)..(368): n is a, c, g, or t
  modified_base (373)..(373): a, c, t, g, unknown or other
  misc_feature (373)..(373): n is a, c, g, or t
  modified_base (388)..(388): a, c, t, g, unknown or other
  misc_feature (388)..(388): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcgtggtttcgtgtaggcgtatttagaaggtgtcagtgtgaggtgcagttggtggaatctgggggaaacttggtccagccgtggggggtccctgagctctcctgtgcngctctgntnatattatatntatgtagtgtgtggtcgcgcgcgcgnggcggngnggnggtggngcactanaacagacagagagaaagatatgtgatntgngaggcgactcncgtcncagagacaacacaanatacactatattatataatagaacagacgtagagagacgaagacgacgacataatattattagtaagtaaagtaactactattagtagtaagtaggtacggtacggtacggtacgggtacggtacgtacg

SEQ ID NO: 299790 - DNA, 528 bp, Homo sapiens
  misc_feature: GZ8MTXP02JMGA0.38.23.C01.1.454.CMB.2.raw
  modified_base (490)..(490): a, c, t, g, unknown or other
  misc_feature (490)..(490): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttcctgttgctattttagaaggtgtccagtgtgaggtgcagttggtggaatctgggggaaacttggtccagcctgggggtccctgaagctctcctgtgcagcctctggattcatatttagtaatcattggatgagttgggtccgcaggctccgagggacggggctggagtgggtggccactataaaccacgatggaactagaaaaagctatgtggactctgtgaagggccgattcaccgtctccagagacaacgccaagaattcactgtatttgctaaatgaacagcctagagagtacgaagacacggaccatatattattgtagtaaaagntacattcgataagtggtaggcgacgtacgggtggctag

SEQ ID NO: 299791 - DNA, 522 bp, Homo sapiens
  misc_feature: GZ8MTXP02JTF7S.38.23.C01.1.454.CMB.2.raw
  modified_base (406)..(406): a, c, t, g, unknown or other
  misc_feature (406)..(406): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctctgggcgagaggccaccatcaactgcaagtccagccagagtctttgtcagctccaagaatatgagttcgttagcttggtaccagcagaaagcacgacagtcccctaagttgctcatttatggtcatctactcgggtgtccggggtcctgaccgattcagtcggcagcggatcgtgggaccaggactttcactctcaccgatcagcagccctgcagactgaanatgtgctagtttatactgtacagctaatattagtgtacgtcctacggtctcgtacgtttcggacggtacggtaccgaaagggttcggaagtacgtacgaaggtcgaactggtacgg

SEQ ID NO: 299792 - DNA, 543 bp, Homo sapiens
  misc_feature: GZ8MTXP02HSEAU.38.23.C01.1.454.CMB.2.raw
  modified_base (448)..(448): a, c, t, g, unknown or other
  misc_feature (448)..(448): n is a, c, g, or t
  modified_base (454)..(454): a, c, t, g, unknown or other
  misc_feature (454)..(454): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcgtgggttttcctgttgctattttagaaggtgtccagtgtgaggtgcagttggtggaatcgtgggggaaacttggtccagcctgggggtccctgaagctctcctgtgcagctctggattcatattagtaatcattggatgagttgggtccgcgaggctccgaggggacgggctgggagtggggtggccactaataaaccacgataggaactagaaaaagctaatgtggactctggtagaagggccgattccaccgtctccagagacaacgacaagaatcatgtattgacaaatgaanagtccngagagtacgaagacacggcaatatattagttgtaagtaaaatatactacttgattaagtcggaggtacgaccggtacgggtcgagttag

SEQ ID NO: 299793 - DNA, 535 bp, Homo sapiens
  misc_feature: GZ8MTXP02JAQN7.38.23.C01.1.454.CMB.2.raw
  modified_base (493)..(493): a, c, t, g, unknown or other
  misc_feature (493)..(493): n is a, c, g, or t
  modified_base (527)..(527): a, c, t, g, unknown or other
  misc_feature (527)..(527): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggtttcctgttgctatttagaaggtgtccagtgtgaggtgcagttggtggaatctgggggaaacttggtccagcctgggggtccctgaagctctcctgtgcagcctctggattcatatttagaatcattggatgagttggtccgcaggctccagggacggggctggagtgggtggccactataaaccacgatggaactagaaaaagactaatgtggactctgtgaaggggccgattcaccgtctccagagacacgacaagatcactagtattgactaaatgaacacgacctagaagagtacgaacgaacgacggaccatataattattagtagtaaaanatacattgaataagtggaggacgacggtacgggngacgttag

SEQ ID NO: 299794 - DNA, 546 bp, Homo sapiens
  misc_feature: GZ8MTXP02H143L.38.23.C01.1.454.CMB.2.raw
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagagtcttttgtcagctcaagaatatgagttcgtagcttggtaccagcagaaagcacgacagtcccctaagtgctcatttatggtcattctacgtcggggtcgtccggggtcctcgaccgtattcgagcggcaggccggatcgtgggacagtactttcactctcaccatcagcacgcctgcagactgaagatggtggtactagtttatactgtacagtactaattattagtggtacgtccgtcggtccttcgtaccggtttcgggacgggtacgggtaaccgaaaggggtggaacgtaagtacgaaagtcggtaacgttggtcgg

SEQ ID NO: 299795 - DNA, 513 bp, Homo sapiens
  misc_feature: GZ8MTXP02FOXMJ.38.23.C01.1.454.CMB.2.raw
  modified_base (434)..(434): a, c, t, g, unknown or other
  misc_feature (434)..(434): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagagtctttgtcagctccaagaatatgagttcgtagcttggtaccagcagaaagcacgacacgtcccctaagttgctcatttattggtcatctactcgggtgtccggggtcctgaccgattcagcgcagcgatcgtgggacagtatttcactctcaccatcagcagcctgcagactgaaagtatgtggctagtttattactgtcagctaaatnttatggtacgtctcggctcgtacgtttcggacggtacggaccgaaagggtggaagactacgaaagcgaaactggtacgg

SEQ ID NO: 299796 - DNA, 543 bp, Homo sapiens
  misc_feature: GZ8MTXP02IJJ93.38.23.C01.1.454.CMB.2.raw
  modified_base (418)..(418): a, c, t, g, unknown or other
  misc_feature (418)..(418): n is a, c, g, or t
  modified_base (434)..(434): a, c, t, g, unknown or other
  misc_feature (434)..(434): n is a, c, g, or t
tcagtcgatcacgtcacgaccggtgctcgatttagtacacgtgattagggattgggggagctacaacaggcaggtcaggggcagcaagatggtgttgcagacccaggtcttcatttctctgttgctctggatctctggagcctacggggacatcgtgatgacccagtctccagactccctggctgtgtctctgggcgagagggccacatcaactgcaagtccagccagagtcttttgtcagctccaagatatgagttcgtagcttggtaccagcaagaaagcacgacacgtcccctaagtgctcatttatggtcatctacgtcgggtgtccccggggtccctgaccgtattcacgcggcagcggatcgtgggactagtatttcactctcaccatcagcagcctgcagactgaagatgnggctaagtttattacngttacagtacaattattagtggtacgttccgtacgtcttaccgtacgtttcgggacggtacggggaaaccgtaaggggtacggaacggtaataccgaaggacgtaaacg

SEQ ID NO: 299797 - DNA, 568 bp, Homo sapiens
  misc_feature: GZ8MTXP02IVPT4.38.23.C01.1.454.CMB.2.raw
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagacctccctggctgtgtctcgtgggcgagagggccaccatcaactgcaagtccagccagagttcttttgtcagctacaagatatgagttcgtagcttggtaccagcagaaagcacgacacgtcccctaagttgctactatttatggtcatctacgtcggtcgtcccccggggtcctgaccgtattcgagcggcagcggatcgtagggactagtacttcactctcacatcagcagcctgacagactagaagtagtggtacggacttaagtttactacgtgttacgaacgtactaaattagttagtacggttacgttccgtcggtcttacgtaacgtttcggggaccggtaacggggaaccgtaaaggggtcggtaagtagtaaccgaaggacgtaacg

SEQ ID NO: 299798 - DNA, 513 bp, Homo sapiens
  misc_feature: GZ8MTXP02GGCG4.38.23.C01.1.454.CMB.2.raw
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagagtctttgtcagctcaagaatatgagttcgttagcttggtaccagcagaaagcacgacagtcccctaagtgctctatttatggtcatctacgtcgggtgtccccggggtcctgaccgattcagcgcagcgatcgtgggacagatttcactctcaccatcagcagcctgacagactgaagatgtggactagtttacttactgtcagacaattattataggtatccgtcggctcacgtttcggacggtaagggaaccgaaagggtggagagtacgaaggcgtaacgg

SEQ ID NO: 299799 - DNA, 533 bp, Homo sapiens
  misc_feature: GZ8MTXP02F841T.38.23.C01.1.454.CMB.2.raw
  modified_base (304)..(304): a, c, t, g, unknown or other
  misc_feature (304)..(304): n is a, c, g, or t
  modified_base (348)..(348): a, c, t, g, unknown or other
  misc_feature (348)..(348): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagccgtggggggtccctgaagctctcctgtgcagcctctggattcatatttagaatcattggatgagttgggtccncaggctcgagggacggggctggagtgggtggccactataaaccncgatggaactgaaaaagctatgtggactctgtgaagggcattcaccgtctccagagacaacgaccaagaattcactagtactttagacaaatgaacagcctagacgagtacgaagacacggaccatatattatgtagtaaaagatacattcgataagtggtaggacgacggtacgggcgacttag

SEQ ID NO: 299800 - DNA, 541 bp, Homo sapiens
  misc_feature: GZ8MTXP02GP2ZA.38.23.C01.1.454.CMB.2.raw
  modified_base (464)..(464): a, c, t, g, unknown or other
  misc_feature (464)..(464): n is a, c, g, or t
  modified_base (467)..(467): a, c, t, g, unknown or other
  misc_feature (467)..(467): n is a, c, g, or t
  modified_base (499)..(499): a, c, t, g, unknown or other
  misc_feature (499)..(499): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtgggggtccctgaagctctcctgtgcagcctctggattcatatttagtaatcattggatgagttggtccgcaggctcgagggcggggctggaggtgggtggccacgtataaaccacgatggaactagaaaaagactatgtggactcgtgtagaagggccgatccaccgtctaccagacgacaacgaccaaagaacttcgactagtatttagacaaatgaacagcctaganagngaacgacacgcatatattatagtagtaaaagntactatcgaataagtggacggcggacgtacggggtgacttag

SEQ ID NO: 299801 - DNA, 555 bp, Homo sapiens
  misc_feature: GZ8MTXP02FL05V.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagccgtgggggtccctgaagctctcctgtgcagcctctggattcatatttagaatcattggatgagttgggtccgcaggctccgaggggacggggctggagtgggtggccactataaaccacgataggaactagaaaaagactatgtggactcgtgtagaagggcattcaccgtctccagagacaacgaccaagaatcactagtatttagacaaatagaacagcctagaagagtacgaagacacggacatataattattagtaacgtaaaatactactaattgaataagtcgggtaggacggtacggtaacggggttgacgttaagg

SEQ ID NO: 299802 - DNA, 536 bp, Homo sapiens
  misc_feature: GZ8MTXP02IGKW1.38.23.C01.1.454.CMB.2.raw
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagacctccctggctgtgtctctgggcgagagggccaccatcaactgcaagtccagccagagtctttgtcagctccaagaatatgagttcgtagctggtaccagcagaaagcacgacagtcccctaagtgctcatttattggtcatctactcggtgtccccgggtccctgaccgattcagcgcagcgagtctaggggacagtactttcactctcaccatacagcagcctgacagactgaaagattaggtgtactaagtttattaacgtgttacagtacaattaattagtggttagtcccgtcgtcttacgtacgtttccgggacggtacgggaaccgtaaggtcggagataccgaaggacgtaacgg

SEQ ID NO: 299803 - DNA, 584 bp, Homo sapiens
  misc_feature: GZ8MTXP02GMA2L.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtgggggtccctgaagctctcctgtgcagcctctggattcatatttagtaatcattggatgagttgggtccgcgaggctcgaggggacggggcgtgggaggtggggtggccctaactaataaaaccacgaagtaggaaactagaaaaagactataggtgggactcgtaggtagaacggggccgtattccgacccgtctacccgagaacgaacaaccgaccaaagaattcaactgtatttagactaaatgaacagcctagagagtacgaagacgacggcatatatttatagtaagtaaaagactacgtattacgattaagtgggtggacggtacggtacggggtgacgttag

SEQ ID NO: 299804 - DNA, 530 bp, Homo sapiens
  misc_feature: GZ8MTXP02JEQ4H.38.23.C01.1.454.CMB.2.raw
  modified_base (304)..(304): a, c, t, g, unknown or other
  misc_feature (304)..(304): n is a, c, g, or t
  modified_base (409)..(409): a, c, t, g, unknown or other
  misc_feature (409)..(409): n is a, c, g, or t
  modified_base (449)..(449): a, c, t, g, unknown or other
  misc_feature (449)..(449): n is a, c, g, or t
  modified_base (452)..(452): a, c, t, g, unknown or other
  misc_feature (452)..(452): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcgtggttttccgtgttagcgtatttagaaggtgtccagtgtgaggtgcagttggtggaatctgggggaaacttggtccagccgtgggggtccctgaagctctcctgtgcagcctctggattcatatttagtaatcattggatgagttggtccncaggctccgagggacgggctgggagtggggtcggtccacgtataaaccacggaatggaactagaaaaagctaatgtggactctgtagagggccgattccacgtcnccagagacaacgcaagacttcactgtattgcaaatgaacngcnagagacaagacaggccatatattatgtacgtaaaatactacattagatgtcggacggacgtacggtacggtgacgtag

SEQ ID NO: 299805 - DNA, 552 bp, Homo sapiens
  misc_feature: GZ8MTXP02H6O82.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtgggggtccctgagctctcctgtgcagcctctggattcatatttagtaatcattggatgagttgggtccgccaggctccgagggacggggctgggagtgggtgccatataaaccagatggaactagaaaaagctaatgtggactctggtgaagggccattcaccgtctccagagacaatgaccaagatacactgtatttgacaaatgaacagcctagagagtacgaaagacgacggaccaataatatttaattagtaagtaaaaagtatactattacgaattagtagggtacggacgaacgggttacgggttaggacg

SEQ ID NO: 299806 - DNA, 589 bp, Homo sapiens
  misc_feature: GZ8MTXP02G1II4.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagccgtgggggtccctgaagctctcctgtgcagcctctggattcatatttagtaatcattggatgagttggtccgcaggctccgaggggacgggcgtggagtggggtggccactataaaccagagtaggaactagaaaaagactatgtgggactcgtaggtaggaaggggccgattccgaccgtctacccgagacgaccaacgacccaaagaacttactaactagtatttagactaaaatgaaacagcctagagagtacgaagacgacggaccataacttagttattaggttaagtaaaagtatactaagttacgtaataagttagggtacggacggtacggtaccggggtggacgtttag

SEQ ID NO: 299807 - DNA, 525 bp, Homo sapiens
  misc_feature: GZ8MTXP02H5FPN.38.23.C01.1.454.CMB.2.raw
  modified_base (301)..(301): a, c, t, g, unknown or other
  misc_feature (301)..(301): n is a, c, g, or t
  modified_base (363)..(363): a, c, t, g, unknown or other
  misc_feature (363)..(363): n is a, c, g, or t
tcagtcgatcacgtcacgaccggtgctcgatttagtacacgtgattagggattggggacaacaggcaggcaggggcagcaagatggtgttgcagaccccaggtcttcatttctctgttgctctggatctctggagcctacggggacatcgtgatgacccagtctccagactccctggctgtgtctctgggcgagagggccaccatcaactgcaagtccagccagagtcttttgtcagctccaaagatatgagttcgtagcttggtaccagcagaaagcacgacacgtcccctaagttgctnatttatggtcatctacgtcgggtgtccggggtcctgaccgtattcgagcggcaggcgatcgngggacagtatttcactctcaccatcagcagcctgcagctagaagatgtggtctagtttatactgtacagactaattattagtggtaacttccgtacggtctactacgtttcggacgggtacggaccgaagggtggagtagtacgaagcgtaacgttggacgg

SEQ ID NO: 299808 - DNA, 574 bp, Homo sapiens
  misc_feature: GZ8MTXP02FVO5D.38.23.C01.1.454.CMB.2.raw
  modified_base (351)..(351): a, c, t, g, unknown or other
  misc_feature (351)..(351): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctcgtgggcgagagggccaccatcaactgcaagtccagccagagttcttttgtcagctaccaagaatatgagttcgttagcttggtaccagcaagaaagcacgacacgtcccctaagttgctctatttatggtcatcttacgtcggggtgtcccggggtcctgaccgtnttcagcgcaggcggatcgtaggggactagtatttcactctcaccatcgagcacgccctgacagactaggaaagtataggtcggacttagtttacgttactacggtacagtactaaattagttaagtagggttacgtccgtcggtccttacgtacggtttcgggacgggtaacgggaccgtaaagggtcggaacgacgtacgaaggtacggtaacgtggtacgg

SEQ ID NO: 299809 - DNA, 527 bp, Homo sapiens
  misc_feature: GZ8MTXP02IF291.38.23.C01.1.454.CMB.2.raw
  modified_base (406)..(406): a, c, t, g, unknown or other
  misc_feature (406)..(406): n is a, c, g, or t
  modified_base (496)..(496): a, c, t, g, unknown or other
  misc_feature (496)..(496): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagccgtgggggtccctgaagctctcctgtgcagcctctggattcatattagtaatcattggatgagttgggtccgccaggctccgagggacggggctggagtgggtggccactataaaccacgataggaactagaaaaagactatgtggactctggtgaaggggcgattcaccgttcnccagacgaacaacgaccaagtaactcactgtatttgacaaatgaacagcctagagagtacgaagacacggcatatattatgtataaaagntacattgataagtgtgcgagtacggtgctag

SEQ ID NO: 299810 - DNA, 529 bp, Homo sapiens
  misc_feature: GZ8MTXP02JP4LX.38.23.C01.1.454.CMB.2.raw
  modified_base (304)..(304): a, c, t, g, unknown or other
  misc_feature (304)..(304): n is a, c, g, or t
  modified_base (494)..(494): a, c, t, g, unknown or other
  misc_feature (494)..(494): n is a, c, g, or t
tcagtcgatcacgtcacgaccggtgctcgatttagtacacgtgattagggagttgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagccgtggggggtccctgaagctctcctgtgcagcctctggattcatattagaatcattggatgagttgggtccncaggctccagggacggggctggagtggggtggccatataaaaccacgatggaaactgaaaaaagctaatgtggactctgtgaagggccgaattcaccgtctccagagacaacgccaaagaattcactgtatttgacaaatgaacagcctagagagtacgaaagacacggccatatattatgtagtaaaantacattcgataagtgtggcgacgtacgggtgctag

SEQ ID NO: 299811 - DNA, 524 bp, Homo sapiens
  misc_feature: GZ8MTXP02ITHK5.38.23.C01.1.454.CMB.2.raw
  modified_base (232)..(232): a, c, t, g, unknown or other
  misc_feature (232)..(232): n is a, c, g, or t
  modified_base (360)..(360): a, c, t, g, unknown or other
  misc_feature (360)..(360): n is a, c, g, or t
  modified_base (391)..(391): a, c, t, g, unknown or other
  misc_feature (391)..(391): n is a, c, g, or t
  modified_base (413)..(413): a, c, t, g, unknown or other
  misc_feature (413)..(413): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagagtcttgtnagctcaagaatatgtagttcgttagtcgttgtaccagcagaaagacacgacacgtccctaagtgctctatttattggtcatctacgtcggtcgtccgggtcccgtcgaccgtactcagcggcagcggntctggacagtattcactctcacatcaagcancctgacagtacagaaagattgnggtactaggtttattacgtgtcaagtacaattattagtaggtacgtcctcggtctcgtacgtttacggcgggaaggtaccaaggtcgagactcaaggtccaacgttgtcgg

SEQ ID NO: 299812 - DNA, 553 bp, Homo sapiens
  misc_feature: GZ8MTXP02H1O7T.38.23.C01.1.454.CMB.2.raw
  modified_base (383)..(383): a, c, t, g, unknown or other
  misc_feature (383)..(383): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagagtcttttgtcagctccaagaatatgagttcgtagcttggtaccagcagaaagcacgacacgtcccctaagtgctcattttatgtcattctactcgggtgtccggggtcctgaccgattcagcgcagcggatcgtgggacagtactttcactctcacccntcagcacgcctgcagactgaaagtatgtaggtctagtttattactgtacagtacaaattattagtggttacttccgtcggtcctactaccggtttccgggacgggtaacgggacccgtaaaggggttcggaacgtaagttaccgaaaggtaccggtaaacgttaggtcgg

SEQ ID NO: 299813 - DNA, 533 bp, Homo sapiens
  misc_feature: GZ8MTXP02H56AJ.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagcctgggggtccctgagctctcctgtgcagcctctggattcatatttagtaatcattggatgagttgggtccgccaggctccgaggggacggggctgggagtgggtggccactataaaccacgatggaactagaaaaagctaatgtggactctgtgaagggccgattcaccgtctccagagacaacgccaagaattcactgtattgacaaatgaacagcctagagagtacgaagacacggcatatattattagtagtaaaagatacattcgataagtggtaggacgtacggtacgggtgactag

SEQ ID NO: 299814 - DNA, 540 bp, Homo sapiens
  misc_feature: GZ8MTXP02IMXSW.38.23.C01.1.454.CMB.2.raw
  modified_base (299)..(299): a, c, t, g, unknown or other
  misc_feature (299)..(299): n is a, c, g, or t
  modified_base (344)..(344): a, c, t, g, unknown or other
  misc_feature (344)..(344): n is a, c, g, or t
  modified_base (476)..(476): a, c, t, g, unknown or other
  misc_feature (476)..(476): n is a, c, g, or t
  modified_base (504)..(504): a, c, t, g, unknown or other
  misc_feature (504)..(504): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattgggctgagctgggtttcctgttgctatttagaaggtgtccagtgtgaggtgcagttggtggaatctgggggaaacttggtccagccgtgggggtcctgaagctctcctgtgcagcctctggattcatatttagtaatcattggatgagttgggtccncaggctccgagggacggggctggagtgggtggcccatataaaccncgatggaactagaaaaagctaatgtggactctggtagaaggggccatttccgaccgtctcccagagacaacgacaagaaattcaactgtatttagactaaaatgaaacagtcctagacgagtacgaagaacncggaccatatattattagtagtaaaagntacaattcgataagtggtgacgagtacggtggctag

SEQ ID NO: 299815 - DNA, 561 bp, Homo sapiens
  misc_feature: GZ8MTXP02F6YOY.38.23.C01.1.454.CMB.2.raw
  modified_base (468)..(468): a, c, t, g, unknown or other
  misc_feature (468)..(468): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtgggggtccctgaagctctcctgtgcagcctctggattcatatttagtaatcattggatgagttgggtccgcgaggctccgaggggacggggctgggaggtggggtggccactataaaccgacgataggaactagaaaaagactatgtggactcgtgtagaagggccgtattccaccgtctacccgagacgacaacgaccaaagtaacttcacttgtatttagacaaatgaacngcctagagagtacgaagacacggaccatattattattagtaagtaaaagatacaattgaataagtggtaggacgtacggtacgggtgcgttag

SEQ ID NO: 299816 - DNA, 542 bp, Homo sapiens
  misc_feature: GZ8MTXP02HDZAF.38.23.C01.1.454.CMB.2.raw
  modified_base (304)..(304): a, c, t, g, unknown or other
  misc_feature (304)..(304): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttcctgttgctattttagaaggtgtccagtgtgaggtgcagttggtggaatctgggggaaacttggtccagccgtggggggtccctgaagctctcctgtgcagcctctggattcatatttagtaatcattggatgagttgggtccncaggctcgaggggacgggctggagtgggtggccatataaaccagataggaactagaaaaagctatgtgactctgtagagggccgattccaccgtctccagacgacaacgacaagattcactgtatttagactaaatgaacagcctagagagtacgaagacacggaccaatagttattagttgtaagtaaaagactacaattcgaataagtggtacggacgacggtacggtcggactag

SEQ ID NO: 299817 - DNA, 527 bp, Homo sapiens
  misc_feature: GZ8MTXP02GSRH5.38.23.C01.1.454.CMB.2.raw
  modified_base (441)..(441): a, c, t, g, unknown or other
  misc_feature (441)..(441): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggtttcctgtgctatttagaaggtgtccagtgtgaggtgcagttggtggaatctgggggaaacttggtccagcctgggggtccctgaagctctcctgtgcagcctctggattcatatttagtaatcattggatgagttgggtccgccaggctccaggggacggggctggagtgggtggccactataaaccacgatggaactgaaaaagctaatgtggactctgtgaagggccattcaccgtctccagagacaacgccaagaattcactgtatttgacaaatgaaacngcctagacgagtcgaagacacggccatatattattgtagtaaaagatacattcgataagtggtcggacgacggtacgggtggctag

SEQ ID NO: 299818 - DNA, 495 bp, Homo sapiens
  misc_feature: GZ8MTXP02JFXB2.38.23.C01.1.454.CMB.2.raw
  modified_base (357)..(357): a, c, t, g, unknown or other
  misc_feature (357)..(357): n is a, c, g, or t
  modified_base (431)..(431): a, c, t, g, unknown or other
  misc_feature (431)..(431): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagagtctttgtcagctccaagatatgagttcgttagcttggtaccagcagaaagcacgacagtcccctaagttgctcatttattggtcatctactcgggtgtccccggggtccctgaccgatttagcggcngcggatcgtgggacagatttcactctcacatcagcagcctgcagactgaagatgtgctagtttatactgtcagnaatatatgtagtctggctcactttcggacggtaggaccgaaggtggaagatacaagcgaactgg

SEQ ID NO: 299819 - DNA, 501 bp, Homo sapiens
  misc_feature: GZ8MTXP02J2OOT.38.23.C01.1.454.CMB.2.raw
  modified_base (412)..(412): a, c, t, g, unknown or other
  misc_feature (412)..(412): n is a, c, g, or t
  modified_base (434)..(434): a, c, t, g, unknown or other
  misc_feature (434)..(434): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacgggacatcgtgatgacccagtctccagactccctggctgtgtctctgggcgagagggccaccatcaactgcaagtccagccagagtcttttgtcagctccaagatatgagttcgttagcttggtaccagcagaaagcacgacagtcccctaagttgctcatttattggtcatctactcgggtgtccccggggtccctgaccattcagcgcagcggatctgggacagtatttcactctcaccatcagccagccctgccagactgaaagntgtggactagtttattactgtnagcaatattaatggtatcctcggctctacgtttcggcgaggaaccaaggtgagatcgaagcgtaacg

SEQ ID NO: 299820 - DNA, 543 bp, Homo sapiens
  misc_feature: GZ8MTXP02I9M8J.38.23.C01.1.454.CMB.2.raw
  modified_base (303)..(303): a, c, t, g, unknown or other
  misc_feature (303)..(303): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagccgtgggggtccctgaagctctcctgtgcagcctctggattcatattagtaatcattggatgagttgggtccncaggctccgagggacggggctggagtgggtgccactataaaccacgataggaactagaaaaagctatgtggactctgtgaagggcgtatccaccgtctcccagagacaacgaccaagaatcactgtatttgacaaatagaacagacctagagagtacgaagacacggccaatattattatagtagtaaaagatactaattacgataagtggtaggtacggtacggtacggggtgacgtag

SEQ ID NO: 299821 - DNA, 523 bp, Homo sapiens
  misc_feature: GZ8MTXP02IGF8J.38.23.C01.1.454.CMB.2.raw
  modified_base (305)..(305): a, c, t, g, unknown or other
  misc_feature (305)..(305): n is a, c, g, or t
  modified_base (357)..(357): a, c, t, g, unknown or other
  misc_feature (357)..(357): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagagtcttttgtcagctaccaagaatatgagttcgttagcttggtaccagcaagaaagcaacgacacgtcccctaaagttgctntatttatggtcattctacgtcgggtgtccggggtcctgaccgatcaggcgcngcgggatctggggacagtatttcactctcaccatcagcagcctgacagactagaagatgtggctagtttattaactgtacagactaattattatggtactccgtaggctcgtacgtttcggcggtacggccgaaaggtggaacgatacgaaagcgtaaactggtcg

SEQ ID NO: 299822 - DNA, 535 bp, Homo sapiens
  misc_feature: GZ8MTXP02IU6HS.38.23.C01.1.454.CMB.2.raw
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagagtcttttgtcagctccaagaatatgagttcgttagcttggtaccagcagaaagcacgacagtcccctaagttgctcatttatggtcatctacgtcgggtgtccggggtcctgaccgattcagcgcagcggatcgtgggacagatttcactctcacatcagcagcctgcagactgaagatgtaggctagtttatactgtcagctaaattattagtggtacgttcctcggtacttcgtacgtttcgggacgggtaacgggacccgtaaaggggttcggaagtacgtacgaaacggtcgtaaacgttggtacgg

SEQ ID NO: 299823 - DNA, 522 bp, Homo sapiens
  misc_feature: GZ8MTXP02HJYZS.38.23.C01.1.454.CMB.2.raw
  modified_base (405)..(405): a, c, t, g, unknown or other
  misc_feature (405)..(405): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagagtctttgtcagctccaagaatatgagttcgtagcttggtaccagcagaaagcacgacacgtcccctaagtgctcatttatggtcatctacgtcgggtgtccggggtcctgaccgattcgagcggcagcggatcgtgggacagtatttcactctcaccatcagcagcctgcagactgaaagntgtggtctagtttatactgtcagctaatattagtgtacgtcctcggtcttcgtacgtttcgggacgggacgggtaaccaaggggtggagtacgtacgaaaggccgaacgttggacgg

SEQ ID NO: 299824 - DNA, 535 bp, Homo sapiens
  misc_feature: GZ8MTXP02H4A3L.38.23.C01.1.454.CMB.2.raw
  modified_base (493)..(493): a, c, t, g, unknown or other
  misc_feature (493)..(493): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagctgggggtccctgaagctctcctgtgcagcctctggattcatatttagtaatcattggatgagttgggtccgccaggctccgaggggacggggcgtggagtgggtggccactataaaccacgataggaactgaaaaagctatgtggactctgtagaagggccgattcaccgtctcccagagacaacgccaagaattcactgtattgacaaatgaacagacctgagagtacgaagacacggacatatattattgtagtaaaagntacatttcgattaagtggaggtacgacgtacgggtgtactag

SEQ ID NO: 299825 - DNA, 539 bp, Homo sapiens
  misc_feature: GZ8MTXP02HC473.38.23.C01.1.454.CMB.2.raw
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagagttcttttgtcagctcaagaatatgagttcgtagcttggaccagcaagaaagcaacgacacgtcccctaaagttgctactattttatggtcatcctacgtcggggtcgtcccggggtcctcgaccgtattcgagcggcaggcggatcgtgggacagtatttcactctcacatcagcacgcctgcagactgaaagtatggtggactagtttattactgtacagactaaattattagtggtaacgtccgtcggcttacgtacgtttcgggacggaacgggaaccgaagggtaagagatacgaagacgaacgtgacgg

SEQ ID NO: 299826 - DNA, 517 bp, Homo sapiens
  misc_feature: GZ8MTXP02JG5H1.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagcctgggggtccctgaagctctcctgtgcagcctctggattcatatttagtaatcattggatgagttgggtccgcaggctccgagggacggggctggagtggggtggccactataaaccacgatggaactgaaaaagctatgtggactctgtgagggcgattcaccgtctccagagacaacgccaagattcactgtatttgcaaatgaacagcctgagagtcgaagacacggccagtatattatgtagtaaaagatcattcgataagtggtgcgacgtacggtgctag

SEQ ID NO: 299827 - DNA, 636 bp, Homo sapiens
  misc_feature: GZ8MTXP02H05R7.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttcctgttgctattttagaaggtgtccagtgtgaggtgcagttggtggaatcgtgggggaaacttggtccagccgtgggggtccctgagctctcctgtgcagcctctggattcattatttagtaatcattggatgagttggtccgcaggctccgaggggacggggctgggaggtggggtggccactaacgtaaaccgacgacgtagggaaacctaggaaaaaagtactagttggtgggtacttcgtaggtacggaaacggggccgtaatttcccgacccgtcctacccgagaacgaacaaaccgaccaaagtaaacttcaacttgtaatttaggacctaaaagttacgaaactacgaccgttaggaagaggtaacgaaaggaccgacggaccaattaattaattatttaggtaagtaaaagattactaatttacgattaagtcgggtaggacggtaacggtacggggtgacgtttagg

SEQ ID NO: 299828 - DNA, 486 bp, Homo sapiens
  misc_feature: GZ8MTXP02GYQCR.38.23.C01.1.454.CMB.2.raw
  modified_base (402)..(402): a, c, t, g, unknown or other
  misc_feature (402)..(402): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagagtctttgtcagctccaagaatatgagttcgttagcttggtaccagcagaaagcacgacagtcccctaagttgctcatttatggtcatctactcgggtgtccggggtcctgaccgatcagcgcagcggatctggacagatttcactctcaccatcagcagcctgcagactgaaagatgnggcagtttatactgtcagcaatattatgtatctcggctcactttcggcgtacggaccaaggtgagatcaagcgaacgtgtacgg

SEQ ID NO: 299829 - DNA, 535 bp, Homo sapiens
  misc_feature: GZ8MTXP02JSM0J.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagcctggggggtccctgaagctctcctgtgcagccctctggattcatattagtaatcattggatgagttggtccgcaggctcgagggcgggctggaggtgggtggccactataaaccacgatggaactagaaaaagactatgtggactctgtgaaggcgattcaccgtctccagacgacaacgcaagaattcgactgtatttagcaaatgaacagacctagagagtcgaagacgacggcctatagtaattattgtagtaaaagtatacattcgaataagtggtaggacgacggtacgggtggactag

SEQ ID NO: 299830 - DNA, 543 bp, Homo sapiens
  misc_feature: GZ8MTXP02F4IF2.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagcctgggggtccctgaagctctcctgtgcagcctctggattcatatttagaatcattggatgagttgggtccgcaggctccgagggacggggctggagtgggtggccactataaaccacgatggaactagaaaagactatgtggactcgtgtgaagggcgattcaccgtctccagagacaacgaccaagaattcactgtatttgacaaaatgaaacagcctagaacgagtacgaagacacggaccaatatattattagtagtaaaagatacaattcgaattaagtggtggacggtacggtacgggtgacgtaag

SEQ ID NO: 299831 - DNA, 577 bp, Homo sapiens
  misc_feature: GZ8MTXP02J10J9.38.23.C01.1.454.CMB.2.raw
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctctgggcgagaggccaccatcaactgcaagtccagccagtagttctttgtcagctaccaagaatatgagttcgttagcttggaccagcaagaaacgcacgacacgtacccctaagttcgctctatttattggtactattctacgtcggggtcgtcccggggtcctcggaccgtattcgaggcggcaggcggtatcgtgggactagtactttcactctaccacctatcagcacgcctgcagactaggaaagtagtggtaggtcttaagtttatactagtactaagtactaaattagtttagtaggtacgtccgtacggtctacgttacgttccgggacgggacgggaaccgtaaggggtaaggaacgtagtacgaacggacgaaacgtggtacgg

SEQ ID NO: 299832 - DNA, 533 bp, Homo sapiens
  misc_feature: GZ8MTXP02GQM2H.38.23.C01.1.454.CMB.2.raw
  modified_base (414)..(414): a, c, t, g, unknown or other
  misc_feature (414)..(414): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagagtcttttgtcagctccaagatatgattcgttagcttggtaccagcagaaagcacgacacgtcccctaagttcgctctatttattggtcatctactcgggtgtccccggggtcctgaccgtattcagcggcagcggatcgtgggacagtactttcactctcacatcagcagcctgcagactgaagntgtgactagttatactgtcagtctaatattacgtggtacgtccgtcggacttcgtacgtttcgggacgggtaacggtaaccgtaaaggggtggaacgacgtacgaacggacgtaaacgg

SEQ ID NO: 299833 - DNA, 534 bp, Homo sapiens
  misc_feature: GZ8MTXP02GF6UO.38.23.C01.1.454.CMB.2.raw
  modified_base (298)..(298): a, c, t, g, unknown or other
  misc_feature (298)..(298): n is a, c, g, or t
  modified_base (346)..(346): a, c, t, g, unknown or other
  misc_feature (346)..(346): n is a, c, g, or t
  modified_base (427)..(427): a, c, t, g, unknown or other
  misc_feature (427)..(427): n is a, c, g, or t
  modified_base (493)..(493): a, c, t, g, unknown or other
  misc_feature (493)..(493): n is a, c, g, or t
  modified_base (527)..(527): a, c, t, g, unknown or other
  misc_feature (527)..(527): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggtttcctgtgctatttagaaggtgtccagtgtgaggtgcagttggtggaatctgggggaaacttggtccagcctgggggtccctgaagctctcctgtgcagcctctggattcatatttagaatcattggatgagttgggtccncctaggctccgagggacggggctgggagtgggtggccactataaaccncgatggaactagaaaagctatgtggactctgtagaggggccattcaccgtctaccagacgacaacgccaaagattacactntatttgacaaatgaacagacctgaagagtacgaagacacggaccattatattattagtaagtaaantacaagtcataagtggtaggacgaggttacgggngtacgtg

SEQ ID NO: 299834 - DNA, 611 bp, Homo sapiens
  misc_feature: GZ8MTXP02IUFSZ.38.23.C01.1.454.CMB.2.raw
  modified_base (304)..(304): a, c, t, g, unknown or other
  misc_feature (304)..(304): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtgggggtccctgaagctctcctgtgcagcctctggattcatatttagtaatcatggatgagttgggtccnccaggctccgaggggacgggcgtggaggtggggtggccaacgtagtaaaaccacgaagtaggaaactagaaaaaagctaagtagtgggaactcgtaggtaggaacggggccgatttcccgaccgtctacccgaagacgaacaacgacccaaagaacttacactagtatttagacaaatagaacagaccgttagaacgagtacgaaagaacgacggacctaataattaattattaggttaagtaaaaagtactactaaacttgaataagttagggtcggtacggacggtaacggggtggacctttaag

SEQ ID NO: 299835 - DNA, 516 bp, Homo sapiens
  misc_feature: GZ8MTXP02FXDGI.38.23.C01.1.454.CMB.2.raw
  modified_base (389)..(389): a, c, t, g, unknown or other
  misc_feature (389)..(389): n is a, c, g, or t
  modified_base (410)..(410): a, c, t, g, unknown or other
  misc_feature (410)..(410): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagagtctttgtcagctccaagatatgagttcgttagcttggtaccagcagaaagcacgacagtcccctaaagttcgctctatttattggtcatctactcgggtcgtccccggggtccctgaccgattcagcgcagcggatcgtgggacagattcactctcacntcagcagcctgcagactgaanagtgtgacgtagtttatactgtcagactaatattataggtagtcctcggacttcgtacgtttcggcggtacggaaccgaagggtcgagacgtacgaacgcgtaacg

SEQ ID NO: 299836 - DNA, 573 bp, Homo sapiens
  misc_feature: GZ8MTXP02HG6OS.38.23.C01.1.454.CMB.2.raw
  modified_base (305)..(305): a, c, t, g, unknown or other
  misc_feature (305)..(305): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggtttccttgttgctattttagaaggtgtccagtgtgaggtgcagttggtggaatcgtgggggaaacttggtccagccgtggggggtccctgaagctctcctgtgcagcctctggattcattattagtaatcattggatgagttgggtccncgaggctccgaggggacggggctggaggtgggtgccatataaaccacgataggaactagaaaaagactagtgtggactctgtagaagggccgattccaccgtctcccgagagaaccaaacgacccaaagaacttacaacgttagttactttagactaaaatagaaacagcctagaagagtacgaagacacggacaagtattaatattgtaaagtaaaacgatacgattacgaataagtggtaggcggtacggtacggggtcgacttag

SEQ ID NO: 299837 - DNA, 545 bp, Homo sapiens
  misc_feature: GZ8MTXP02FUREB.38.23.C01.1.454.CMB.2.raw
  modified_base (442)..(442): a, c, t, g, unknown or other
  misc_feature (442)..(442): n is a, c, g, or t
  modified_base (496)..(496): a, c, t, g, unknown or other
  misc_feature (496)..(496): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagccgtgggggtccctgaagctctcctgtgcagcctctggattcatatttagtaatcattggatgagttggtccgcaggctcgagggacgggctggagtgggtggccactataaaccacgatggaactagaaaagctatgtggactctgtgagggcgattcacgtctcagagacaacgccaagaattcactagtatttagacaaattcgaaacncggacctagaacgagtacgaagacgacggaccatatattatgtagtaaaaagtntactagttacgaataagtcggtacggacggtacggtacgggtcgactag

SEQ ID NO: 299838 - DNA, 687 bp, Homo sapiens
  misc_feature: GZ8MTXP02H8SDV.38.23.C01.1.454.CMB.2.raw
  modified_base (310)..(310): a, c, t, g, unknown or other
  misc_feature (310)..(310): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgagtgcagttggtgaatcgtgggggaaacttggtccaggccgtggggggtcccctgaagctctcctgtgcagcctctggattcattatttaagtaatcattggatgtagttgggtcccncgaggtcctccgaggggcgggcgtggaggtgggtggccataactaaaccagactaggaactagaaaaagctaagtggtgtacttctgtaggaacggggccgtatttaccacccggttcacccgaagaacgaaccaaaccgacccgtaaagaaactttaccacgttagttaatttccggaaactaaaacgtacggtaaaaccacggacccgtaaggagtaaacggtaccgaaaaggacccgaaacccggacctaaagttaacttaaatttaacgtttagtaaagtaaaaaacgtattaaccgtaaatttaagaattaaggttacggggttacgggacccggttaacggggttaaccgggggtagtacccgtttaaggg

SEQ ID NO: 299839 - DNA, 546 bp, Homo sapiens
  misc_feature: GZ8MTXP02JUZQZ.38.23.C01.1.454.CMB.2.raw
  modified_base (342)..(342): a, c, t, g, unknown or other
  misc_feature (342)..(342): n is a, c, g, or t
  modified_base (347)..(347): a, c, t, g, unknown or other
  misc_feature (347)..(347): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagccgtggggggtccctgaagctctcctgtgcagcctctggattcattatttagtaatcattggatgagttgggtccgccaggctccgagggcgggctggagtgggtgccatanaaacncgatgaactagaaaaagctagtgtggactcgtgtagaagggccgattccaccgtctaccagagacaacgaccaagaatcactagtattagactaaatgaacagacctagaagagtacgaagacacggacatatattattagtagtaaaagatactattcgaataagtaggtaggacggtacggtacggggtcgacgtag

SEQ ID NO: 299840 - DNA, 530 bp, Homo sapiens
  misc_feature: GZ8MTXP02JT9HM.38.23.C01.1.454.CMB.2.raw
  modified_base (410)..(410): a, c, t, g, unknown or other
  misc_feature (410)..(410): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagatcttttgtcagctccaagaatatgagttcgtagcttggtaccagcagaaagcacgacacgtcccctaagttcgctctatttattggtcatctactcgggtgtccggggtcctcgaccgattcagcggcagcggatcgtggggacagtatttcactctcaccatcagcagccctgcagactgaaagntggtggctagtttattactgtacagactaaattattagtggttacgtcccgtcggcttccgtacgtttcgggacgggacggaaccgtaagggtggagacgtacgaagcgaacgtgtacgg

SEQ ID NO: 299841 - DNA, 520 bp, Homo sapiens
  misc_feature: GZ8MTXP02JQGEB.38.23.C01.1.454.CMB.2.raw
  modified_base (344)..(344): a, c, t, g, unknown or other
  misc_feature (344)..(344): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagcctgggggtccctgaagctctcctgtgcagcctctggattcatatttagaatcattggatgagttgggtccgcaggctcagggacggggctggagtgggtgccactataaaccncgatggaactgaaaagctatgtggactcgtgtagaaggggccattcaccgtctcccagagacaacgccaagaattcactgtattgcaaatgaacagcctgacgagtacgaagacacggccatatattatgtagtaaaagatacattcgataagtggtggcgacgtcgggtagctag

SEQ ID NO: 299842 - DNA, 529 bp, Homo sapiens
  misc_feature: GZ8MTXP02HXVAE.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagcctgggggtccctgaagctctcctgtgcagcctctggattcatattagtaatcatggatgagttgggtccgccaggctccgagggacggggctggagtggggtggccatataaaccacgatggaactgaaaaagactaatgtggactctgtgaaggccgattcaccgtctccagagacaacgaccaagaattcaactgtattgacaaatgaacagacctgagagtcgaaagacacggcataatattattgtagtaaaagatacattcgataagtggtagacgtacgtacgggtgactag

SEQ ID NO: 299843 - DNA, 520 bp, Homo sapiens
  misc_feature: GZ8MTXP02F4MEE.38.23.C01.1.454.CMB.2.raw
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagagtctttgtcagctccaagaatatgagttcgtagcttggtaccagcagaaagcacgacacgtcccctaagtgctcatttattggtcatctacgtcgggtgtcccggggtcctcgaccgattcgagcggcagcggatcgtgggacagtactttcactctcaccatcagcagcctgacagactgaaagatgtggactagtttatactgtacagtctaaatattagtgtagtcctcggtctcgtacgttcggcggtaacggaccgaaggtgaagagtacgaacgacgtaacgtggtacgg

SEQ ID NO: 299844 - DNA, 622 bp, Homo sapiens
  misc_feature: GZ8MTXP02IAOPA.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagcctgggggtccctgaagctctcctgtgcagccctctggattcattattagtaatcattggatgagtttgggtccgccaggctccgagggacggggctggagtggggtggccactataaaccacgatggaaactgaaaaagctagtgtcggacctgtagtagggaacggcgtactacccgaccttccacgagaacgaacgaacccgaacgaaagtaacttacacgttagtttagttacgaaactaaagtaacgaaacgacgtaccgtagaagacgtaaacggaacgaacgaccgactaataattattagtttagtaaaagtaaagtactacgtacgttagtaagtaaggttgggacggtacggtaacgggtacggggtacggtaacgtttcgg

SEQ ID NO: 299845 - DNA, 559 bp, Homo sapiens
  misc_feature: GZ8MTXP02I1WUU.38.23.C01.1.454.CMB.2.raw
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagagttcttttgtcagctaccaagatatgagttcgtagcttggaccagcaagaaagcaacgacacgtcccctaagttcgctctatttatggtcattctacgtcgggtcgtccggggtcctgaccgattcgagcgcagcggatcgtgggacagtactttcactctcaccatcagcacgccgacagactagaagtatggtaggtacttagtttacttacgtagtacgagtactaattattagtagtacgtccgtcggtcttacgtacgtttcgggacgggtacgggaaccgtaagggtaggaaggtaacgtacgaaacggacgtaaaccgtggtacgtcg

SEQ ID NO: 299846 - DNA, 561 bp, Homo sapiens
  misc_feature: GZ8MTXP02IXGIT.38.23.C01.1.454.CMB.2.raw
  modified_base (521)..(521): a, c, t, g, unknown or other
  misc_feature (521)..(521): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtgggggtccctgagctctcctgtgcagcctctggtattcattatttagtaatcattggatgagttgggtccgcgaggctccgaggggcggggctggaggtggggtgccatagtaaaccacgataggaactaagaaaaagactagttgtgggtactcgtggtaggaacggggccgtattccacccgtctccagaacgaccaaacgacccaagaattcacttgtatttagactaaatacgaacagacctagagagtacgaagacgacgacatatattattgtagtaaanatcattcgataagtggtcggcgtaggtacggtcggactag

SEQ ID NO: 299847 - DNA, 595 bp, Homo sapiens
  misc_feature: GZ8MTXP02GIM7L.38.23.C01.1.454.CMB.2.raw
  modified_base (340)..(340): a, c, t, g, unknown or other
  misc_feature (340)..(340): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccaggccgtggggggtccctgaagctctcctgtgcagcctctggattcatattagtaatcattggatgagttggtccgccaggctccgaggggacggggctgggaggtggggnggccactataaaccacgatggaactagaaaaagactagtgtgggaacttcgtaggtagaaaggggcccgaatttccgaacccgtctacccagaagaccaaaccgccaaagaattaccgaacttgttaatttagactaaaatagaaacagtaccctagaagaggtacgaaagaccgacggaccataatattattagtaagtaaaagatacgtattagaattaagtgggtacggacgtacggtacgggtggacttag

SEQ ID NO: 299848 - DNA, 534 bp, Homo sapiens
  misc_feature: GZ8MTXP02HVGWP.38.23.C01.1.454.CMB.2.raw
  modified_base (414)..(414): a, c, t, g, unknown or other
  misc_feature (414)..(414): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctctggcgagaggccacatcaactgcaagtccagccagagtcttttgtcagctaccaagaatatgagttcgttagcttggtaccagcagaaagcacgacacgtcccctaagttgctctatttattggtctatctacgtcgggttcgtccggggtccctgaccgtattcgagcggcagcggatcgtgggacagtactttcactctcaccatcagcagcctgcagactgaaagntgtggtctagtttatactgtacagtacaaattattagtaggtacgtcctcggtactcgtacgtttcggacgggtacggaaccgtaagggtggaagtagtacaaggccgtaacgtggtcgg

SEQ ID NO: 299849 - DNA, 714 bp, Homo sapiens
  misc_feature: GZ8MTXP02H5GY6.38.23.C01.1.454.CMB.2.raw
  modified_base (608)..(608): a, c, t, g, unknown or other
  misc_feature (608)..(608): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagacctccctggctgtcgtctcggtggcgaggacggcccacataccaactgacaacgtccacgccagtacgttcttttgtcagtcctacgaaagtaatagtagtacgtttacgtagtcgttacggtaccagacaagaaacgcaacgactaccgtaccctaaggttcgactacttatttagtcggtactacttaccgttaccggtcggggttccggtccccccggggttaccctacggtaacccgtacgtttaccgacgggtcccggcgtacgggtacggtaaccgttcgggtacggggtactaaggtttacctttacccaaccttccttacccgaaccttactaccgaacgaccacgtccccgtagcccgtaagtaccgtaggaaacgtggttgtacgtacgtttaagtttactacgtcgtacgaacgtataaagttnttacggtacggttacgtccgtacgtaccttaccgtttacgggtccgggaacgggtaacgggtaaccgtagggggaagtacgtagaccggtaacggtacggtaacgg

SEQ ID NO: 299850 - DNA, 554 bp, Homo sapiens
  misc_feature: GZ8MTXP02F0IO0.38.23.C01.1.454.CMB.2.raw
  modified_base (379)..(379): a, c, t, g, unknown or other
  misc_feature (379)..(379): n is a, c, g, or t
  modified_base (408)..(408): a, c, t, g, unknown or other
  misc_feature (408)..(408): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagagttcttttgtcagctccaagaatatgagttcgttagcttggtaccagcaagaaagcacgacacgtcccctaagtcgctcattttatgtcatctacgtcgggtgtccggggtcctgaccgatcgagcgcagcgatcgtgggacagtatttcactcncacatcagcacgcctgcagactagaaagntgtaggtctagtttatacgtagtacagactaaattattagtggtacgtccgttcggtaccttcgtaaccggtttcgggaccggtaacggggaaccgtaaggggtaaggaagtaagttaccggaaacgtacggtaaaccgtggtcgg

SEQ ID NO: 299851 - DNA, 529 bp, Homo sapiens
  misc_feature: GZ8MTXP02H327I.38.23.C01.1.454.CMB.2.raw
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagagtcttttgttcagctccaagaatatgagttcgttagcttggtaccagcaagaaagcacgacacgtcccctaagttgctcatttatgtcatctacgtcgggtgtccgggtcctgaccgattcagcgcagcgatcgtgggacagtatttcgactctcaccatcagcagccctgctacgactagaaagatggtaggtctagttttatacttgtacagtactaaattattaagttggtaacgttccgtcggtctctaacgtttcgggcggtacgggacaagggtgacgatacgaagccgaactgtacgg

SEQ ID NO: 299852 - DNA, 579 bp, Homo sapiens
  misc_feature: GZ8MTXP02HOW9H.38.23.C01.1.454.CMB.2.raw
  modified_base (266)..(266): a, c, t, g, unknown or other
  misc_feature (266)..(266): n is a, c, g, or t
  modified_base (572)..(572): a, c, t, g, unknown or other
  misc_feature (572)..(572): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttcctgttgctattttagaaggtgtccagtgtgaggtgcagttggtggaatcgtgggggaaacttggtccagcctggggggtccctgaagctctcctgtgcagcctcnggattcatatttagtaatcattggatgagttgggtccgccaggctccgaggggacggggctgggagtggggtggccactataaaccacgatagggaaactacgaaaaaagactaatggtgggaacttcgtaggtagaaacgggggccgaatttcccacccgtctacccgaagacgaaccgaaccgacccaaagtaaacttacaacttgttaatttgaacaaattgaacagacctagagagtacgaaagacacggccaatatattattgataaagatacattcgataagttggacggcgagtacggnggactag

SEQ ID NO: 299853 - DNA, 567 bp, Homo sapiens
  misc_feature: GZ8MTXP02JFJG9.38.23.C01.1.454.CMB.2.raw
  modified_base (515)..(515): a, c, t, g, unknown or other
  misc_feature (515)..(515): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttcctgttgctattttagaaggtgtccagtgtgaggtgcagttggtggaatctgggggaaacttggtccagccgtggggggtccctgaagctctcctgtgcagcctctggattcatatttagtaatcattggatgagttgggtccgcgaggctccgagggacggggctggaggtgggtgccactataaaccgacgagtggaactagaaaaagctatgtgggactcgtggtagaacggggctattccacccgtctcccgagacgacaaccgcaaagaacttcactagtatttagacaaatacgaacagcctagagtagtacgaagacgacggacatatattattagtaaagtaaaagntactaacgttgaataaggttggtacggacggacggtacggggtgactttagg

SEQ ID NO: 299854 - DNA, 592 bp, Homo sapiens
  misc_feature: GZ8MTXP02H9RD6.38.23.C01.1.454.CMB.2.raw
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctctgggcgagagggccacatcaactgcaagtccagccagagtcttttgtcagctccaagaatatgagttcgtagcttggtaccagcagaaagcacgacacgtacccctaagttgctctatttattggtcatctactcgggtgtccggggtccctggaccgtattcacggtcggcgaggcgggattcgtaggggactagtacttcactcctcaccatcacgcacgcctgccagtacaggaaagtattggacggtattaagttttataacgttggttaccaggacaaatttataaagttcggggttaacttccgttacggacttcgtaaacgttttccggggacgggaacggggttacccgaaagggggttgaacggtagttacgaaacggaccgaaacgtttacgggcgg

SEQ ID NO: 299855 - DNA, 524 bp, Homo sapiens
  misc_feature: GZ8MTXP02HAZJL.38.23.C01.1.454.CMB.2.raw
  modified_base (410)..(410): a, c, t, g, unknown or other
  misc_feature (410)..(410): n is a, c, g, or t
  modified_base (459)..(459): a, c, t, g, unknown or other
  misc_feature (459)..(459): n is a, c, g, or t
  modified_base (490)..(490): a, c, t, g, unknown or other
  misc_feature (490)..(490): n is a, c, g, or t
  modified_base (493)..(493): a, c, t, g, unknown or other
  misc_feature (493)..(493): n is a, c, g, or t
  modified_base (497)..(497): a, c, t, g, unknown or other
  misc_feature (497)..(497): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttcctgttgctattttagaaggtgtccagtgtgaggtgcagttggtggaatcgtgggggaaacttggtccagccgtgggggtccctgaagctctcctgtgcagcctctggattcattatttagtaatcattggatgagttgggtccgcaggctccgagggacggggctggagtggggtggccaagtataaaccgacgataggaactagaaaaaagctatgtggactcgtgtagaaggggccattcaccgtcnccagagacaacgcaagatcactgtattgacaaatgaacagcctagaagngacgaagacacggacatatatatgtagaaanctnagtnataagtcgtgcgacgtacggtgactag

SEQ ID NO: 299856 - DNA, 561 bp, Homo sapiens
  misc_feature: GZ8MTXP02I1SYD.38.23.C01.1.454.CMB.2.raw
  modified_base (303)..(303): a, c, t, g, unknown or other
  misc_feature (303)..(303): n is a, c, g, or t
  modified_base (308)..(308): a, c, t, g, unknown or other
  misc_feature (308)..(308): n is a, c, g, or t
  modified_base (424)..(424): a, c, t, g, unknown or other
  misc_feature (424)..(424): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacattgtgatgacccagtctccagactccctggctgtgtctctgggcgagaggccacatcaactgcaagtccagccagagttctttgtcagctacaagatatgagttcgtagcttggtaccagcagaagcacgacacgtcccctagttcgctctatttgngttcntactcggtcgggttcgtccggggtccacgaccgtatcgagcgacaggcgtatcgtgggacctagtacttcactcgtacaccatcgacgcacgccctagaccagaccgtagaaagtntaggtcggtactagtttacgttaactgtacgagtactattagtagttacggtactccgtacggtcctacgtacggtttacgggacgggtacggaaccggtaaggtaaggagtacgacgaaagtccggatacggtcgg

SEQ ID NO: 299857 - DNA, 527 bp, Homo sapiens
  misc_feature: GZ8MTXP02GJCVW.38.23.C01.1.454.CMB.2.raw
  modified_base (375)..(375): a, c, t, g, unknown or other
  misc_feature (375)..(375): n is a, c, g, or t
  modified_base (389)..(389): a, c, t, g, unknown or other
  misc_feature (389)..(389): n is a, c, g, or t
  modified_base (397)..(397): a, c, t, g, unknown or other
  misc_feature (397)..(397): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctctgggcgaggagggccaccatcaactgcaagtccagccagagttcttttgtcagctccaagaatatgagttcgtagcttggtaccagcagaaagcacgacacgtcccctaagttgctctatttattggtcattctacgtcgggtgtccggggtcctcgaccgattcagcggcagcggatcgtaggacagtntttcactctcaccntcagcacncctgcagactagaagatgtcggatagtttatacgtgtcagctaaatattagaggtacgtctcggtctcgtaacgtttcggacggtacggaccgtaaggggtgagtacgacgaagaccgtaacgtggtcgg

SEQ ID NO: 299858 - DNA, 529 bp, Homo sapiens
  misc_feature: GZ8MTXP02GY73V.38.23.C01.1.454.CMB.2.raw
  modified_base (303)..(303): a, c, t, g, unknown or other
  misc_feature (303)..(303): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagcctgggggtccctgaagctctcctgtgcagcctctggattcatatttagtaatcattggatgagttgggtccncaggctccgagggacggggctggagtgggtggccactataaaccacgatggaactagaaaaagctatgtggactctgtgaggggcattcaccgtctccagagacaacgcaagaatcactgtatttgacaaatgaaacagacctagacgagtacgaagacacggaccatatatattgtagtaaaagatacattcataagtggtacggcgacggtacgggtggactag

SEQ ID NO: 299859 - DNA, 543 bp, Homo sapiens
  misc_feature: GZ8MTXP02I9ONT.38.23.C01.1.454.CMB.2.raw
  modified_base (304)..(304): a, c, t, g, unknown or other
  misc_feature (304)..(304): n is a, c, g, or t
  modified_base (503)..(503): a, c, t, g, unknown or other
  misc_feature (503)..(503): n is a, c, g, or t
  modified_base (536)..(536): a, c, t, g, unknown or other
  misc_feature (536)..(536): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagcctgggggtccctgaagctctcctgtgcagcctctggattcattatttagtaatcattggatgagttgggtccncaggctccgagggcgggctggagtgggtgccatataaaccacgatggaaactagaaaaagctagtgtggactcgtagtgaagggtccattccaccgtctaccagacgacaacgccaaagtattcactgtatttagacaaatgaaacagcctagaacgaggtacgaaagacacggacattatattattaggtataaaagntacaattcgataagtggtcgacgacggtacggnggactag

SEQ ID NO: 299860 - DNA, 525 bp, Homo sapiens
  misc_feature: GZ8MTXP02JXQ3T.38.23.C01.1.454.CMB.2.raw
  modified_base (303)..(303): a, c, t, g, unknown or other
  misc_feature (303)..(303): n is a, c, g, or t
  modified_base (371)..(371): a, c, t, g, unknown or other
  misc_feature (371)..(371): n is a, c, g, or t
  modified_base (486)..(486): a, c, t, g, unknown or other
  misc_feature (486)..(486): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttcctgttgctattttagaaggtgtccagtgtgaggtgcagttggtggaatctgggggaaacttggtccagcctggggggtccctgaagctctcctgtgcagccctctggattcatatttagaatcattggatgagttgggtccnccaggctccgagggacggggctggagtgggtggccactataaaccacgatggaactagaaaaagctangtggactctgtgaagggcgatcaccgtctccagagacaacgccaagaatcactgtatttgacaaatgaacagcctagagagtacgaagacacggccatatattatgagtaaaagntacattacgataagtggtaggcgacggtacgggtgctag

SEQ ID NO: 299861 - DNA, 659 bp, Homo sapiens
  misc_feature: GZ8MTXP02GROT5.38.23.C01.1.454.CMB.2.raw
  modified_base (266)..(266): a, c, t, g, unknown or other
  misc_feature (266)..(266): n is a, c, g, or t
  modified_base (607)..(607): a, c, t, g, unknown or other
  misc_feature (607)..(607): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtgggggtccctgaagctctcctgtgcagcctntggattcatatttagatcattggatgagttgggtccgcgaggctccgaggggacgggctgggaggtggggtcggacccaacgttaactaaaacccgacggaagttacggggaaaaccttaaggaaaaaaacggtacttaagtgggttggggaaccttccgttaggtagggaaacgggggtcccgtaagtttcccgacccgttcctacccgaggaacgaaccaaacgacccaaaagtaacttaccacgttagttaatttaggaacctaaagtacgaaacagacctaggaagacgtacgaaacgaacgacggtaccaagtaattaattattagtaagtaaaanatactattaaacgattaagtggtacggtacggacggtacgggtggacgttag

SEQ ID NO: 299862 - DNA, 534 bp, Homo sapiens
  misc_feature: GZ8MTXP02I63IS.38.23.C01.1.454.CMB.2.raw
  modified_base (298)..(298): a, c, t, g, unknown or other
  misc_feature (298)..(298): n is a, c, g, or t
  modified_base (342)..(342): a, c, t, g, unknown or other
  misc_feature (342)..(342): n is a, c, g, or t
  modified_base (441)..(441): a, c, t, g, unknown or other
  misc_feature (441)..(441): n is a, c, g, or t
  modified_base (488)..(488): a, c, t, g, unknown or other
  misc_feature (488)..(488): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggtttcctgttgctatttagaaggtgtccagtgtgaggtgcagttggtggaatctgggggaaacttggtccagcctgggggtccctgaagctctcctgtgcagctctggattcatattagtaatcattggatgagttgggtccnccaggctccgaggacggggctggagtggggtgccatataaaccncgatgggaactgaaaaagctaatgtggactctgtgaagggccgattcaaccgtctccagagaacaacgccaagaattcactgtatttgactaaatgaanagcctagagagtcaaggacacggcataatattattagtagtaaaagntactattacgataagtcggtacggacgtacggtacgggtcgactag

SEQ ID NO: 299863 - DNA, 587 bp, Homo sapiens
  misc_feature: GZ8MTXP02GML7N.38.23.C01.1.454.CMB.2.raw
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagagttcttttgtcagctaccaagaatatgagttcgtagcttggtaccagcaagaaagcaacgactacgtacccctaagttcgcttactaattttattggtcctaattcgttacgtcggggttcgtccccggggttccctacggacccgtattcgacggcggcgacgggccggatccgtagggactagtactttcactctacaccatcagcacgcctgacagactagaaagagtgtcggtacttagtttaactacgtacgtacagtactaaattagttagttggtactccgtcggtcttccgtacgtttcgggacgggtaacggaaccgtaagggtggaagacgtacgaaacgcgaacgtggtacg

SEQ ID NO: 299864 - DNA, 575 bp, Homo sapiens
  misc_feature: GZ8MTXP02HYDLZ.38.23.C01.1.454.CMB.2.raw
  modified_base (468)..(468): a, c, t, g, unknown or other
  misc_feature (468)..(468): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtggggggtccctgaagctctcctgtgcagcctctggattcattatttagtaatcattggatgagttgggtccgcgaggctccgaggggacggggcgtggaggtggggtcggccacgtaactaaaccgacgagtaggaactagaaaaagactagtgtggactcgtgtaggaagggccgattccaccgtctaccagacgacaacgaccaagattacactgtattgacaaatgaacngccgtagagagtacgaagacgacggccaatatatttattagtaaagtaaaagtatacgtattacgaattaagtgggttaggacggtacggttacggggagtacgtag

SEQ ID NO: 299865 - DNA, 633 bp, Homo sapiens
  misc_feature: GZ8MTXP02GT11P.38.23.C01.1.454.CMB.2.raw
  modified_base (264)..(264): a, c, t, g, unknown or other
  misc_feature (264)..(264): n is a, c, g, or t
  modified_base (285)..(285): a, c, t, g, unknown or other
  misc_feature (285)..(285): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcgtggtttcgtgtaggctatttagaaggtgtcagtgtgaggtgcagttggtggaatcgtagggggaaacttggtccagccgtgggggtcctgaagctctcctgtgcagccctntggattcatatttagtaactntatgatgtggtcggccgcgcgcgtcggagggcggtgtggaggtggtcgacctaactaacaaaccgagacgtacggaaactaaagaaaacgtacgtagtaggtcggtacttacggtaggtacggaacgggtctacttacgacgttccgtaccgacgaagacgaaccgaaacgtacctaaagtaacttacgtacgttagttacgttacgaacgtaacgtaacgtaacgtacgtacgtacgaacgtaacgtaacgaacgaacgacgactaataacttaagttagttaagtaaagtaaagtactactagtagtaagtagtacggtacggtacggtacggtacggtacgtacg

SEQ ID NO: 299866 - DNA, 531 bp, Homo sapiens
  misc_feature: GZ8MTXP02FJEBA.38.23.C01.1.454.CMB.2.raw
  modified_base (442)..(442): a, c, t, g, unknown or other
  misc_feature (442)..(442): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagcctggggggtccctgaagctctcctgtgcagcctctggattcatattagtaatcattggatgagttgggtccgccaggctcaggggacgggctggagtgggtgggccactataaaccacgatggaactagaaaaagactatgtggactctgtgaagggcgattcaccgtctccagagacaacgccaagaatcactgtatttgacaaatgaanagcctagacgagtacgaagacacggaccatatattatgtagtaaaagtatactatcgaataagtggtaggacgtaagtacgggtgctag

SEQ ID NO: 299867 - DNA, 541 bp, Homo sapiens
  misc_feature: GZ8MTXP02G45ON.38.23.C01.1.454.CMB.2.raw
  modified_base (384)..(384): a, c, t, g, unknown or other
  misc_feature (384)..(384): n is a, c, g, or t
  modified_base (509)..(509): a, c, t, g, unknown or other
  misc_feature (509)..(509): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctatttagaaggtgtccagtgtgaggtgcagttggtggaatcgtgggggaaacttggtccagccgtggggggtccctgaagctctcctgtgcagcctctggattcatattagtaatcattggatgagttgggtccgcaggctccgagggacggggctggaggtgggtgccaactataaaccgacgataggaaactagaaaaagactatgtggactntgtagaaggcgatcaccgtctacgagagacaacgacaagaattcactgtatttagacaaaatagaacagcctagacgagtacgaagacacgacataatattattagtaagtaaaagatacattanataagtggtagacgaggtaacggggcgtatag

SEQ ID NO: 299868 - DNA, 526 bp, Homo sapiens
  misc_feature: GZ8MTXP02HJ8YE.38.23.C01.1.454.CMB.2.raw
  modified_base (344)..(344): a, c, t, g, unknown or other
  misc_feature (344)..(344): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctcgtgggcgagagggccacatcaactgcaagtccagccagagttctttgtcagctcaagatatgagttcgtagcttggaccagcagaaagcacgacacgtcccctaagttgctactatttatggtacatctacgtcggggtgtcccccggggtccngaccgtattcgagcggcagcggatcgtagggacagtattcactctcacatcagcacgcctgacagactgaaagagttgtgactagtttatacgtgtacagactaattattagtcggtacgtccgtcggtctcgtacgtttcgggacggaggtaaccgaaggtggacagtcgaagtcgtaacg

SEQ ID NO: 299869 - DNA, 540 bp, Homo sapiens
  misc_feature: GZ8MTXP02IG3U6.38.23.C01.1.454.CMB.2.raw
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgacaagtccagccagagttcttttgtcagctccaagaatatgagttcgttagcttggtaccagcagaaagcacgacacgtcccctaagtgctacatttattggtcatctactcgggtcgtccccggggtccctgaccgtattcagcgcagcggatcgtagggacagtacttcactctcaccatcagcagcctgacagactgaagagtgtggactagtttatacgtgtacagtactaagttacttaagtcggtaacgtccgtcggtacctcgttacgtttcggacggacgggaaccgtagggtgacgtactacgaacgacgtaacgg

SEQ ID NO: 299870 - DNA, 564 bp, Homo sapiens
  misc_feature: GZ8MTXP02G2S1R.38.23.C01.1.454.CMB.2.raw
  modified_base (303)..(303): a, c, t, g, unknown or other
  misc_feature (303)..(303): n is a, c, g, or t
  modified_base (441)..(441): a, c, t, g, unknown or other
  misc_feature (441)..(441): n is a, c, g, or t
  modified_base (445)..(445): a, c, t, g, unknown or other
  misc_feature (445)..(445): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtgggggtcctgaagctctcctgtgcagcctctggattcatatttagtaatcattgatgagttgggtccncgaggctccgaggggacgggctgggaggtgggtgccaactataaaccacgataggaactagaaaaagctaatgtggactgtgtaggaagggccgattccaccgtctccagagacaacgcaaagatcactgtattaganaaanagtaacagtcctagagacgtacggaagacgacggacctaataagttaattagttagtaacgtaaaagtacttacattacgataagtaggtgggtaccggaggtaccgggtggacttagg

SEQ ID NO: 299871 - DNA, 574 bp, Homo sapiens
  misc_feature: GZ8MTXP02H9X26.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagctgggggtccctgaagctctcctgtgcagcctctggattcattatttagtaatcattggatgagttgggtccgccaggctccgaggggacggggctgggaggtgggtggccactactaaaccacgataggaactagaaaaagactagtgtggactctgtagaaggggccgattccacccgtctacccagagaaccaacgaccaaagtaacttcacttgtatttagacaaatgaacagcctagagtagacgaagacacggaccataatattattagtaataaaagatactagtttacgaattaagtgggtacggacggtaacgggttaccggggtaggactttag

SEQ ID NO: 299872 - DNA, 589 bp, Homo sapiens
  misc_feature: GZ8MTXP02F0HKP.38.23.C01.1.454.CMB.2.raw
  modified_base (542)..(542): a, c, t, g, unknown or other
  misc_feature (542)..(542): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttcctgttgctattttagaaggtgtccagtgtgaggtgcagttggtggaatcgtgggggaaacttggtccagccgtggggggtcccctgaagctctcctgtgcagccctctggattcatatttagtaatcattggatgagtggtccgcaggctccgagggacgggctggaggtggggtggccaactaagtaaaacccacgatagggaaactaagaaaaagactatgtggaactcgtaggtagaaaggggtcccgaatttccaacccgttctacccgaggacgaacaacgacccaaagtaaacttcacttagtatttagactaaaatgaaacagcccgtagagagttacgaaagacacggccaatattattattgtaagtaaaanatactattagtagtaagtggtacggacggtacggtacggtcgactag

SEQ ID NO: 299873 - DNA, 625 bp, Homo sapiens
  misc_feature: GZ8MTXP02F8LX6.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttcctgttgctattttagaaggtgtccagtgtgaggtgcagttggtggaatcgtgggggaaacttggtccaggccgtgggggtccctgaagctctcctgtgcagcctctggattcatatttagtaatcattgatgagttggtccgcaggctcgagggacgggctggagtgggtggccactataaaccacgagtagaaacgtagaaaaagactatgtggactctaggtagaaaggggccgtagttcccgaacccgtctaccgaagaacgaaccgaaacccggacccaaaagtaactttaccgaacttagttaagttttaggaaactaaaattacgaaacgtacaccgttagaacgagtacgaaacgacgacggacctaattataattagttagtaacgtaaaaagtctactagtttcgaaagttgtagggttacggacggtaacggttaccggggtaggactttaagg

SEQ ID NO: 299874 - DNA, 610 bp, Homo sapiens
  misc_feature: GZ8MTXP02JALSJ.38.23.C01.1.454.CMB.2.raw
  modified_base (304)..(304): a, c, t, g, unknown or other
  misc_feature (304)..(304): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttcctgttgctattttagaaggtgtccagtgtgaggtgcagttggtggaatcgtgggggaaacttggtccagccgtgggggtccctgagctctcctgtgcagcctctggattcattattagtaatcattggatgagtttgggtccnccaggctccgagggacggggctggagtggggtcgccactataaaccgagactggaaactagaaaaaagctaagtgtgggtactcgtggtaggaaggggccgtattccaacccgttctcccgaagaacgacaaaccgaccaaagaattcaactgttaatttgactaaagtagaaacacgaccgtagaacggacgtacggaaagaccgaaccggacctaaataattatttaatttaggtaagttaaaagattaccgtacgttagaattaagtgggtacggtacggtacggtacggggtcggacttagg

SEQ ID NO: 299875 - DNA, 520 bp, Homo sapiens
  misc_feature: GZ8MTXP02G094N.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagccgtggggggtccctgaagctctcctgtgcagcctctggattcatatttagtaatcattggatgagttgggtccgcaggctccgagggacggggctggagtgggtggccactataaaccacgatggaactgaaaagctatgtggactctgtgaagggcgattcaccgtctccagagacacgcaagatcactgtatttgacaaatgaacagctagagagtgaagacaggccatatattatagtagtaaaagatacgattcgataagtcggtggcgaggtacggtggactag

SEQ ID NO: 299876 - DNA, 561 bp, Homo sapiens
  misc_feature: GZ8MTXP02I4Z13.38.23.C01.1.454.CMB.2.raw
  modified_base (375)..(375): a, c, t, g, unknown or other
  misc_feature (375)..(375): n is a, c, g, or t
  modified_base (451)..(451): a, c, t, g, unknown or other
  misc_feature (451)..(451): n is a, c, g, or t
  modified_base (509)..(509): a, c, t, g, unknown or other
  misc_feature (509)..(509): n is a, c, g, or t
tcagtcgatcacgtcacgaccggtgctcgatttagtacacgtgattaggtattgggggtctcagagaggagccttagccctggactccaaggcctttgcacttggtgatcagcactgagcacagaggactcaccatggaattggggctgagctgggttttcctgttgctattttagaaggtgtccagtgtgaggtgcagttggtggaatctgggggaaacttggtccagcctggggggtccctgaagctctcctgtgcagcctctggattcatattagtaatcattggatgagttgggtccgcaggctccgagggacggggctggagtgggtggccactataaaccacgatagggaactagaaaaaagctaatgnggaactcgtgtgaagggccgattcaccgtctccagagacaacgaccaagaattcactgtatttgacaaaatgaaanagacctagagagtacgaaagaacacggaccaataataattaattgtaaggttaaaaanactactaacttacgaataagtggtacggacggtacggtacgggtcggactag

SEQ ID NO: 299877 - DNA, 551 bp, Homo sapiens
  misc_feature: GZ8MTXP02I0EQO.38.23.C01.1.454.CMB.2.raw
  modified_base (181)..(181): a, c, t, g, unknown or other
  misc_feature (181)..(181): n is a, c, g, or t
  modified_base (342)..(342): a, c, t, g, unknown or other
  misc_feature (342)..(342): n is a, c, g, or t
  modified_base (360)..(360): a, c, t, g, unknown or other
  misc_feature (360)..(360): n is a, c, g, or t
  modified_base (387)..(387): a, c, t, g, unknown or other
  misc_feature (387)..(387): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtntctcgtgggcgagacggccaccatcaactgcaagtccagccagagttctttgtcagctacaagaatatgagttcgttagcttaggtaccagcaagaaagcaacgacacgtcccctaaagtcgctcatttattggtcatctacgtcgggtgtccggggtccngaccgattcgagtcgacngcgatcgtaggacagtactttcactcncacatcagcacgcctagcagactgaaagagtgtagactagtttattactgtcaagctaaatattagtaggtacgttcctaggtccttacgtaccgttttcgggaccggtaaacggggtaacccgaagggttcggaagagtaccgaagacgtaaacgtggtacgg

SEQ ID NO: 299878 - DNA, 561 bp, Homo sapiens
  misc_feature: GZ8MTXP02G60KR.38.23.C01.1.454.CMB.2.raw
  modified_base (445)..(445): a, c, t, g, unknown or other
  misc_feature (445)..(445): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctcgtgggcgagaggccacatcaactgcaagtccagccagagttctttgtcagctacaagatatgtagttcgttagcttggtaccagacaagaaacgcaacgactacgtacccctaagttcgcttactatttagttggtactattcctacgtcggggtcgtcccggggtcctagaccgtattcgaggcggcaggcgggtatcgtagggacagtactttaccgactcctaccaccatcacgccacgcctgacaagacagaagtntacggtgtactagtttatacgttgtacgtagtactaattattagtagtactccgttcgctacgtcgttacggacggtacggacgtaaggtgagtacgacgaagcgtaacgtgtacg

SEQ ID NO: 299879 - DNA, 528 bp, Homo sapiens
  misc_feature: GZ8MTXP02JO8L7.38.23.C01.1.454.CMB.2.raw
  modified_base (365)..(365): a, c, t, g, unknown or other
  misc_feature (365)..(365): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggggcctacggggacatcgtgatgacccagtctccagactccctggctgtgtctctgggcgagaggccaccatcaactgcaagtccagccagagtcttttgtcagctccaagatatgagttcgtagcttggtaccagcagaaagcacgacagtcccctaagtgctcatttatggtcatctacgtcgggtgtccgggtcctgaccccgattcagcggcagcggatcgtgggacagnttcactctcacatcagcacgctcgcagactgaagatgtggctagtttatctgtcagactaatattagtggtacgtccgttcggcttcgtaccgtttcggggacgggaacgggtaccgtaaggggtggaagacgttaacgaaacggcgtaacgtggtcggaccg

SEQ ID NO: 299880 - DNA, 535 bp, Homo sapiens
  misc_feature: GZ8MTXP02HR0IZ.38.23.C01.1.454.CMB.2.raw
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagagtcttttgtcagctaccaagaatatgagttcgtagcttggtaccagcaagaaagcaacgacagtcccctaaagtcgctctatttattggtcatctacgtcggtgtccggggtccctgaccgattcagcgcagcgatcgtgggacagtatttcactctcaccatcagcagcctgcagactgaaatatgtggtctagtttatactgtcagacaattattatggtactcgtcggtactcgtaacgtttcggcgggtaacgggacccgtaagggtaacggagtaacgtacgaaacggtacgaaacgttggtacgg

SEQ ID NO: 299881 - DNA, 566 bp, Homo sapiens
  misc_feature: GZ8MTXP02HZXZU.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattgggctgagctgggtttccttgttgctattttagaaggtgtccagtgtgaggtgcagttggtggaatcgtgggggaaacttggtccagccgtgggggtcctgagctctcctgtgcagcctctggattcattatttagtaatcattggatgagtttgggtccgccaggctccgaggggacggggctggagtgggtggccataactaaaccacgatggaacctgaaaaagctaatgtggactcgtagtagaaggggccaatttccgaccgtctacccgagacgacaaccgccaaagtattacacttgtatttcgacaaagtagaacagcctaggacgaggtacgaagacgaacggccaatatattattagtacgtaaaagctactaatcgataagtcggtacggacgaggtaccggggtgacgttag

SEQ ID NO: 299882 - DNA, 540 bp, Homo sapiens
  misc_feature: GZ8MTXP02G0XBZ.38.23.C01.1.454.CMB.2.raw
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagagtcttttgtcagctccaagatatgagttcgtagcttggtaccagcagaaagcacgacacgtcccctaaagttgctctatttattggtcatctactcgggtgtccccggggtccctgaccgtattcgagcggcagcggatctgggacagatttcactctcacatcagcagcctgcagactagaaagtatgtggtactagtttatactgtacagactaaattattaacgttggtacgtccgtcgggtcttcctaacgtttcgggacgggaaagggtaaccgaaagggtcggacgtagtcgaaacgcgtaaacg

SEQ ID NO: 299883 - DNA, 585 bp, Homo sapiens
  misc_feature: GZ8MTXP02GVOKQ.38.23.C01.1.454.CMB.2.raw
  modified_base (328)..(328): a, c, t, g, unknown or other
  misc_feature (328)..(328): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttgggtccagccgtggggggtccctgaagctctcctgtgcagcctctggatcatatttagaatcattggatgagttggccgcaggctcgaggcgggctggagtgggngccactataaaccagataggaactagaaaaaagactagtgtaggacctgtagtagaaacgggcctatttaccgaccgtcctaccagacgaacgaaccgtaccaaagtaactcactgtattagacaaatagaaacacgcctagaagtacggacgaaacgacgacggtaccaataatatttattagtaaaggtaaaatatactaagttacgaataaggtggtagggtacggaccggtttaacgggggacggtacgtacg

SEQ ID NO: 299884 - DNA, 546 bp, Homo sapiens
  misc_feature: GZ8MTXP02JN28M.38.23.C01.1.454.CMB.2.raw
  modified_base (486)..(486): a, c, t, g, unknown or other
  misc_feature (486)..(486): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccaggcctggggggtccctgaagctctcctgtgcagcctctggattcatatttagatcattggatgagttgggtccgccgaggctccgagggacggggcgtggaggtgggtggccactataaaccacgatgaactagaaaagactatgtggactctcgtagaaggggccgattcacccgtctcccgagagacaacgaccaagaacttcactgtatttagacgaaatgaacagcctagagagtacgaagacacggcctanatacttattgtagtaaaagatacattcgataagtggtaggacgacggtacgggtcgctag

SEQ ID NO: 299885 - DNA, 598 bp, Homo sapiens
  misc_feature: GZ8MTXP02G54KY.38.23.C01.1.454.CMB.2.raw
  modified_base (330)..(330): a, c, t, g, unknown or other
  misc_feature (330)..(330): n is a, c, g, or t
  modified_base (482)..(482): a, c, t, g, unknown or other
  misc_feature (482)..(482): n is a, c, g, or t
  modified_base (568)..(568): a, c, t, g, unknown or other
  misc_feature (568)..(568): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagcctggggggtccctgaagctctcctgtgcagcctctggattcatattagtaatcattggatgagtttgggtccgccaggcccacggacggggcggtcggnggtagggtgggccgactaactaaacaaccgagtacgaacgtaacgtaaaagaaactagtagtaggcgtactgtggaacgggacggacttactacccgtactcccaacgagaacaaaccgaacccaagaaacgtactaccagttattagttanaaacttaagaacaagacctgagagtacgaagaacacggaccatattaattattagtagtaaaagaatactactacgtatataaggnggtacgacggtacgggtaggcgtaatttgg

SEQ ID NO: 299886 - DNA, 570 bp, Homo sapiens
  misc_feature: GZ8MTXP02GRT2M.38.23.C01.1.454.CMB.2.raw
  modified_base (415)..(415): a, c, t, g, unknown or other
  misc_feature (415)..(415): n is a, c, g, or t
  modified_base (467)..(467): a, c, t, g, unknown or other
  misc_feature (467)..(467): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgacaagtccagccagagttcttttgtcagctcaagatatgagttcgttagcttggtaccagcaagaaagcaacgacacgtcccctaagttcgctctatttattggtctatctacgtcggggtcgtcccccggggtccctggacccgtattcaggcggcgagcggactcgtggggacagtctttcactctacacatcagcancctgacagactagaagagtgtggacttagtttaacttacgtgttacaacgtntaaattattaagttggtacgttccgtcggacttacgtacgtttcggggacggtaaacgggaaccgtaaaggggtcggaagacgtacgaaacggtccgtaaacg

SEQ ID NO: 299887 - DNA, 578 bp, Homo sapiens
  misc_feature: GZ8MTXP02JC47G.38.23.C01.1.454.CMB.2.raw
  modified_base (360)..(360): a, c, t, g, unknown or other
  misc_feature (360)..(360): n is a, c, g, or t
tcagtcgatcacgtcacgaccggtgctcgatttagtacacgtgattagggattgggggacaacaggcaggcaggggcagcaagatggtgttgcagacccaggtcttcatttctctgttgctctggatctctggagccgtacggggacatcgtgatgacccagtctccagactccctggctgtgtctcgtgggcgaggacgggccaccatcaactgacaagtccagccagagttcttttgtcagctacaagaatatgtagttcgtagtcttggtaccagacaagaaagcaacgacacgtacccctaagtcgctactatttagtgtctatctacgtcgggtcgtccggggtcctcgaccgtntcgaggcggcacggcggtatcggtaggggactagtactttccactcctaccaccatcgacgcacgcctgacagacgtagaagagtggtaggtactagtttactacgtgtacagtactaattattagtggtacgtccgtacggtctacgtacgttcggggacggtaacgggaccgtaaggggtggaagtacgtaacggaacggacgtaacgtggtacgg

SEQ ID NO: 299888 - DNA, 536 bp, Homo sapiens
  misc_feature: GZ8MTXP02G383I.38.23.C01.1.454.CMB.2.raw
  modified_base (421)..(421): a, c, t, g, unknown or other
  misc_feature (421)..(421): n is a, c, g, or t
  modified_base (509)..(509): a, c, t, g, unknown or other
  misc_feature (509)..(509): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagacctccctggctgtgtctctgggcgagaggccaccatcaactgacaagtccagccagagttcttttgtcagctcaagaatatgagttcgtagcttggtaccagcaagaaagcaacgacacgtccctaagtgctcatttatgtcatctacgtcgggtgtcccggggtcctcgaccgtattcgacggcggcacgggcggtatcgtaggggactagtatttccactctacacctatcagcagcctgcagactgaaanctgtggtactagtttatactgtacagtactaatattagtgtacgtcgtcggtctacgtacgtttcgggacggtacggaccgtaagggngacgtacgacgaaagcgaacgttgcgg

SEQ ID NO: 299889 - DNA, 582 bp, Homo sapiens
  misc_feature: GZ8MTXP02JXKRX.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtgggggtccctgaagctctcctgtgcagcctctggattcatatttagtaatcattggatgagttgggtccgcgaggctccgaggggacggggcgtgggaggtggggtggccaactaataaacccgagacgtaggaactaagaaaaagctagtggtggactcgtgtgaacgggtccgattccgacccgtctaccgagagaacaacgacaaagtactacacttgtattgacaaatgaacagctagagagtacgaagacgacggacctaagtatattaattagtaagtaaaagatacacttacaaagttaagtgggtacggacgggaacggttacggggtggtacgttagg

SEQ ID NO: 299890 - DNA, 571 bp, Homo sapiens
  misc_feature: GZ8MTXP02JISO8.38.23.C01.1.454.CMB.2.raw
  modified_base (303)..(303): a, c, t, g, unknown or other
  misc_feature (303)..(303): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagcctggggggtccctgaagctctcctgtgcagcctctggattcatatttagaatcattggatgagttgggtccncaggctcgaggggacggggttggagtggggtggccactataaaccagataggaactagaaaaagactatggtggactctggtaggacggggccgattcacccgtctcccagagacaacgaccaaagacttacactgtatttgacaaatgaacagcctagaagagtacgaagaccgacggaccatatattattagtaagtaaaacgattactattacgaattaagtggggttacggacggtacggtacggggtcggaccgtagtttcgg

SEQ ID NO: 299891 - DNA, 548 bp, Homo sapiens
  misc_feature: GZ8MTXP02IBERM.38.23.C01.1.454.CMB.2.raw
  modified_base (299)..(299): a, c, t, g, unknown or other
  misc_feature (299)..(299): n is a, c, g, or t
  modified_base (358)..(358): a, c, t, g, unknown or other
  misc_feature (358)..(358): n is a, c, g, or t
  modified_base (397)..(397): a, c, t, g, unknown or other
  misc_feature (397)..(397): n is a, c, g, or t
  modified_base (433)..(433): a, c, t, g, unknown or other
  misc_feature (433)..(433): n is a, c, g, or t
  modified_base (442)..(442): a, c, t, g, unknown or other
  misc_feature (442)..(442): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgagtgcagttggtggaatctgggggaaacttggtccaggcctgggggtccctgaagctctctgtgcagcctctggatcatattagaatcattggatgagttgggtccnccagctccagggcgggctggagtgggtggccatagaaaccagatggaactgaaaaaagntaatgtgatctgtgaagggccattcacccgtctccaganaacaaacgccaaagaattcaacttgtaatttagaanaaatagaanagacgtagagagacgaagaacgacgacaataataattaattagtaagtaaaagtaatactacttatataagtagtacggtacggacggtacgggtacggtacgtag

SEQ ID NO: 299892 - DNA, 553 bp, Homo sapiens
  misc_feature: GZ8MTXP02HASZY.38.23.C01.1.454.CMB.2.raw
  modified_base (255)..(255): a, c, t, g, unknown or other
  misc_feature (255)..(255): n is a, c, g, or t
  modified_base (308)..(308): a, c, t, g, unknown or other
  misc_feature (308)..(308): n is a, c, g, or t
  modified_base (373)..(373): a, c, t, g, unknown or other
  misc_feature (373)..(373): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagacctccctggctgtgtctcgtgggcgagacgggccaccatcaactgcaagtccagccagagttctttgtcagctccaagatangagttcgtagcttggtaccagcaagaaacgcacgactacgtcccctaagttcnctctatttattggtctatctacgtcgggtgtccccgggtcctgaccattcagcgcagcggatcgngggacagtcttcactctcacatcagcacgcctgacagacgtagaaagtagtggtacgtacgttagtttacgtacgttcgtacgaagtactaattattaagttcggtaacgttccgtccgtacttcgtacgttcgggacggtaacggaaccgtaggacggagtacgtacgaagtcgtaacg

SEQ ID NO: 299893 - DNA, 621 bp, Homo sapiens
  misc_feature: GZ8MTXP02G6PH5.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtgggggtccctgagctctcctgtgcagcctctggattcattatttagtaatcattggatgagttgggtccgcaggctccgaggggacgggctggaggtggggtggccactataaacccagatggaactagaaaaagctatgtggactcgtggtaggaacgggtccgattcccgaacccgttctacccgaagacgaaccaaaccggacccaaaggtaacttcctaacttagttatttagacctaaaagttcgaaacagtccctagaagagtacgaaagaccgacggaccaattaattaatttagttaggtaaagttaaaagattaccgtaaagtttcggaaattaagtgggtacggtacggtaacggtttacggggtggacctttagg

SEQ ID NO: 299894 - DNA, 543 bp, Homo sapiens
  misc_feature: GZ8MTXP02IYV7B.38.23.C01.1.454.CMB.2.raw
  modified_base (524)..(524): a, c, t, g, unknown or other
  misc_feature (524)..(524): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctctgggcgagagggccacatcaactgcaagtccagccagagtcttttgtcagctcaagaatatgagttcgttagcttggtaccagcagaaagcacgacagtccccctaagttgctcatttattggtctatctacgtcggggttgtccccggggtcccctggacccgtatttcacggtcggcagcggatccgtggggacagtatttcactctcaccatcagcagcctagcagactcgaagatgtgactagtttatactgtcagtcaatattatggttagtcctcggtcttactacgtttccgggacggacggggtaaccgtaaagggtggtaaacgngtaccaaggcccgtaaacg

SEQ ID NO: 299895 - DNA, 542 bp, Homo sapiens
  misc_feature: GZ8MTXP02HM8LK.38.23.C01.1.454.CMB.2.raw
  modified_base (534)..(534): a, c, t, g, unknown or other
  misc_feature (534)..(534): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagcctggggggtccctgaagctctcctgtgcagcctctggattcatatttagtaatcattggatgagtttgggtccgccaggctccgagggacggggctggagtgggtggccactataaaccacgatggaactagaaaaagactatgtggactcgtgtagaacggggcattcaccgtctcccagagacaacgccaagattcactgtatttgacaaatgaacagcctagagagtcgaagacacggactatatattatgtaagtaaatactctactacgattaagtggacggtcgtaacggttcgggngtacgtag

SEQ ID NO: 299896 - DNA, 541 bp, Homo sapiens
  misc_feature: GZ8MTXP02JSBU6.38.23.C01.1.454.CMB.2.raw
  modified_base (57)..(57): a, c, t, g, unknown or other
  misc_feature (57)..(57): n is a, c, g, or t
tcagtcgatcacgtcacgaccggtgctcgatttagtacacgtgattagggattgggngtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagccgtgggggtccctgaagctctcctgtgcagcctctggattcatattagtaatcattggatgagttggtccgccaggctccgaggggacggggctgggagtgggtggccatataaaccacgatggaactagaaaaagactatgtggactctgtgaaggccattcaccgtctccagagacacgccaagaattcactgtattgacaaatgaacagcctagagagtacggaagacacggaccaatataattattagtaagtaaaagtactactaattagaattagtggtacggacgtacggtacggggtgtacg

SEQ ID NO: 299897 - DNA, 534 bp, Homo sapiens
  misc_feature: GZ8MTXP02IAXPM.38.23.C01.1.454.CMB.2.raw
  modified_base (397)..(397): a, c, t, g, unknown or other
  misc_feature (397)..(397): n is a, c, g, or t
  modified_base (420)..(420): a, c, t, g, unknown or other
  misc_feature (420)..(420): n is a, c, g, or t
  modified_base (452)..(452): a, c, t, g, unknown or other
  misc_feature (452)..(452): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagagttcttttgtcagctaccaagaatatgagttcgttagcttggtaccagcaagaaagcaacgacacgtcccctaagttgctctatttattggtcatctacgtcgggtgtccggggtcctgaccgattcagcggcagcggatcgtgggacagtatttcactctcaccatcagcanccctgcagactgaaacgagtggnggtctaggtttatacgtgtacagtctaaattnttagtggtacgttccgtcggtctccgtacgttcgggcggtaacggtacaagggtgaacgagtacgaagcgtaacgtggtacg

SEQ ID NO: 299898 - DNA, 554 bp, Homo sapiens
  misc_feature: GZ8MTXP02G0UDA.38.23.C01.1.454.CMB.2.raw
  modified_base (305)..(305): a, c, t, g, unknown or other
  misc_feature (305)..(305): n is a, c, g, or t
  modified_base (503)..(503): a, c, t, g, unknown or other
  misc_feature (503)..(503): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagccgtggggggtccctgaagctctcctgtgcagcctctggattcatatttagtaatcattggatgagttgggtccncaggctccgaggggacggggttggaggtggggtggccactataaaccacgatcgggaactagaaaaagactagtgtaggactctgtgaagggccgattcaccgtctcagagacaacgccaaagacttcactgtattgacaaatgaacagcctagagagtacgaagacgacggccaagtatattattgtaagtaaaagntactattacgattaagtcggtggacgtacggtacgggtggcgtagtttcgg

SEQ ID NO: 299899 - DNA, 548 bp, Homo sapiens
  misc_feature: GZ8MTXP02GGGGQ.38.23.C01.1.454.CMB.2.raw
  modified_base (299)..(299): a, c, t, g, unknown or other
  misc_feature (299)..(299): n is a, c, g, or t
  modified_base (308)..(308): a, c, t, g, unknown or other
  misc_feature (308)..(308): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctcgtgggcgaggacggccaaccatcaactgacaagtccagccagagttcttttgtcagctaccaagatatgagttcgtagcttggaccagcagaaagcacgacacgtccctaagtnctctatttntgtcatctacgtcggtgtcccgggtccagaccgtattcgacggtcgcgaggccgtatcgtagggacagtactttcgacttctacctaccatcagcacgccctagacaggactaggaaacgtgtggtaggtacttaggtttacttactgtacagactaaattattagtcggtactccgtacgtctcgtacggttcggacggacggacgagggtgacgtacgtacgacgtcgaactggtacg

SEQ ID NO: 299900 - DNA, 635 bp, Homo sapiens
  misc_feature: GZ8MTXP02F3DB5.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtgggggtccctgaagctctcctgtgcagcctctggattcatatttagatcattgatgagtggtccgcgaggctcggaggggacggggcgtgggaggtgggtcggaccaacgtaactaaaacccgacggaacgtacgggaaacctaagaaaaaacggtacttaagtggtacgggacttcgtaggtacggaacggggtccgtaagttccaacccgtctacccaaggaacgaaccgaaacgacctaaagtaacttactacgttagttatttagaactaaaatacggaaacacgcgtagagacggtacgaaagacgacggtaccaattataattagttagtaaagtaaaagactactacttggaattaaggtgggtacggacggtaaccggtagggtacggagtg

SEQ ID NO: 299901 - DNA, 542 bp, Homo sapiens
  misc_feature: GZ8MTXP02F2OKE.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagcctggggggtccctgaagctctcctgtgcagcctctggattcatatttagaatcattggatgagttgggtccgccaggctccaggggacggggctggagtggggtggccactataaaccacgatggaactagaaaaagctatgtggactctgtgaagggcgattcaccgtctccagagacaacgccaaagaattcactgtatttgacaaatgaacagcctagacgagtacgaagacacggccatataattattgtagtaaaagatactattcgaataagtacggtaggacggtacggttacggggtgactag

SEQ ID NO: 299902 - DNA, 579 bp, Homo sapiens
  misc_feature: GZ8MTXP02H2SLP.38.23.C01.1.454.CMB.2.raw
  modified_base (305)..(305): a, c, t, g, unknown or other
  misc_feature (305)..(305): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgagtgcagttggtggaatctgggggaaacttggtccagcctggggggtccctgaagctctcctgtgcagcctctggattcattatttagtaatcattggatgagtttgggtccnccaggctccgagggacggggctggagtggggtggcactaataaaccacgatggaaactagaaaaagactaatgtggacttctgtaggaagggccgatttcaacccgtctaccagacgaacaacgaccaaagaacttcaacttgtaatttgactaaatgtaaacagacctaggagtaagacgaaacgacaacggaccctaataattattaatttgtaagtaaaagatacgatttacgataagtggtacggacgtacggttaccggggagtcgtag

SEQ ID NO: 299903 - DNA, 544 bp, Homo sapiens
  misc_feature: GZ8MTXP02HMJL6.38.23.C01.1.454.CMB.2.raw
  modified_base (302)..(302): a, c, t, g, unknown or other
  misc_feature (302)..(302): n is a, c, g, or t
  modified_base (376)..(376): a, c, t, g, unknown or other
  misc_feature (376)..(376): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagcctgggggtccctgaagctctcctgtgcagcctctggatcatattagtaatcattggatgagtttgggtccnccgaggctccgagggacggggctgggagtggggtgccaactataaaccacgatggaaactagaaaaagactaangtggactctgtgaagggccgaattcgaacccgtctcccagacgaaccaacgaccaagaacttcaactgtatttgacaaatgaaacagacctgagagtacgaagacgacgccatatattattgtaataaagactcattacgataagtgtggcgacgtacgggtgactag

SEQ ID NO: 299904 - DNA, 522 bp, Homo sapiens
  misc_feature: GZ8MTXP02GOQIT.38.23.C01.1.454.CMB.2.raw
  modified_base (452)..(452): a, c, t, g, unknown or other
  misc_feature (452)..(452): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttcctgttgctattttagaaggtgtccagtgtgaggtgcagttggtggaatctgggggaaacttggtcagcctgggggtccctgaagctctcctgtgcagcctctggattcatatttagtaatcattggatgagttgggtccgccaggctccagggacggggctggagtgggtggccacgtataaaccacgatggaactgaaaaagactaatgtggactctgtgaagggcgattcaaccgtctcccagagacaacgccaagaaattcactgtatttgcaaatgaacagcctganagtgaagacacggccatatattattagtagtaaaagactacattgataagtgtgcgagtacggtggctag

SEQ ID NO: 299905 - DNA, 549 bp, Homo sapiens
  misc_feature: GZ8MTXP02FJF7T.38.23.C01.1.454.CMB.2.raw
  modified_base (499)..(499): a, c, t, g, unknown or other
  misc_feature (499)..(499): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagcctggggggtccctgaagctctcctgtgcagcctctggattcatatttagtaatcattggatgagttgggtccgccaggctcgagggacggggctggagtgggtggccactaataaaccacgagtggaactagaaaaagactatgtggactctgtagaagggcgattcacccgtctcccagagacaacgccaagaactcactgtatttagacaaatgaaacagcctagacgagtcgaaagacacggccatatattattagtataaaagntacattagtataagtgggtaggtcggacggttacggggtacggtacgtag

SEQ ID NO: 299906 - DNA, 552 bp, Homo sapiens
  misc_feature: GZ8MTXP02IOGTU.38.23.C01.1.454.CMB.2.raw
  modified_base (302)..(302): a, c, t, g, unknown or other
  misc_feature (302)..(302): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctctgggcgagacgggccaccatcaactgacaagtccagccagagttctttgtcagctacaagatatgagttcgtagcttggtaccagcaagaaagcacgacacgtcccctaagtcgctntatttatggtctatctacgtcgggtcgtccggggtcctgaccgattcgaggccgcaggcggactcgtagggacagtactttccaactctaccacatcagccagccctgaccagactgaaagtagtgtaggtctagtttattattgtcaggtctagtatgaattcgaggttcgcctacgacttccgtacccgttacggaccgaaggggaaccaaccggtacgtacggaacctaaaacgtaaaccgagtcgg

SEQ ID NO: 299907 - DNA, 609 bp, Homo sapiens
  misc_feature: GZ8MTXP02FX14L.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtgggggtccctgaagctctcctgtgcagcctctggattcattatttagtaatcattggatgagttggtccgcaggctcgaggggacgggctgggagtgggtggaccacgtaataaaaccgacgagtacggaaactaagaaaaagtctaagtgtgggactcgtaggtagaacggggccgtattcaccgtctacccagaacgacaacgaccaagtaacttacacgtagtatttagactaaaatacgaaacacgacctagaacgtacgtacggaaagtaacgaccggaccaattaacttaagtttagttagtaaagtaaaagattacctaattcgaataagtcggtacggaccggtacggtacggggtgtacttaagg

SEQ ID NO: 299908 - DNA, 543 bp, Homo sapiens
  misc_feature: GZ8MTXP02HF0RS.38.23.C01.1.454.CMB.2.raw
  modified_base (304)..(304): a, c, t, g, unknown or other
  misc_feature (304)..(304): n is a, c, g, or t
  modified_base (502)..(502): a, c, t, g, unknown or other
  misc_feature (502)..(502): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagcctgggggtccctgaagctctcctgtgcagcctctggattcatatttagtaatcattggatgagtttgggtccnccaggctccgagggacggggctggaggtgggtggccaacgtataaaccacgataggaactagaaaaagctaagtgtgggactctgtagaagggccgattcaccgtctccagagacaacgccaagattcatgtatttgactaaatgaacagcctagagagtcgaagacacggacatattattattggtataaaaacgtntactatagataagtggtcggacgtacggtacggtcgactag

SEQ ID NO: 299909 - DNA, 538 bp, Homo sapiens
  misc_feature: GZ8MTXP02J093G.38.23.C01.1.454.CMB.2.raw
  modified_base (371)..(371): a, c, t, g, unknown or other
  misc_feature (371)..(371): n is a, c, g, or t
  modified_base (498)..(498): a, c, t, g, unknown or other
  misc_feature (498)..(498): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagcctggggggtccctgaagctctcctgtgcagccctctggattcatatttagaatcattggatgagttggtccgcaggctcgagggacgggctggagtgggtggccactataaaccacgatagaactagaaaaagctagtgnggactctgtgaagggcattcaccgtctccagagacaacgccaagaattcactgtatttgactaaatgaacagcctagagagtacgaaacgacgacggaccaagtattaattattagtagtaaaacgntacgaattacgaatgtaggtggacgtaggtacggtgctag

SEQ ID NO: 299910 - DNA, 593 bp, Homo sapiens
  misc_feature: GZ8MTXP02JWJUL.38.23.C01.1.454.CMB.2.raw
  modified_base (329)..(329): a, c, t, g, unknown or other
  misc_feature (329)..(329): n is a, c, g, or t
  modified_base (363)..(363): a, c, t, g, unknown or other
  misc_feature (363)..(363): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtggggggtccctgaagctctcctgtgcagcctctggattcattattagtaatcattggatgtagttgggtccgcgaggctccgaggggacggggngtcgggaggtggggtcggccactactaaaacccncgaagtaggaaactagaaaaagtactagtgtggacttctaggtagaaggggccgtattccaccgtctaccagacgacaacgaccaagacttacacttacgttatttagactaaagtagaacacgcctagagaggtacgaacgacgacggacaagtataattattagtaagtaaaagactactattacgataaggtggtacggacggtacggtacgggtcggacgtttacg

SEQ ID NO: 299911 - DNA, 535 bp, Homo sapiens
  misc_feature: GZ8MTXP02JEM6V.38.23.C01.1.454.CMB.2.raw
  modified_base (325)..(325): a, c, t, g, unknown or other
  misc_feature (325)..(325): n is a, c, g, or t
  modified_base (331)..(331): a, c, t, g, unknown or other
  misc_feature (331)..(331): n is a, c, g, or t
  modified_base (337)..(337): a, c, t, g, unknown or other
  misc_feature (337)..(337): n is a, c, g, or t
  modified_base (339)..(339): a, c, t, g, unknown or other
  misc_feature (339)..(339): n is a, c, g, or t
  modified_base (350)..(350): a, c, t, g, unknown or other
  misc_feature (350)..(350): n is a, c, g, or t
  modified_base (352)..(352): a, c, t, g, unknown or other
  misc_feature (352)..(352): n is a, c, g, or t
  modified_base (354)..(354): a, c, t, g, unknown or other
  misc_feature (354)..(354): n is a, c, g, or t
  modified_base (356)..(356): a, c, t, g, unknown or other
  misc_feature (356)..(356): n is a, c, g, or t
  modified_base (360)..(360): a, c, t, g, unknown or other
  misc_feature (360)..(360): n is a, c, g, or t
  modified_base (379)..(379): a, c, t, g, unknown or other
  misc_feature (379)..(379): n is a, c, g, or t
  modified_base (396)..(396): a, c, t, g, unknown or other
  misc_feature (396)..(396): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttcctgttgctattttagaaggtgtccagtgtgaggtgcagttggtggaatctgggggaaacttggtccagcctggggggtccctgaagctctcctgtgcagcctctggattcatattagaatcatggatgagtggtcgcaggctccaggacgggctggagtggggngcatanaaacanangaatagaaaananangngatntgtagaggacgatcactcncagagacaacgacaaanaatacactatattagtacaaataagaacagacgtagagagacgaagaacgacgacataataattattagtaagtaaaagtaaatactaacttagtaataagtaggtacggtacggtaacggtacgggtacgggacgtag

SEQ ID NO: 299912 - DNA, 541 bp, Homo sapiens
  misc_feature: GZ8MTXP02HWWTZ.38.23.C01.1.454.CMB.2.raw
  modified_base (251)..(251): a, c, t, g, unknown or other
  misc_feature (251)..(251): n is a, c, g, or t
  modified_base (298)..(298): a, c, t, g, unknown or other
  misc_feature (298)..(298): n is a, c, g, or t
  modified_base (459)..(459): a, c, t, g, unknown or other
  misc_feature (459)..(459): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagacctcctggctgtgtctctgggcgagagggccaccatcaactgacaagtccagccagagtcttttgtcagctcaagatngattcgtagcttggaccagcagaaagcacgacacgtacccctaagtnctctatttatggtcatctacgtcggggttgtcccccggggtcctgaccgtattccgagtcgggctaggcgatccgtagggacagtattccactctcacatcagcacgcctggcggactaggaaagtatggttggtacggtttatacgtgtcagcagtattntacgttactcctactagtacgtttcggacctaacggggacctaagtcgtaagggatacgtacgacgtacgaacgttcggtcg

SEQ ID NO: 299913 - DNA, 536 bp, Homo sapiens
  misc_feature: GZ8MTXP02JS1WK.38.23.C01.1.454.CMB.2.raw
  modified_base (499)..(499): a, c, t, g, unknown or other
  misc_feature (499)..(499): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttcctgttgctattttagaaggtgtccagtgtgaggtgcagttggtggaatctgggggaaacttggtccagccgtggggggtccctgaagctctcctgtgcagcctctggattcatatttagtaatcattggatgagttgggtccgcaggctccgaggggacggggctgggagtgggtggccactataaaccacgatggaactagaaaaagctaatgtggactctgtagaagggccgattccaccgtctcccagagacaacgccaagacttcactgtatttagctaaatgaacagcctagacgagtacgaagacacggccagtatattatgtagtaaaagntacattcgataagtggtggcgaggtacgggtgactag

SEQ ID NO: 299914 - DNA, 554 bp, Homo sapiens
  misc_feature: GZ8MTXP02IG5VQ.38.23.C01.1.454.CMB.2.raw
  modified_base (303)..(303): a, c, t, g, unknown or other
  misc_feature (303)..(303): n is a, c, g, or t
  modified_base (350)..(350): a, c, t, g, unknown or other
  misc_feature (350)..(350): n is a, c, g, or t
  modified_base (354)..(354): a, c, t, g, unknown or other
  misc_feature (354)..(354): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagccgtgggggtcctgaagctctcctgtgcagcctctggattcattattagtaatcattggatgagttgggtccncaggctccgaggggacggggctgggagtggggtgccactataaaccncganaggaatagaaaaagctatgtggactcgtgtagaggggcattccaccgtctccagagacaacgaccaagactacgactgtatttgacaaatacgaacagcctagagagtacgaaagcgacgacctataattaattagttagtactaaaagacttacaattgaattaagtcggtaggacggtacggtacgggtggactttag

SEQ ID NO: 299915 - DNA, 648 bp, Homo sapiens
  misc_feature: GZ8MTXP02F79AH.38.23.C01.1.454.CMB.2.raw
  modified_base (460)..(460): a, c, t, g, unknown or other
  misc_feature (460)..(460): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagacctccctggctgtgtctcgtgggcgaggagggcccaccatcaactgacaagtccagccagtagttcttttgtcagctaccaagaatatgagttcgttagcttggaccagcaagaaagccaacgacacgtacccctaagttcgactctattttagtggtcctatccgttacgtccggggtcggtccccggggtcctcggacccgtattcgacggcggcagggccggtatcgtaggggacctagtactttccacctctaccaccatcagccacgcctgactagactagaaagtntggtacggtacttagtttactacgtcgtacaagtactaaattagttagttcgggtacgtacccgtcggttaccttaaccgttaccgggtttccgggggaaccggggtaacggggtaacccggtaaagggggtggtaaacggtaacggttaaccgaacgggtaacccggttaaaggtcggtaaccgggg

SEQ ID NO: 299916 - DNA, 550 bp, Homo sapiens
  misc_feature: GZ8MTXP02JPZVW.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggtttcctgttgctattttagaaggtgtccagtgtgaggtgcagttggtggaatcgtgggggaaacttggtccagccgtgggggtccctgaagctctcctgtgcagcctctggattcatatttagaatcattggatgagttgggtccgcaggctccgaggggacggggctgggagtgggtggccactataaaccacgatggaaactagaaaaagtctaagtgtggactcgtgtaggaagggccgatttccaccgtctcccgagagacaacgaccaaagaattcactgtatttagactaaatcgaacagacctagaagtagtacgaaagacacggaccaatatattatgtagtaaaagatacattagataagtggtaggcgagtacgggtgacgtag

SEQ ID NO: 299917 - DNA, 564 bp, Homo sapiens
  misc_feature: GZ8MTXP02HZ77B.38.23.C01.1.454.CMB.2.raw
  modified_base (410)..(410): a, c, t, g, unknown or other
  misc_feature (410)..(410): n is a, c, g, or t
  modified_base (512)..(512): a, c, t, g, unknown or other
  misc_feature (512)..(512): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtgggggtccctgagctctcctgtgcagcctctggattcattattagtaatcattggatgagttgggtccgccaggctccgaggggacggggcgtgggaggtgggtggccactataaaccacgataggaactagaaaaagactatgtggactctggtagagggccattccaccgtcnccagacgacaacgaccaagtatcacttagtatttagacaaatgaacagcctagacgagtacgaacgacgaccggacaataattattattaggtaagtaaaanattcaatttaccgattaagtgggtacggtacgtacgggtacgggtggactag

SEQ ID NO: 299918 - DNA, 557 bp, Homo sapiens
  misc_feature: GZ8MTXP02JGE5D.38.23.C01.1.454.CMB.2.raw
  modified_base (376)..(376): a, c, t, g, unknown or other
  misc_feature (376)..(376): n is a, c, g, or t
  modified_base (402)..(402): a, c, t, g, unknown or other
  misc_feature (402)..(402): n is a, c, g, or t
  modified_base (407)..(407): a, c, t, g, unknown or other
  misc_feature (407)..(407): n is a, c, g, or t
  modified_base (436)..(436): a, c, t, g, unknown or other
  misc_feature (436)..(436): n is a, c, g, or t
  modified_base (471)..(471): a, c, t, g, unknown or other
  misc_feature (471)..(471): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctcgtgggcgagagggccaccatcaactgcaagtccagccagagttcttttgtcagctcaagatatgagttcgtagcttggtaccagacagaaacgcacgacacgtcccctaagttcgctctatttagtggtcatctacgtcgggtcgtccccggggtccctgaccgtattcgacgcgcagcggatcgngggacagtactttcacttcctcaccntcganccacgtccctgacagactagaagattggnggtacttaagtttatacgtgttacagacttaaatnttagtcggttacgtccgtacggcttacgtacgttcggggacggtaacggaaccgtaagggtcggaagtactaacgaacgcgtaacg

SEQ ID NO: 299919 - DNA, 632 bp, Homo sapiens
  misc_feature: GZ8MTXP02JBOOP.38.23.C01.1.454.CMB.2.raw
  modified_base (303)..(303): a, c, t, g, unknown or other
  misc_feature (303)..(303): n is a, c, g, or t
  modified_base (319)..(319): a, c, t, g, unknown or other
  misc_feature (319)..(319): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgtctattttagaaggtgtccagtgtgaggtgcagttggtggaatcgtgggggaaacttggtccagccgtgggggtccctgaagctctcctgtgcagctctggattcattattagtatcattggatgagttggtccncgagctcgaggcgggngtggaggtgggtggccactactaaaccgacgataggaactaagaaaaacgactataggtgacttcgtagtacgaacgggtcgtacttccgaccgtcttacccgagacgtaaccaacgacccaaggaacttccgaattacgttaactttaggaacctaaaagtacgtaaactacgcccgtaaggagacggtacgaaacggaacaccggacctaattaattagttaatttggtaaacggtaaaatattacgtaacgttacgtaataaggttagggtcggttaccggaaacggggttcgggtacggacgtttaagg

SEQ ID NO: 299920 - DNA, 547 bp, Homo sapiens
  misc_feature: GZ8MTXP02IADYX.38.23.C01.1.454.CMB.2.raw
  modified_base (408)..(408): a, c, t, g, unknown or other
  misc_feature (408)..(408): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagctggggggtccctgagctctcctgtgcagcctctggattcattatttagtaatcattggatgagttgggtcccgccaggctccgaggggacggggctggagtggggtgccatataaaccacgataggaactagaaaaagactagtgtggactctagtgaagggccattcacccgtcnccagacacaacgaccaaagaattcactgtatttgacaaatgaactagcctagagagtacgaagacacggcaatatattattagtaagtaaaagatacatttcgaattaagtggtacggacgacggtacgggtaggctag

SEQ ID NO: 299921 - DNA, 547 bp, Homo sapiens
  misc_feature: GZ8MTXP02GJSSH.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagccgtgggggtccctgaagctctcctgtgcagcctctggattcattatttagtaatcattggatgagttgggtccgcaggctccgagggacggggctgggagtgggtggccactataaaccgagatggaactagaaaaagactatgtgactgtgtgaacgggctatcaccgttctacccagagaacaacgacaagaatcactgtattgacaaatagaacagcctagagagtacgaacgacacggaccataatattatagtaagtaaaagatactattacgaataagtaggtaggtacggacggtacgggtggacttag

SEQ ID NO: 299922 - DNA, 550 bp, Homo sapiens
  misc_feature: GZ8MTXP02GFZLG.38.23.C01.1.454.CMB.2.raw
  modified_base (281)..(281): a, c, t, g, unknown or other
  misc_feature (281)..(281): n is a, c, g, or t
  modified_base (424)..(424): a, c, t, g, unknown or other
  misc_feature (424)..(424): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagtagttcttttgtcagctacaagaatatgtagttcgttagcttggtaccagcaagaaancaacgacacgtcccctaagtcgctactatttagtgtacatcgtacgtcgggtgtcccgggtcctcgaccgtatcgaggtcggcaggcgatcgtgggactagtactttcactcacaccatcagcacgcctgacagactgaaagntgtggtactagtttatactcgtcagactaaattattagtgtactccgtcggtctacgtaccgttcgggacggtaacggacgtaagggtaagaagtacgtacgaaacggtaccgtaagttcggtacg

SEQ ID NO: 299923 - DNA, 565 bp, Homo sapiens
  misc_feature: GZ8MTXP02JMG3X.38.23.C01.1.454.CMB.2.raw
  modified_base (377)..(377): a, c, t, g, unknown or other
  misc_feature (377)..(377): n is a, c, g, or t
  modified_base (410)..(410): a, c, t, g, unknown or other
  misc_feature (410)..(410): n is a, c, g, or t
  modified_base (424)..(424): a, c, t, g, unknown or other
  misc_feature (424)..(424): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagtagttctttgtcagcctacaagaatatgagttcgtagcttggaccagcaagaaagcacgacacgtacccctaagttgctactatttatggtcattctacgtcgggtcgtccggggtcctacgaccgtattcaggcgacaggcggatcgtggganagtatttcgactctacaccatcagcacgcctanacagactagaaagngtagtggctagtttactactgtacagataagttattagtgtacgtccgttacggaccttcggtacgtttccgggacgggtaacggaaccgtaaggggtaaggaacgtaacgtaccggaaaggaccgtaaacggtggtacgg

SEQ ID NO: 299924 - DNA, 534 bp, Homo sapiens
  misc_feature: GZ8MTXP02J2VKE.38.23.C01.1.454.CMB.2.raw
  modified_base (275)..(275): a, c, t, g, unknown or other
  misc_feature (275)..(275): n is a, c, g, or t
  modified_base (337)..(337): a, c, t, g, unknown or other
  misc_feature (337)..(337): n is a, c, g, or t
  modified_base (413)..(413): a, c, t, g, unknown or other
  misc_feature (413)..(413): n is a, c, g, or t
  modified_base (427)..(427): a, c, t, g, unknown or other
  misc_feature (427)..(427): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagacctccctggctgtgtctctgggcgagagggccaccatcaactgcaagtccagccagagttcttttgtcagctacaagatatgattcgtagcttggtacagcagaaancacgacacgtcccctaagtgctactatttattggtcatctacgtcgggtcgtccggggtccngaccgtattcagcggcagccggatcgtgggacagtatttcactctacaccatcagcagcctagcagactgatatgngctagtttattacngtcagactaatattagtggtaacgtcgtcggtctacgtacctttacgggacggacgggtaaccgaagggttggaacgtagtaccgaagcccggtaaacgtggtccgg

SEQ ID NO: 299925 - DNA, 549 bp, Homo sapiens
  misc_feature: GZ8MTXP02GW6JJ.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtggggggtccctgaagctctcctgtgcagcctctggattcattatttagtaatcattggatgagttgggtccgcaggctccgagggacggggctggagtgggtgccatataaaccacgatggaactagaaaaagctatgtggactcgtgtagaacgggcgattccaccgtctcccagacgacaacgacaaagaatcactgtatttagacaaatgaacagcctagagagtacgaagacacggacatatattatgtaagtaaaagatacaattacgaataagtaggtacggacggtaacggtacggggtgacttagg

SEQ ID NO: 299926 - DNA, 597 bp, Homo sapiens
  misc_feature: GZ8MTXP02H571E.38.23.C01.1.454.CMB.2.raw
  modified_base (186)..(186): a, c, t, g, unknown or other
  misc_feature (186)..(186): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtntctgtggcgagagggccaccatcaactgcaagtccagccagagtcttttgtcagctcaagatatgagttcgtagcttgaccagcaagaaagcaacgacacgtacccctaagtcgctctatttatggtcatctacgtcggggtcgtcccccggggtcctacgaccgtattcgacggcccggcgaacggcggtaacttcggtagggggaaccattaactttcctaactcctaccacctataccacgccaacgccctgctaacgacgttagaaagtgttgacggtacttaaggtttaacttaacgtggttacagtaactaattaagttagttaggtacgtttccgtacgtcttccgtacggttccggacgggtacggaaccgaaggtacggagtactacgaacggtacgaacgg

SEQ ID NO: 299927 - DNA, 572 bp, Homo sapiens
  misc_feature: GZ8MTXP02GTOC3.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaagtctgggggaaacttggtccagccgtggggggtccctgaagctctcctgtgcagcctctggattcatatttagtaatcattggatgagttgggtccgccaggctccgagggacggggctggagtgggtggccactataaaccagactggaactagaaaaagactatgtgggactctggtagaacggggccgattccaccgtctcccagagacaacgccaaagaattcactgtatttagacaaatgaacagacctagagagtacgaaagacgacggccaatattattattagtacgtaaaaagtatactaagttcgaattaagtagggtacgggcggtaacggtaaccggggtggacctttagg

SEQ ID NO: 299928 - DNA, 569 bp, Homo sapiens
  misc_feature: GZ8MTXP02FN2MT.38.23.C01.1.454.CMB.2.raw
  modified_base (510)..(510): a, c, t, g, unknown or other
  misc_feature (510)..(510): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagccgtgggggtccctgaagctctcctgtgcagcctctggattcatatttagtaatcattggatgagttggtccgccaggctccgagggacggggcgtggagtggggtggccactataaaccacgataggaactagaaaaagactatgtggactcgtgtgaagggcgattccgaccgtctaccagagacaacgaccaaagaactcacttagtatttgacaaatgaaacagctagacgagtacgaagacgacggacataagtatttattagtagtaaaaagtntacgtagttacgaattaagtggggtacggacgggtacggttacgggtgggtactttagg

SEQ ID NO: 299929 - DNA, 592 bp, Homo sapiens
  misc_feature: GZ8MTXP02HZC6K.38.23.C01.1.454.CMB.2.raw
  modified_base (542)..(542): a, c, t, g, unknown or other
  misc_feature (542)..(542): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccaggccgtgggggtccctgaagctctcctgtgcagccctctggattcattattagtaatcattggatgagttgggtccgcaggctccgaggggacggggctgggaggtgggtgcaactataaaccacgataggaaactaggaaaaagctagtggtggacttctggtaggaaacggggcccgtaattccacccgttcaccgaagacgaaccaaccgaccaaagtaacttacaccttagttaatttaggaactaaaagtagaacagccgtagaagagtacgaagacacggaccagtattattattgtaataaaagntacattacgaattaagtgggtacgacggtacggtacggggcgtacgtagg

SEQ ID NO: 299930 - DNA, 521 bp, Homo sapiens
  misc_feature: GZ8MTXP02JWGWC.38.23.C01.1.454.CMB.2.raw
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagagtctttgtcagctccaagatatgagttcgtagcttggtaccagcagaaagcacgacagtcccctaagtgctcatttatgtcatctactcgggtgtccggggtcctgaccgattcagcggcagcgatcgtgggacagtatttcactctcaccatcagcagcctgcagactgaagatgtggctagtttatactgtacagtactaatattagtgtacttccgtcggtctcgtaaccgtttcgggaccgggtacggtaaccgaagggtcgtaagacgtacgaagaccgtaacgtggtacgg

SEQ ID NO: 299931 - DNA, 534 bp, Homo sapiens
  misc_feature: GZ8MTXP02JZ6YT.38.23.C01.1.454.CMB.2.raw
  modified_base (414)..(414): a, c, t, g, unknown or other
  misc_feature (414)..(414): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaatgcaagtccagccagagtctttgtcagctcaagaatatgagttcgtagcttggtaccagcagaaagcaacgacagtcccctaagttgctctatttattggtcatctacgtcgggtgtccccggggtcctgaccgattcagcgcgagcggatcgtgggacagtattcactctcaccatcagcagcctgacagactgaagatgnggactagtttatacgtgtacagactaaattattagtcggtacgtccgtcggactcgtacgtttcgggacggaacgggaaccgtaaagggtcggaacgagtaccgaaaaggccgtaaacgg

SEQ ID NO: 299932 - DNA, 605 bp, Homo sapiens
  misc_feature: GZ8MTXP02G1X3K.38.23.C01.1.454.CMB.2.raw
  modified_base (343)..(343): a, c, t, g, unknown or other
  misc_feature (343)..(343): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtgggggtccctgagctctcctgtgcagcctctggattcattatttagtaatcattggatgagttggtccgcgaggctccgaggggacgggctggagtggggtgccatanaaaccgacgatggaaactagaaaaagtctatgtggacttcgtaggtagaacggggccgtattcccgacccgttctacccgaagaacgaacgaaaccgacccgaaagtaacttccaacttagttaagttttacgaactaaaatacgaaacagtaccctaggaagagtacggaaacgacgaccggacaatattaattattagtaaagtaaaacgatactattacgataagtgggtacggacggtacggtacgggtggactttag

SEQ ID NO: 299933 - DNA, 500 bp, Homo sapiens
  misc_feature: GZ8MTXP02HUIV2.38.23.C01.1.454.CMB.2.raw
tcagtcgatcacgtcacgaccggtgctcgatttagtacacgtgattagggattggggacaacaggcaggcaggggcagcaagatggtgttgcagacccagtcttcatttctctgttgctctggatctctggagcctacggggacatcgtgatgacccagtctccagactccctggctgtgtctctgggcgagagggccaccatcaactgcaagtccagccagagtcttttgtcagctcaagatatgagttcgttagcttggtaccagcagaaagcacgacagtcccctaagttgctcatttattggtcatctactcgggtgtccggggtcctgaccgattcagcggcagcggatctgggacagatttcactctcaccatcagcagccctgcagactgaagatgtggctagtttattactgtcagcaatattatggtatcctcggtctctacgtttcgggcgtacggggaccaagggtggagatcgagcgaactggtacgg

SEQ ID NO: 299934 - DNA, 680 bp, Homo sapiens
  misc_feature: GZ8MTXP02IWNR3.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgcttattttagaaggtgtccagtgtgaggtgcagttggtggaatcgtagggggtaaacttggtccagccgtgggggtcctcgagctctctgtgcacgcctcgtggtattcattaatttagtaatctattggatgtaggtttgggcccgcgaggccgtaccggaggggacggggcgtgggaggtggggtcgaccctaacttaataaacccgagtaactaggaaaacctagaaaaaagtactagttgtgggtacctcgtaggtagggaaaccggggtccgtaattacccaccgtcctaccgaagacgaacaaaccgaccaaagtaacttactaacgtagttaatttacgaactaaaagttacgaaacgtacgaccgttaaggagaacgttacggaaacgaaccgacggaacctaagtaatttaattaagtttagtaaagtaaaaagtacttacgtaacgttagtaagttaagttagggtacggtaccggtacggttaccgggggtgtacgtttag

SEQ ID NO: 299935 - DNA, 537 bp, Homo sapiens
  misc_feature: GZ8MTXP02GAWNY.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtggggggtccctgaagctctcctgtgcagcctctggattcatatttagtaatcattggatgagttgggtccgccaggctccgagggacggggcgtggaggtggggtggccactataaaccacgatggaactagaaaaagactatgtggactcgtgtgaagggcgattccaccgtctcccagagacaacgcaagatcactgtatttgacaaatgaacagcctagagagtcgaagacacggcaagtatattatagtataaaagatacgaattcgataagtgtggtacgacggtagggtcgcttag

SEQ ID NO: 299936 - DNA, 632 bp, Homo sapiens
  misc_feature: GZ8MTXP02JZTN1.38.23.C01.1.454.CMB.2.raw
  modified_base (326)..(326): a, c, t, g, unknown or other
  misc_feature (326)..(326): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcttgggttttccttgttgctatttagaaggtgtccagtgtgaggtgcagttggtggaatcgtgggggaaacttggtccagccgtgggggtcctgaagctctctgtgcagctctggattcattattagtatcattggatgtaggttgggcccgcgaggcgtccgaggggacggggngtgggaggtggggtcggaccaacttaaagaaaccgacgagtacggaaactaggaaaaagactagtgtggactctggtaggaagggccgtattccgaccgtctaccgagaacgaaccaaacgaccaaagtacttacaacttgttaattacgaactaaaatgaaacgacgtacctaggaagtaacgtaacggaaagaaccgaccggaactaattaaattaactttaagttagtaaagtaaaaacgtctaacgtacgttaagtagtaacggtggtacgggtacggtacgggtacgggtagtacgttacg

SEQ ID NO: 299937 - DNA, 590 bp, Homo sapiens
  misc_feature: GZ8MTXP02HL55K.38.23.C01.1.454.CMB.2.raw
  modified_base (440)..(440): a, c, t, g, unknown or other
  misc_feature (440)..(440): n is a, c, g, or t
tcagtcgatcacgtcacgaccggtgctcgatttagtacacgtgattagggattggggacaccaggcaggcaggggcagcaagatggtgttgcagacccaggtcttcatttctctgttgctctggatctctggagcctacggggacatcgtgatgacccagtctccagactccctggctgtgtctcgtgggcgagagggccaccatcaactgacaagtccagccagtagttcttttgtcagtctaccaaagaatatgtagttcgtagtcttggtaccagacaagaaagcacgacacgtcccctaagttcgctactatttagtggtctatctacgtcggggtcgtcccggggtcctacggacccgtattcgaggtcggcaggcggatcgagggactagtctttccactctacaccctatcgagcacgtccctgacgagtacngaaagtcgtaggtcgtacttagtttactacgtgtacgtagtactaagttagttagtacggtacttccgtacggtcttacgtaccggttacggggacggtaacgggaccgtaagggtcggaagtacgtacgaaggtacgtaacgtggtcgg

SEQ ID NO: 299938 - DNA, 545 bp, Homo sapiens
  misc_feature: GZ8MTXP02G1CC3.38.23.C01.1.454.CMB.2.raw
  modified_base (339)..(339): a, c, t, g, unknown or other
  misc_feature (339)..(339): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagacgtggggggtccctgaagctctcctgtgcagcctctggattcattatttagtaatcattggatgagttgggtccgcaggctccgagggacggggctggaggtggggnggccactataaaccagatggaactagaaaagactatgtggactcgtgtgaagggccgatcaccgtctccgagagacaacgacaagaatcactgtatttagacaaatgaacagacctagagagtacgaagacacggccaagtatattatagtagtaaaagatactaattcgtaataagtggtggacgtacggtacgggtcgacgtag

SEQ ID NO: 299939 - DNA, 552 bp, Homo sapiens
  misc_feature: GZ8MTXP02FULJT.38.23.C01.1.454.CMB.2.raw
  modified_base (500)..(500): a, c, t, g, unknown or other
  misc_feature (500)..(500): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggtttcctgttgctattttagaaggtgtccagtgtgaggtgcagttggtggaatcgtgggggaaacttggtccaggccgtggggggtccctgaagctctcctgtgcagcctctggattcatatttagtaatcattggatgagttgggtccgcgaggctcgaggggacggggctggaggtgggtggccactataaaccacgatggaactagaaaaagctatgtggactctggtgaagggtcattccaccgtctaccagacgacaacgacaagaattcactagtatttgactaaatgaacagcctagagagtacgagacacggaccatatattattagtagtaaaagntactaattcgaagtaagtgggtacggacgtaccggttacggggtgacttagg

SEQ ID NO: 299940 - DNA, 540 bp, Homo sapiens
  misc_feature: GZ8MTXP02IG2VW.38.23.C01.1.454.CMB.2.raw
  modified_base (341)..(341): a, c, t, g, unknown or other
  misc_feature (341)..(341): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggtttcctgttgctatttagaaggtgtccagtgtgaggtgcagttggtggaatcgtgggggaaacttggtccagcctgggggtccctgaagctctcctgtgcagcctctggattcatatttagtaatcattggatgagttgggtccgcaggctcgagggcggctggagtgggtgccactataaaccngatgaactagaaaagactatgtggactcgtgtagaaggggcgattcaccgtctccgagagacaacgacaagtaattcacgtgtatttgactaaatagaacagccgtagagacgtagaacgacacggacctatataagttattagtagtaaaagctactacttcgataagtaggtaggcggtacggtacgggtacgctag

SEQ ID NO: 299941 - DNA, 587 bp, Homo sapiens
  misc_feature: GZ8MTXP02GGYJ7.38.23.C01.1.454.CMB.2.raw
  modified_base (304)..(304): a, c, t, g, unknown or other
  misc_feature (304)..(304): n is a, c, g, or t
  modified_base (353)..(353): a, c, t, g, unknown or other
  misc_feature (353)..(353): n is a, c, g, or t
  modified_base (581)..(581): a, c, t, g, unknown or other
  misc_feature (581)..(581): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttcctgttgctattttagaaggtgtccagtgtgaggtgcagttggtggaatcgtgggggaaacttggtccagccgtggggggtccctgaagctctcctgtgcagcctctggattcatatttagaatcattggatgagttgggtccnccgaggctccgaggggacggggctgggagtggggtggccatataaaccngatggaactagaaaaagctatgtggactcgtggtagaaacgggcccgaatttccaacccgtctacccgaagaagaacaaaccgaccaaagtaacttacaacttagtaatttaggtacaaaattacggaaacacgacccgttagaacgaagtaccgaaagaaccaacggacctaatataatttattagtaagtaaaagactacatgataagtggtgacgacggtacggngcgtag

SEQ ID NO: 299942 - DNA, 577 bp, Homo sapiens
  misc_feature: GZ8MTXP02F6192.38.23.C01.1.454.CMB.2.raw
  modified_base (261)..(261): a, c, t, g, unknown or other
  misc_feature (261)..(261): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtgggggtccctgaagctctcctgtgcngcctctggattcattatttagtatcattggatgagttgggtccgcaggctccgaggggacggggctgggaggtggggtggccactaataaaaccgacgataggaactagaaaaacgactatgtggtactcgtagtgaaggggccgtattccgaccgtctccgagagacaacgaccaaagacttacactagtatttagacaaatgaaacagcctagagaacggtacgaaagaccgtacggaccagtattaattagttagtagtaaaagctactattacgataagtcggtggacggtacggtacgggtggcgttaagg

SEQ ID NO: 299943 - DNA, 542 bp, Homo sapiens
  misc_feature: GZ8MTXP02GOJSQ.38.23.C01.1.454.CMB.2.raw
  modified_base (446)..(446): a, c, t, g, unknown or other
  misc_feature (446)..(446): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctcgtgggcgagagggccaccatcaactgcaagtccagccagagttcttttgtcagctacaagaatatgagttcgtagcttggtaccagcagaaagcaacgacacgtcccctaagtcgctctatttattggtcatctacgtcgggtgtccggggtcctgaccgtattcaggtcggcagcggtatcgtgggacagtatttcactctcacccatcagcacgcctgacagactgaaagagtggtgtactagtttatacgtgtacagntaaattattagtcgtagttcctcggtctcgttaacgttcgggacggtacgggacctaaggggtcgacgtatacggaaagtccgtaaacgtggtcgg

SEQ ID NO: 299944 - DNA, 568 bp, Homo sapiens
  misc_feature: GZ8MTXP02GUNED.38.23.C01.1.454.CMB.2.raw
  modified_base (306)..(306): a, c, t, g, unknown or other
  misc_feature (306)..(306): n is a, c, g, or t
  modified_base (371)..(371): a, c, t, g, unknown or other
  misc_feature (371)..(371): n is a, c, g, or t
  modified_base (528)..(528): a, c, t, g, unknown or other
  misc_feature (528)..(528): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtgggggtccctgaagctctcctgtgcagcctctggattcattatttagtaatcattggatgagttgggtccncgaggctccgagggcgggctggaggtgggtgccactataaacccgagaatggaaactagaaaaanactatgtcggactcgtaggtaggaacggggccgtattcccgacccgtctacccgaagaacgaacaaccgaccaaagtaactacgactagtatttagactaaatgaacagccgtagaagagtacgaagacgacgacatatattattagtagtaaaagntactagtgaatgtggaggcgtacggtacgggtcgacttag

SEQ ID NO: 299945 - DNA, 561 bp, Homo sapiens
  misc_feature: GZ8MTXP02HUCXY.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtggggggtccctgaagctctcctgtgcagccctctggattcatattagtaatcatggatgagtttgggccgccaggctccgaggggacggggctgggagtggggtggccactagtaaaccacgatggaaactagaaaaagctatgtgactctgtagaagggcccgattccgaacccgtcctaccgagacgaaccaacgaccaaaggaacttcaacttgtatttagactaaatgaacagcctagagagtagaagacacggcagtatattattagtagtaaaagatcattacgattaagtggtacggcgtacggtacggtggtacttag

SEQ ID NO: 299946 - DNA, 600 bp, Homo sapiens
  misc_feature: GZ8MTXP02HFP3T.38.23.C01.1.454.CMB.2.raw
  modified_base (305)..(305): a, c, t, g, unknown or other
  misc_feature (305)..(305): n is a, c, g, or t
  modified_base (545)..(545): a, c, t, g, unknown or other
  misc_feature (545)..(545): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtgggggtccctgaagctctcctgtgcagcctctggattcattatttagtaatcattggatgagttggtccncgagctccgagggacgggctggagtgggtggccatactaaacacgagtaggaactagaaaaagtctaagtgtggtactcgtggtagaacggggccgattcccgacccgtcctacccgagaacgaccaaaccgaccctaagaacttaccacttagttatttagacctaaagtcgaaacagtcctagaagtacgtaacggaacgacgacggactaattattagttagttagtaaagtaaaanatactattacgtataagtgggtaggtacggtaagggtaccgggtagtactttagg

SEQ ID NO: 299947 - DNA, 629 bp, Homo sapiens
  misc_feature: GZ8MTXP02JKUCZ.38.23.C01.1.454.CMB.2.raw
  modified_base (244)..(244): a, c, t, g, unknown or other
  misc_feature (244)..(244): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttcctgttgctattttagaaggtgtccagtgtgaggtgcagttggtggaatcgtgggggaaacttggtccagccgtgggggtcccngaagctctcctgtgcagcctctggattcattatttagtaatcattggatgagttgggtccgcgaggctcgaggggacgggcgtgggaggtggggtgccaactaacgaaaccgacgaagtaggaactagaaaaagactagtggtggacttcgtggtacggaacggggcgtagttcccaccgtctacccgagacgaacgaacgacccaaaggtacttacgacttagttaatttggacaaaagtcgaaacagtcctagaacgacggtacgaaacgaccgaaccggtcaaagttattaaattatttaaggtaaacggtaaaatacttactaatttcggaattaaggtggggtacggaccgggtaggttacgggggtcgtacgtttaacg

SEQ ID NO: 299948 - DNA, 726 bp, Homo sapiens
  misc_feature: GZ8MTXP02IC28S.38.23.C01.1.454.CMB.2.raw
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctctgggcgagagggccacatcaactgacaagtccagccagagttcttttgtcagtctaccaaagtaatatgtagttcgttagcttggtaccagcaagaaacgcaaccgacacgttaccccgtaagttcgccttactattttagtcggttacatttccgtacgttcggggtccgtccggggtccctcggacccgtattcgacggtcggacgtacggcggtacttcggtaggggaacctagtacttttccaacctcccttacccaaccctataccgaacggtcccaacggtcccttacggaccaaagggtacctaggaaaacggttcgttacgggttgggtaacctttaagggtttttaactttaaccgtggttacctaaacggtctaaaatttagttaagttacggggttaaccttaccccggttacggttcctacctttaccggggtttacggggacccgggttaaggggtaacccgtaaagggggttaaccgggaactaacgttacggaaaccggtaccggtaaaccgtttaggtaccgggg

SEQ ID NO: 299949 - DNA, 580 bp, Homo sapiens
  misc_feature: GZ8MTXP02IUZ61.38.23.C01.1.454.CMB.2.raw
  modified_base (406)..(406): a, c, t, g, unknown or other
  misc_feature (406)..(406): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagacctccctggctgtgtctctgggcgaggagggccaccatcaactgcaagtccagccagtagttcttttgtcagcctaccaaagaatatgagttcgttagcttaggtaccagcaagaaagcaacgacacgtacccctaagtcgctctatttatggtcatctacgtcgggtcgtccccgggtcctgactattcgagcgcgagcggatcgtagggactagtctttcactctacaccntaccgagccagcctgacgaagacgtagaaagacgttaggtcggtattaacgtttattacgtgtacaagtactaaattagttaagtcggtacgttccgtacggtccttacgttaccggttcggacgggtaacgggtaaccgaagggtacggataacgtacgaacggacgtaacgg

SEQ ID NO: 299950 - DNA, 585 bp, Homo sapiens
  misc_feature: GZ8MTXP02F6HM5.38.23.C01.1.454.CMB.2.raw
  modified_base (475)..(475): a, c, t, g, unknown or other
  misc_feature (475)..(475): n is a, c, g, or t
  modified_base (533)..(533): a, c, t, g, unknown or other
  misc_feature (533)..(533): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtggggggtccctgaagctctcctgtgcagcctctggattcatatttagtaatcattggatgtagttggtccgcgaggctcgagggacggggctggagtgggtggccactaataaaccacgagtagaactagaaaaagactatagtcgactcgtaggtaggaacgggccgtattccaaccgttcctacgagaacaacgaaacgaccaagtaaactcgaactagtattagactaaatgaaacngactagaagagtacgaaagacaccggactaatagtaattagttacgtaaagtaaaatntactaatacgaataagtacgggagacggtacggtacgggtcggtacttaagg

SEQ ID NO: 299951 - DNA, 581 bp, Homo sapiens
  misc_feature: GZ8MTXP02JVVOB.38.23.C01.1.454.CMB.2.raw
  modified_base (308)..(308): a, c, t, g, unknown or other
  misc_feature (308)..(308): n is a, c, g, or t
  modified_base (376)..(376): a, c, t, g, unknown or other
  misc_feature (376)..(376): n is a, c, g, or t
  modified_base (390)..(390): a, c, t, g, unknown or other
  misc_feature (390)..(390): n is a, c, g, or t
tcagtcgatcacgtcacgaccggtgctcgatttagtacacgtgattagggattggggggtctcagagaggagccttagccctggactccaaggcctttgcacttggtgatcagcactgagcacagaggactcaccatggaattggggctgagctgggttttccttgttgctattttagaggtgtccagtgtgaggtgcagttggtggaatcgtgggggaaacttggtccagccgtggggggtccctgaagctctcctgtgcagccctcgtggattcatatttagtaatcattggatgagttgggtccncgaggctccgaggggacggggctgggagtggggtgccactaataaaccagagtaggaactagaaaaanctatgtggactcgngtagaacgggccgattccacccgtctacccgagacgaacaacgaccaaagaacttacacgtagttatttaggactaaatagaacagcccgtagacgagtacgaagacgacggacaatattattagtgtaaaggtaaatactacattacgattaagtcgggtacggacggtacggtacggggtggacttagg

SEQ ID NO: 299952 - DNA, 553 bp, Homo sapiens
  misc_feature: GZ8MTXP02GYMN5.38.23.C01.1.454.CMB.2.raw
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagacctccctggctgtgtctctgggcgagacgggccaccatcaactgcaagtccagccagtagttcttttgtcagctacaagaatatgtagttcgtagtcttggtaccagcaagaaagcaacgacacgtccccttaagtcgctactattttatggtctatctacgtcgggtcggtccggggtcctcgaccgtattcgacgcggcaggcggatcgtagggacagtactttcactctacactactcagcacgtccctaagacgactagaacgtagtcggaggtacttagtttattcgtataccaaatattatagtgtactcgtcgcttctacggttcggacggtacggacgtaagggtcgaagtaatcgaaagtcaagtcgtcggactcg

SEQ ID NO: 299953 - DNA, 570 bp, Homo sapiens
  misc_feature: GZ8MTXP02JNLWU.38.23.C01.1.454.CMB.2.raw
  modified_base (483)..(483): a, c, t, g, unknown or other
  misc_feature (483)..(483): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagcctggggggtccctgaagctctcctgtgcagcctctggattcatatttagtaatcattggatgagtttgggtccgccaggctccgaggggacgggcgtggagtggggtggccacgtataaaccacgatggaactagaaaagactatgtgggactctgtgaaggggccgattcacccgtctcccaagcgacaaccgccaaagagtttacacttcgtattttgcaaatgaaacagcctgagaagtccgaagaccncggacctactagttattagttagtagtaaaaagagtacatttacggattaagtaggtcggtcggaaggtaccgggggtaggtctaag

SEQ ID NO: 299954 - DNA, 537 bp, Homo sapiens
  misc_feature: GZ8MTXP02HYL7U.38.23.C01.1.454.CMB.2.raw
  modified_base (304)..(304): a, c, t, g, unknown or other
  misc_feature (304)..(304): n is a, c, g, or t
  modified_base (367)..(367): a, c, t, g, unknown or other
  misc_feature (367)..(367): n is a, c, g, or t
  modified_base (491)..(491): a, c, t, g, unknown or other
  misc_feature (491)..(491): n is a, c, g, or t
  modified_base (498)..(498): a, c, t, g, unknown or other
  misc_feature (498)..(498): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgcttattttagaaggtgtccagtgtgaggtgcagttggtggaatcgtagggggaacttggtccagccgtgggggtccctgagctctctgtgcagcctctggattcattatttagaatcattggatgagttgggtccncgaggctccgagggacgggctggagtgggtggccatactaaaccacgatggaaactgaaaaanctaatgtggactctgtgaaggggccattcaccgtctcccagagacaacgaccaagtaattcactgtatttgactaaatgaaacagcctagaagacgtacgaaagacacggaccagtatatattnagtaaanatctattcgataagtggtaggcgaggtacggtgtactag

SEQ ID NO: 299955 - DNA, 817 bp, Homo sapiens
  misc_feature: GZ8MTXP02FLDTC.38.23.C01.1.454.CMB.2.raw
  modified_base (303)..(303): a, c, t, g, unknown or other
  misc_feature (303)..(303): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtgggggtccctgagctctcctgtgcagcctctggattcatattagtaatcattggatgagttgggtccncgaggctccgaggggacgggctggaggtggtggccactataaaccacgataggaactagaaaaagctaatgtggactcgtaggtagaacgggccgtaaattccgtaacccgttcctacccgaaggaacgaaccgaaacccgacccaaaacggtaaacttacctaacgttacgtttaagtttttacggaaaccctaaaaagtttacgggaaaaccaacgggtacccccgtttaagggaaaggtaaacgggtttaaacccgggaaaaacggggtaaacccgtaaaaccccgggggaacccctaaaacgtttaaaacgttttaaaactttttaaaacggtttttaaacgggtttaaaacgggtttaaaaaaaaacgggttaaagtttaaccccttaaaagttttacccgggttaaaagtttaaacgggtttagggggtttaacgggggtaaccccggggttaaaaccgggggttttaaccccggggggtttaagggggtacccgttttaaaacgggg

SEQ ID NO: 299956 - DNA, 643 bp, Homo sapiens
  misc_feature: GZ8MTXP02FWCRF.38.23.C01.1.454.CMB.2.raw
  modified_base (587)..(587): a, c, t, g, unknown or other
  misc_feature (587)..(587): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtgggggtccctgagctctcctgtgcagcctctggattcatatttagtaatcattggatgagttggtccgcaggctcgagggacggggcgtggaggtgggtcggacccaacgtaactaaaacccgacggaagtagggaaacctaaggaaaaaacgtacttagtagggtcgggacttcgtaggtacggaaggggtcccgtaacgttcccgtaacccgttctacccgaagaacgaaccgaaaccgaccaaagtaacttacgacttagttatttagactaaaatcgaaacacgtaccgtagaagtacgtacgaaacgacgaccggacctaagtaattattagttagtaaggtaaaanattacgtaattcgtaataagttgggtacggacggtacggtacgggtggactttagg

SEQ ID NO: 299957 - DNA, 621 bp, Homo sapiens
  misc_feature: GZ8MTXP02JGDS2.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtggggggtccctgaagctctcctgtgcagcctctggattcatatttagtaatcattggatgagttgggtccgcaggctccgaggggacgggcgtgggaggtggggtggcccactaactaaaaccacgataggaaactagaaaaaacgactaatgtgggactcgtaggtagaacggggccgtaattccgacccgttcctacccgaaacggaacgaaccgaaaccgaccaaaagtaaacttaccaacttagttaattttacggaactaaaagtacgaaacacgacctagaagagtacgaaagaacacggaccaataattattattagtaagtaaaagatacagttacgaattaagtggtacggacggtacggtacgggtcggacttagg

SEQ ID NO: 299958 - DNA, 622 bp, Homo sapiens
  misc_feature: GZ8MTXP02FLWE6.38.23.C01.1.454.CMB.2.raw
  modified_base (441)..(441): a, c, t, g, unknown or other
  misc_feature (441)..(441): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagccgtacggggacatcgtgatcgacccagtctccagacctccctggctgtgtctcgtgggcgagacggccaccatcaactgacaagtccagccagtagttctttgtcagctaccaaagaatatgtagttcgttagcgttggaccagacaagaaacgccaacgactacgtacccctaagttcgctactattttagtggtactacttcgtacggttcggggtcggtccccggggtcctacggtacccgtattcgacggcggacgaggtccggatcggtagggactagttctttaccacttccacaacctntacgagcacgcctgaccaagtacgtagaaagtgtggtagtacgttaagttttacttacgtacgtacacgtaactaattagttagtacgtaccgtccgtcggtccttacgttacggttacgggaccgggtaacggaacggtaagggtaagaacgtagtacgaaggaccggtaacgtggtacg

SEQ ID NO: 299959 - DNA, 590 bp, Homo sapiens
  misc_feature: GZ8MTXP02F61U7.38.23.C01.1.454.CMB.2.raw
  modified_base (417)..(417): a, c, t, g, unknown or other
  misc_feature (417)..(417): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagacctccctggctgtgtctcgtgggcgagacggccaccatcaactgcaagtccagccagtagttctttgtcagtctacaagaatatgtagttcgttagcttaggtaccagacaagaagccacgacacgtccctaagtcgctactatttagtcggtactacttcgttacgtcggggtacggttccccggggtcctggacctatcgacggcggcagggcggtatcggtgggactagtactttcactctcaccntcagcacgcctgactagactagaaagtgttggtacgtattagtttacgttacgtcgtacgagtaattaacgttagttacgttagggtaccgttccgtacggtccttacggtaccggttcggacggggtacgaaccgtaggtaacgacgacgtaacgagtacgtagtcggtacg

SEQ ID NO: 299960 - DNA, 550 bp, Homo sapiens
  misc_feature: GZ8MTXP02GYRRY.38.23.C01.1.454.CMB.2.raw
  modified_base (339)..(339): a, c, t, g, unknown or other
  misc_feature (339)..(339): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtgggggtccctgaagctctcctgtgcagcctctggattcatattagtaatcattggatgagttggtccgcaggctcgagggacgggctggagtgggtgccactanaaaccagatggaactagaaaaagctagtgtgggactctgtagaagggccgtattccaccgtctccagacgacaacgacaagaattcactagtatttagacaaatagaacagcctagagagtacgaagacacggaccatactaattatagtagtaaaagtatactattacgaataagtaggtacggcgtaacggtacgggtcggtacgttag

SEQ ID NO: 299961 - DNA, 556 bp, Homo sapiens
  misc_feature: GZ8MTXP02IGAOP.38.23.C01.1.454.CMB.2.raw
  modified_base (305)..(305): a, c, t, g, unknown or other
  misc_feature (305)..(305): n is a, c, g, or t
  modified_base (428)..(428): a, c, t, g, unknown or other
  misc_feature (428)..(428): n is a, c, g, or t
  modified_base (431)..(431): a, c, t, g, unknown or other
  misc_feature (431)..(431): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagacctccctggctgtgtctctgggcgaggagggccaccatcaactgcaagtccagccagagttcttttgtcagctacaagaatatgagttcgttagcttggtaccagcagaaagcacgacacgtcccctaagtnctctatttatgtcatctacgtcgggtcgtccccggggtcctgaccgtattcgacgcggcgacgcggtatcgtaggggacagtattccactctcacatcagccacgcctgacagactagaagtntgngtctaagtttatacgtgtacagtactaaattagttagtcgggttacgtccgtacgggtcttcgtacgtttcgggaccgggtagggaaccgtaagggtacggacgtacgtacgaacggacgtaacg

SEQ ID NO: 299962 - DNA, 564 bp, Homo sapiens
  misc_feature: GZ8MTXP02FW8RN.38.23.C01.1.454.CMB.2.raw
  modified_base (350)..(350): a, c, t, g, unknown or other
  misc_feature (350)..(350): n is a, c, g, or t
  modified_base (515)..(515): a, c, t, g, unknown or other
  misc_feature (515)..(515): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtgggggtccctgaagctctcctgtgcagccctctggattcatatttagaatcattggatgagttgggtccgccaggctccgaggggacgggctggagtgggtggccatataaaccncgatagaactagaaaagactatgtggactcgtagtgaaacgggtccgattccaccgtctacccgagagacaacgccaaagattacactagtatttagactaaatgaactagacctagacgagtacgaagacgacggaccataatagttattaggtagtaaaaagntactaattcgaataagttgggtaggacgtacggtacggggtggacttag

SEQ ID NO: 299963 - DNA, 633 bp, Homo sapiens
  misc_feature: GZ8MTXP02JPRMT.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggtaaacttggtccaggccgtggggggtccctgaagctctcctgtgcagcctctggattcattatttagtaatctagttggatgtaggttgggtcccgccgaggccgtccggagggggacggggtcgtggggtagggtggggtcggcccgaacgtaactaaaacccgacgagtaggaaccgtaaggaaaaaacgtactagtaggtgaactcgtagtacggaagggcccgtattccacccgtcctacccgagacgacgaaaccgaccaaagaacttacacttagttatttagactaaatagaacagctagagagtacgaagacgacggccaatatattagttagtaacggtaaaatatactaattacaaagttaagtagggtacggtacggtacggttaccggggtggtacgtttagg

SEQ ID NO: 299964 - DNA, 567 bp, Homo sapiens
  misc_feature: GZ8MTXP02JJHSV.38.23.C01.1.454.CMB.2.raw
  modified_base (266)..(266): a, c, t, g, unknown or other
  misc_feature (266)..(266): n is a, c, g, or t
  modified_base (305)..(305): a, c, t, g, unknown or other
  misc_feature (305)..(305): n is a, c, g, or t
  modified_base (527)..(527): a, c, t, g, unknown or other
  misc_feature (527)..(527): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttcctgttgctattttagaaggtgtccagtgtgaggtgcagttggtggaatcgtgggggaaacttggtccagccgtggggggtccctgaagctctcctgtgcagcctntggattcatatttagtaatcattggatgagttgggtccncgaggcctcgaggggacggggctgggaggtggggtggcccaagtactaaaccgacgatggaaactagaaaaagctaagtgtggacttcgtaggtgaaggggccgtaattccaccgtctcccgagacacaacgcaagaacttcactgtatttgactaaatagaacagacctagaagagtacggaacgacgaccggccaataagttattattagtagtaaaagntacattcgagtaagtggtagtcgacggtacgggtggctag

SEQ ID NO: 299965 - DNA, 563 bp, Homo sapiens
  misc_feature: GZ8MTXP02HPEHJ.38.23.C01.1.454.CMB.2.raw
  modified_base (307)..(307): a, c, t, g, unknown or other
  misc_feature (307)..(307): n is a, c, g, or t
  modified_base (438)..(438): a, c, t, g, unknown or other
  misc_feature (438)..(438): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactcctggctgtgtctcgtgggcgaggaggccaccatcaactgacaacgtccagccagagttcttttgtcagtctaccaagaatatgtagttcgttagcttggtaccagcaagaaagcacgacacgtaccctaagtgctntattatggtctatctacgtcggggttcgtcccggggtcctcgaccgattcgaggtcggcgaggccggtatcgtaggggactagtatttccactcctcaccctatcagccacgcctgacagactagaaagtnttcggtaggtcttagttttacttacgtgtacagtactaattattagtggtacgtcctggtcctacgtacggttcgggacggacggtaacgaggttcggaatacgtagaacgtcgtaagtgtacgg

SEQ ID NO: 299966 - DNA, 575 bp, Homo sapiens
  misc_feature: GZ8MTXP02JO6R5.38.23.C01.1.454.CMB.2.raw
  modified_base (303)..(303): a, c, t, g, unknown or other
  misc_feature (303)..(303): n is a, c, g, or t
  modified_base (339)..(339): a, c, t, g, unknown or other
  misc_feature (339)..(339): n is a, c, g, or t
  modified_base (346)..(346): a, c, t, g, unknown or other
  misc_feature (346)..(346): n is a, c, g, or t
  modified_base (509)..(509): a, c, t, g, unknown or other
  misc_feature (509)..(509): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttcctgttgctattttagaaggtgtccagtgtgaggtgcagttggtggaatcgtgggggaaacttggtccagccgtgggggtccctgaagctctcctgtgcagcctctggattcatattagtaatcattggatgagttgggtccncaggctccgagggacgggctggagtgggtgccatanaaaccgngacgtgaactagaaaagctatgtgactgtgtagagggcattcaccgtctaccgagacgacaacgcaaagtactcactgtactttgactaaattcgaactagccctagacgagtacgaagacgacggcctaagtacttacgttagttacgtaaggtaaaaagtnttacgtaacgtttaccgaattaagtcgggtacggtaccggtaaggtaccggggttgaccgtttagg

SEQ ID NO: 299967 - DNA, 608 bp, Homo sapiens
  misc_feature: GZ8MTXP02JZZ3P.38.23.C01.1.454.CMB.2.raw
  modified_base (385)..(385): a, c, t, g, unknown or other
  misc_feature (385)..(385): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtgggggtccctgagctctcctgtgcagcctctggattcatatttagaatcattggatgaggttgggtccgcaggctccgagggacggggctggagtgggtgcactataaaccagactaggaactagaaaaacgtactagtgtggacttcgngtgaagggccattccaccgtctaccgagacgacaaacgccaaagaacttcacttagtatttagactaaaatcgaaaacgcgaccgtagaacgaacggtacgaaacggacgaaccgggaccaattaaatactttaagttaggtaaacgttaaaaagactacgtaatttacgtaataaggttcggtacgggtacggtaacgggttaccggggttggactttacgg

SEQ ID NO: 299968 - DNA, 677 bp, Homo sapiens
  misc_feature: GZ8MTXP02F31HX.38.23.C01.1.454.CMB.2.raw
  modified_base (302)..(302): a, c, t, g, unknown or other
  misc_feature (302)..(302): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttcctgttgctattttagaaggtgtccagtgtgaggtgcagttggtggaatcgtgggggaaacttggtccagccgtgggggtccctgaagctctcctgtgcagcctctggattcatattagtaatcattggatgagttgggccncaggctcgaggggacggggctggagtgggtggccactaataaaccacgataggaactagaaaaagctagtgtggactcgtaggtaggaaacggggtccgtaagtttccacccggttcctacccgaaaggaacgaaaccgaaacccgaccaaacggtaaacttaccaacttaggttaacttttaggaacctaaaagttacgaaaacacgtaccgtagaaaggtacggtaacggaaacgaaccgaaccgggtacctaaagttaattaactttaagttaggttaaacggtaaaaaggtaacttacctaaagtttacgtaaagtaaggttacgggtagggtacgggtaacgggtttaccggggtaggggtacttaacgg

SEQ ID NO: 299969 - DNA, 556 bp, Homo sapiens
  misc_feature: GZ8MTXP02GNGJG.38.23.C01.1.454.CMB.2.raw
  modified_base (287)..(287): a, c, t, g, unknown or other
  misc_feature (287)..(287): n is a, c, g, or t
  modified_base (300)..(300): a, c, t, g, unknown or other
  misc_feature (300)..(300): n is a, c, g, or t
  modified_base (303)..(303): a, c, t, g, unknown or other
  misc_feature (303)..(303): n is a, c, g, or t
  modified_base (308)..(308): a, c, t, g, unknown or other
  misc_feature (308)..(308): n is a, c, g, or t
  modified_base (367)..(367): a, c, t, g, unknown or other
  misc_feature (367)..(367): n is a, c, g, or t
  modified_base (385)..(385): a, c, t, g, unknown or other
  misc_feature (385)..(385): n is a, c, g, or t
  modified_base (443)..(443): a, c, t, g, unknown or other
  misc_feature (443)..(443): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctcgtgggcgagacgggccaccatcaactgacaagtccagccagagttctttgtcagctacaagaatatgagttcgtagcttggaccagacaagaaagcaacganacgtccctaagtnctnatttntgcatctacgtcggggtgtccgggtccagaccgatcgagcgcagcggtatcgagggacngtacttcactctacaccntacagcagccctgacaagactagaaagtgtggtacggattaggtttatacgtacgtanagtataattagttagtcggttactcgtacgtccttacgttcggtacgggaacgggaaccgggtaacgtaagggtaacggaagtacgtacggaacgtacggtacggtggtaccg

SEQ ID NO: 299970 - DNA, 560 bp, Homo sapiens
  misc_feature: GZ8MTXP02HYCAO.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggtttccttgttgctattttagaaggtgtccagtgtgaggtgcagttggtggaatcgtgggggaaacttggtccagcctgggggtccctgaagctctcctgtgcagcctctggattcattatttagaatcattggatgagttggtccgccaggctccgaggggacgggctggagtggggtggccactaataaaccacgataggaaactgaaaaagctatgtggactcgtgtggacgggggtcgatttccgaccgtctccgagacgacaacgacaaagtaacttcacgtgtaatttgactaaatgaacagcctagagagtacgaagacgacggacatataattattagtagtaaaaagctactacttacgataagtggtacggacgtacggtacggtcggtactacg

SEQ ID NO: 299971 - DNA, 569 bp, Homo sapiens
  misc_feature: GZ8MTXP02JHA5A.38.23.C01.1.454.CMB.2.raw
  modified_base (371)..(371): a, c, t, g, unknown or other
  misc_feature (371)..(371): n is a, c, g, or t
  modified_base (396)..(396): a, c, t, g, unknown or other
  misc_feature (396)..(396): n is a, c, g, or t
  modified_base (400)..(400): a, c, t, g, unknown or other
  misc_feature (400)..(400): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagacctccctggctgtgtctcgtgggcgagagggccaccatcaactgcaagtccagccagagttctttgtcagctacaagaatatgagttcgtagcgttaggaccagcaagaaacgcaacgacacgtccctaagttgctactatttagtgtacattctacgtcgggtcgtccggggtcctgaccgtatcaggcgacaggcgatcgngggacagtactttcactctacaccntacngcagcctgacagactagaagtagtggtacggtacttagtttactaacgtgtacagtactaaatgttaagtggtacttccgtacggtcttaacggtaccgtttcggggacggtaacgggtaaccgtaaagggggtgaacgtacgtacggaacgtacggtaacgtggtcgg

SEQ ID NO: 299972 - DNA, 724 bp, Homo sapiens
  misc_feature: GZ8MTXP02FOOGC.38.23.C01.1.454.CMB.2.raw
  modified_base (312)..(312): a, c, t, g, unknown or other
  misc_feature (312)..(312): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcttgggttttccttgttgctattttagaaggtgtccagtgtgaggtgcaggttggtggaatcgtagggggaaacttggtccaggccgtggggggtccctggaacgctctccgtgtgcagcctctggattctatattagtatcattggatgagttcggtccncgaggctcggagggacgggctgggaggtgggtacggaccctaacgtaaacgtaaaaccgacggtaagtacgggtaaaacctaaggaaaaaacgtcttaaagtggtacgggactcgttaggtacggaacgggtccgtacttaccgaccgttcgtaccaaggaacaacaaccgaccaaagtaacttaccgattagttatttacgaactaaagtacggaaactacgacctaggaaaccgagtaaccggaaagaccgaaccggaacctaaattaacttaaaacgtttacgtttaaaggttaaaacggttaaaaaagtaccgttaacttaaacggttacttaaaaggttaacggtttaggggttaacgggaacccgggttaggggttaaaacccggggttgggaccttttaaacggg

SEQ ID NO: 299973 - DNA, 514 bp, Homo sapiens
  misc_feature: GZ8MTXP02GDK83.38.23.C01.1.454.CMB.2.raw
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctctgggcgagaggccaccatcaactgcaagtccagccagagtcttttgtcagctccaagaatatgagtcgtagctggtaccagcagaaagcacgacagtccccaagttgctcatttatggtcatctatcgggtgtccccgggtccctgaccgtattcagcgcgagcgatcgtgggacagattcactctcacatcagcagcctgcagactgaaagtatgtgacgtagtttaattactgtctagacaaatattaatcgttacgtcctcggtctctacgtttcggcggtaacggaaccgaaaggtggaacgagtacgaacgcgtaaacg

SEQ ID NO: 299974 - DNA, 825 bp, Homo sapiens
  misc_feature: GZ8MTXP02HHT79.38.23.C01.1.454.CMB.2.raw
  modified_base (264)..(264): a, c, t, g, unknown or other
  misc_feature (264)..(264): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcttgggttttccttgttgcttattttagaaggtgtccagtgtgaggtgcgagttggtggaatcgtagggggaaacttggtccagccgtgggggtccctgagctctcctgtgcngctctggattcattattagtaatctattggatgaggttcgggtccgccgaggtccgtccggaggggacggggtcgtggggtacgggttggggtccggaccctaaacgttaacgtaaaaccccgtagaacgtaacggaaaaccgtaagaaaaaagtcttaagtggtcggtaacttcgtggtaggaacggggtccgtaattcccgacccgtctacccgagaacgaacccgaaacgacccgtaaacgtaacttacctaacgttacgtttaagtttacgaaaccgttaaaagttacgaaaaccgtacggtaccccgttaaggaaacggtaacggttaaccggaaaacggaacccggaaacccgggtaacccgttaaaatttaaaacggttttaaaactttttaaacggtttttaaacgggtttaaaaacgtttaaaaaaaccgggtagtttaaaaccttaaaggttttacccggttaaaagttaaggggtttaagggggttccggggtacccggggttaaaccgggggtttaacccgggggtagggtttaacccgtttttaaggg

SEQ ID NO: 299975 - DNA, 590 bp, Homo sapiens
  misc_feature: GZ8MTXP02JI781.38.23.C01.1.454.CMB.2.raw
  modified_base (359)..(359): a, c, t, g, unknown or other
  misc_feature (359)..(359): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgacaagtccagccagagttctttgtcagctacaagatatgagttcgtagcttggtaccagcagaagcacgacacgtacccctaagttcgctactatttagtggtctatctacgtcggggtcgtcccccggggtccctagaccgtnttcgacggcgcgagcggtatcgtgggacagtacttcactctacactatcgagcacgtcctacgacagacgtagaagtagtgtacggtacttagttttatacgtagtactagtagtaaattagttaagtacggttacgttccgttacggtccttacgttaccggtttaccgggacgggtaacggggaacccgtaaaggggtacggaccgtagtaccggaaaggacgtaacgg

SEQ ID NO: 299976 - DNA, 620 bp, Homo sapiens
  misc_feature: GZ8MTXP02HHRSO.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaggtgtccagtgtgaggtgcagttggtggaatcgtagggggaaacttggtccaggccgtgggggtccctgaagctctcctgtgcagcctctggattcattatttagtaatcattggatgagtttgggtccgcgaggctccgaggggacggggctgggaggtggggtggcccaacgtataaaacccgacgatagggaaacctaggaaaaagactaagttggtgggtaaccttcgtggtagggaaacggggccgtaaagttccgaacccgttctacccgagacgaacaacgccaaagattacactagtatttagactaaatgaaacagcctagacgagtacgaagaccgacggccaaattagtaatttagttagtaagtaaaagtactatacgttagaattaaggtggtacggaccggtaacggttaccggggtaggacgtttag

SEQ ID NO: 299977 - DNA, 578 bp, Homo sapiens
  misc_feature: GZ8MTXP02IEJGO.38.23.C01.1.454.CMB.2.raw
  modified_base (306)..(306): a, c, t, g, unknown or other
  misc_feature (306)..(306): n is a, c, g, or t
  modified_base (356)..(356): a, c, t, g, unknown or other
  misc_feature (356)..(356): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagacctccctggctgtgtctcgtgggcgagagggccaccatcaactgcaagtccagccagagtcttttgtcagctacaagatatgagttcgttagcttggtaccagcaagaaagcacgacacgtacccctaagtcnctctatttatgtcactctacgtcgggtcgtccccggggtccctgaccgtntcgacggcggcgacggcggattcgtggggactaggtactttaccacttcctaccacctactcgacgcacgtcctgacacgacgtagaaacgtgtgggtacggtaccttaagttttacttacgtcgttacgaagtactaaattagttagtacggttactccgtcggtacttcgtacgttcgggcggtacggaacgtagggtacgagacgtacgaacgcgtaag

SEQ ID NO: 299978 - DNA, 576 bp, Homo sapiens
  misc_feature: GZ8MTXP02GSSL7.38.23.C01.1.454.CMB.2.raw
  modified_base (308)..(308): a, c, t, g, unknown or other
  misc_feature (308)..(308): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgcttattttagaaggtgtccagtgtgaggtgcagttggtggaatcgtgggggaaacttggtccaggccgtggggggtccctgaagctctcctgtgcagcctctggattcattattagtaatcattggatgagttgggtccncgaggctcgaggggacgggcgtgggaggtggggtgccgaactaataaaccgacgagtaggaaactaagaaaaagactatgtggactgtaggtgaacggggcctaatccgaaccgtctacccgagacgaacaaacgacaaagaatcactgtattagacaaatgaacagcctagagtagtacgaagacgacgacaataagtattagttagtaagtaaatactatagttagtaataagtaggtaggacgtacgggtacggtcggacttagg

SEQ ID NO: 299979 - DNA, 571 bp, Homo sapiens
  misc_feature: GZ8MTXP02FMTKZ.38.23.C01.1.454.CMB.2.raw
  modified_base (349)..(349): a, c, t, g, unknown or other
  misc_feature (349)..(349): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtggggggtccctgaagctctcctgtgcagcctctggattcatattagtaatcattggatgaggttgggtccgccaggcctccgaggggacggggctggagtggggtggccactanaaaccagactggaactagaaaaagactatgtggactctaggtagaaggggccattcaccgtctaccagagacaacgcaagattcactagtatttagacaaatagaacagcctagacgtagtacgaaagaccgacggaccaatataatttagttagttagtaaaagtactacgtaacttgtaataagtaggttacggacggtacggtacggggtaggactaag

SEQ ID NO: 299980 - DNA, 546 bp, Homo sapiens
  misc_feature: GZ8MTXP02J2P11.38.23.C01.1.454.CMB.2.raw
  modified_base (183)..(183): a, c, t, g, unknown or other
  misc_feature (183)..(183): n is a, c, g, or t
  modified_base (307)..(307): a, c, t, g, unknown or other
  misc_feature (307)..(307): n is a, c, g, or t
  modified_base (505)..(505): a, c, t, g, unknown or other
  misc_feature (505)..(505): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtntccagtgtgaggtgcagttggtggaatcgtgggggaaacttggtccagccgtggggggtccctgaagctctcctgtgcagccctctggattcatatttagtaatcattggatgagttgggtccncaggctcgaggggacggggctggagtggggtggccaactaataaaccgacgataggaactagaaaaagctatgtggactctggtgaaagggcctaattcaccgtctcagagacaacgccaaagaattacactagtatttgacaaatagaacagcctagagagtacgaagacacggaccatatattatagtagtaaaanatacattgataagtggtacggacgacggtacggtggactag

SEQ ID NO: 299981 - DNA, 603 bp, Homo sapiens
  misc_feature: GZ8MTXP02JT0MA.38.23.C01.1.454.CMB.2.raw
  modified_base (382)..(382): a, c, t, g, unknown or other
  misc_feature (382)..(382): n is a, c, g, or t
  modified_base (395)..(395): a, c, t, g, unknown or other
  misc_feature (395)..(395): n is a, c, g, or t
  modified_base (413)..(413): a, c, t, g, unknown or other
  misc_feature (413)..(413): n is a, c, g, or t
  modified_base (417)..(417): a, c, t, g, unknown or other
  misc_feature (417)..(417): n is a, c, g, or t
  modified_base (430)..(430): a, c, t, g, unknown or other
  misc_feature (430)..(430): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagacctccctggctgtgtctcgtgggcgagacgggccaccatcaactgacaagtccagccagagttcttttgtcagtctaccaaagaatatgtagttcgtagcttggtaccagacaagaagcacgacacgtacccctaagttcgcttactatttagtcggtcattcgtacgtcggggttcggtcccggggtcctcggaccgtattcgacggcggacnggcggtactcggnggacagtactttcactcncacntacagcacgtccngacagacgtagaaagtgttacggtaggtacttagtttacttacgtagttacaagtacctaaagttagtttacgtagggtacgttcccgtcgtaccgttcgtacggttcgggacgggtaccgggtacgtaggggtcggtaacgtacgtaccgaaggacttaacggtcggtacgg

SEQ ID NO: 299982 - DNA, 674 bp, Homo sapiens
  misc_feature: GZ8MTXP02H7MNY.38.23.C01.1.454.CMB.2.raw
  modified_base (305)..(305): a, c, t, g, unknown or other
  misc_feature (305)..(305): n is a, c, g, or t
  modified_base (308)..(308): a, c, t, g, unknown or other
  misc_feature (308)..(308): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgagtgcagttggtggaatcgtgggggtaaacttggtccaggccgtggggggtccctgaagctctcctgtgcagcctctggattcattattagtaatcattggatgagttggccncgnggctcgaggggcgggctggaggtgggtgaccactaataaaccgacgaagtaggaaacgtagaaaaacgtacttaagtggtggaacttcgtaggtaggaaacggggcccgtattacccgacccgttccaccgacgaacgaacccaaaccgacccgtaaaagaactttaccacgtttagttaagtttacgaactaaaagttacggaaactacggtaccgttaggaacgacggtaacgaaaacggaccgaaaccggacctaaattaaatttactttaaagtttaggtaaagtaaaaacgtattaaccgtaagttacgtaattaagtcgggtagggtaccggtaacgggttacggggagggtactttagg

SEQ ID NO: 299983 - DNA, 608 bp, Homo sapiens
  misc_feature: GZ8MTXP02IYLF8.38.23.C01.1.454.CMB.2.raw
  modified_base (557)..(557): a, c, t, g, unknown or other
  misc_feature (557)..(557): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtgggggtccctgaagctctcctgtgcagcctctggattcattatttagtaatcattggatgagttgggtccgcaggctccgaggggacggggctgggagtggggtcggacccaataactaaaccgacgagtaggaaacctagaaaaagctagtgtaggctctggtagaacggggccgtattaccgacccgtctacccaagacgaaccaacggtaccaaagtaacttacacttgtatttagactaaaatacgaaacacgaccgtagaaggacgtagaaacgacccgaacggacctaagtaattaattagttagtaaagtaaaanacttcaattcgtaataagtgggtcggtacgtacgggtacggagtacgttag

SEQ ID NO: 299984 - DNA, 552 bp, Homo sapiens
  misc_feature: GZ8MTXP02HRXI4.38.23.C01.1.454.CMB.2.raw
  modified_base (446)..(446): a, c, t, g, unknown or other
  misc_feature (446)..(446): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctctgggcgagaggccaccatcaactgcaagtccagccagagtcttttgtcagctaccaagaatatgagttcgttagcttggtaccagcaagaaagcacgacacgtcccctaagttgctactatttatggtcatctacgtcggggtcgtcccggggtcctcgaccgtattcgacggtcgcgagcggtatcgtgggacctagtactttcactctcacatcagctagcctgacagactagagtatgtgtactagtttatactgtanagtactaattagttagtgtacgtcgtcgtactcgttacggttcggcggtaacggaacccgtaagggtaacgaagtacgtacgaaaggtcgtaaacgtggtaacggg

SEQ ID NO: 299985 - DNA, 544 bp, Homo sapiens
  misc_feature: GZ8MTXP02FJDBS.38.23.C01.1.454.CMB.2.raw
  modified_base (537)..(537): a, c, t, g, unknown or other
  misc_feature (537)..(537): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttcctgttgctattttagaaggtgtccagtgtgaggtgcagttggtggaatcgtgggggaaacttggtccagccgtggggggtccctgaagctctcctgtgcagcctctggattcatatttagaatcattggatgagttgggtccgccaggctcgagggacggggctggagtgggtgccactataaaccacgatggaactagaaaaagctatgtggactctgtagaagggccattcaccgtctccgagacgacaacgccaaagaattcactagtatttagacaaatcgaaacagcctagagagtacgaagacacggcctatatattatgtaagtaaaagctactatcgaataagtgggtacggacggtacggtacgggngacttag

SEQ ID NO: 299986 - DNA, 547 bp, Homo sapiens
  misc_feature: GZ8MTXP02IRHKD.38.23.C01.1.454.CMB.2.raw
  modified_base (344)..(344): a, c, t, g, unknown or other
  misc_feature (344)..(344): n is a, c, g, or t
  modified_base (402)..(402): a, c, t, g, unknown or other
  misc_feature (402)..(402): n is a, c, g, or t
  modified_base (445)..(445): a, c, t, g, unknown or other
  misc_feature (445)..(445): n is a, c, g, or t
  modified_base (502)..(502): a, c, t, g, unknown or other
  misc_feature (502)..(502): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggtttcctgttgctattttagaaggtgtcagtgtgaggtgcagttggtggaatcgtgggggaaacttggtccagccgtggggggtccctgagctctcctgtgcagcctctggattcattatttagtaatcattggatgagttgggtccgcaggctccgaggggacggggctgggagtgggtggccactanaaaccacgatggaactagaaaaagctatgtggatctgtagaagggccattcaccgtcncagagacaacgccaagaattcactgtatttgacaaatcgaaancgactagagaagtacgaagaaccgacggaccaatattaattattagtataaaaagtntactattacgattaagtggtcgacggaggtacgggtcggattacg

SEQ ID NO: 299987 - DNA, 533 bp, Homo sapiens
  misc_feature: GZ8MTXP02F96J9.38.23.C01.1.454.CMB.2.raw
  modified_base (500)..(500): a, c, t, g, unknown or other
  misc_feature (500)..(500): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagagttctttgtcagctccaagaatatgagttcgtagcttggtaccagcaagaaagcacgacacgtcccctaagtgctctatttatgtcatctacgtcgggtgtcccgggtcctgaccgtatcagcgcagcgatcgtgggacagtatttcactctcaccatcagcagccctagcagactagaaagtatgtaggtactagttttattaccgtgtacagtactaaattattagtggtactcgtcggcttcgtacgtttcgggcggtaacggaccgtaaggnggatacgtacgaaggtaccgaacgttggtacgg

SEQ ID NO: 299988 - DNA, 534 bp, Homo sapiens
  misc_feature: GZ8MTXP02GFGI0.38.23.C01.1.454.CMB.2.raw
  modified_base (415)..(415): a, c, t, g, unknown or other
  misc_feature (415)..(415): n is a, c, g, or t
  modified_base (443)..(443): a, c, t, g, unknown or other
  misc_feature (443)..(443): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctctgggcagagggccaccatcaactgcaagtccagccagagtctttgtcagctccaagatatgagttcgtagcttggtaccagcagaaagcaacgacacgtcccctaaagttcgactctatttatggtactatctacgtcgggtgtccccggggtcctgaccgatcagcgcagcgatcgtgggacagactttcactctcacatcagcagcctgacagactaggaaanatgtggactagtttatactgtacagtanaatattaagtggtacgtccgtcggtcttacgtacgtttacggcggaacgggaaccaaggtcgtagggaacaaaccgaaaacgaacgttcgg

SEQ ID NO: 299989 - DNA, 592 bp, Homo sapiens
  misc_feature: GZ8MTXP02JSZC1.38.23.C01.1.454.CMB.2.raw
  modified_base (307)..(307): a, c, t, g, unknown or other
  misc_feature (307)..(307): n is a, c, g, or t
  modified_base (349)..(349): a, c, t, g, unknown or other
  misc_feature (349)..(349): n is a, c, g, or t
  modified_base (373)..(373): a, c, t, g, unknown or other
  misc_feature (373)..(373): n is a, c, g, or t
  modified_base (467)..(467): a, c, t, g, unknown or other
  misc_feature (467)..(467): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcttgggttttccttgttgctattttagaaggtgtccagtgtgaggtgcgagttggtggaatcgtgggggaaacttggtccagccgtgggggtccctgagctctcctgtgcacgcctctggattcattattagtaatcattggatgagttgggtccncgaggctcgagggacgggctggagtgggtgccatataaaccngagtggaaactagaaaaagctagngtgggactgtgtaggaagggccgtaattccgacccgtctaccgagacgacaaacgacccaaagaacttcactagttattagactaaatgaaacngcctagagagtacggaaagcgacggactataattacgttatttagtaagtaaaagtactacgtaactttacgaagttaaggtcgggtagggtaccggtacgggttaccggggtggtacctttagg

SEQ ID NO: 299990 - DNA, 571 bp, Homo sapiens
  misc_feature: GZ8MTXP02GUVQ6.38.23.C01.1.454.CMB.2.raw
  modified_base (305)..(305): a, c, t, g, unknown or other
  misc_feature (305)..(305): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggtaaacttggtccagccgtgggggtccctgaagctctcctgtgcagcctctggattcatatttagaatcattggatgagttgggtccncaggctccgaggggcggggctggagtggggtggcccatataaacccacgataggaactagaaaaagctatgtggactcgtgtagaagggccgaatttccaacccgtctacccgagaacgacaaacgcccaaagaacttcacttgtatttgacaaatgaacagacctagaagagtacgaaagacacggacctataatattagttgtaagtaaaacattactaattcgaataagtcgggtaggtacggtacggtacggggtgagttag

SEQ ID NO: 299991 - DNA, 665 bp, Homo sapiens
  misc_feature: GZ8MTXP02GW3DA.38.23.C01.1.454.CMB.2.raw
  modified_base (305)..(305): a, c, t, g, unknown or other
  misc_feature (305)..(305): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctggttttccttgttgctattttagaaggtgtcagtgtgaggtgcagttggtggaatcgtagggggaaacttggtccagccgtgggggtccctgaagctctcctgtgcagcctctggtattcattattagtaatcattggatgtagttggtccncgaggctcggagggacggggcgtgggaggtggggtacgaccaaactaaacaaaaccgacgaacgtaggaaaacctaaggaaaaaacgtacttaagtcggtaggaaccttcggtaggtacggaaacggggcctaaacgtttccgtacccgtacctacccgaaagaaaccggaaacccaaaaccggaacccaaaacgtaaacttaccgaacttagttaatttacgaaactaaagtacgaaacacgactagaacgaagtacgaaagaccgacggacctaataagttaattattagtaaagtaaaagtatactaatacgtaattaaggtaggtacggacggtaacggtacgggtagtacgttag

SEQ ID NO: 299992 - DNA, 565 bp, Homo sapiens
  misc_feature: GZ8MTXP02H5FPH.38.23.C01.1.454.CMB.2.raw
  modified_base (335)..(335): a, c, t, g, unknown or other
  misc_feature (335)..(335): n is a, c, g, or t
  modified_base (408)..(408): a, c, t, g, unknown or other
  misc_feature (408)..(408): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgcttattttagaaggtgtccagtgtgagtgcagttggtggaatcgtgggggaaacttggtccaggccgtggggggtccctggaagctctcctgtgcagcctctggattcattattagtaatcatggatgagttggtccgcgaggctcgagggcgggcgtggagtgggngcactaataaaccacgatagaactagaaaagtactagtgtgactcgtggtagaagggccgattcacccgttcncagagaacaacgacaaagattcactagttacttagactaaatagtaaacagacctaggagaagtacgaaagacaccggacagtaattattaagtttgtaaagtaaaagactactacttagaatgtaggacggtcggacggttacgggtaggacttag

SEQ ID NO: 299993 - DNA, 559 bp, Homo sapiens
  misc_feature: GZ8MTXP02JV50L.38.23.C01.1.454.CMB.2.raw
  modified_base (352)..(352): a, c, t, g, unknown or other
  misc_feature (352)..(352): n is a, c, g, or t
  modified_base (399)..(399): a, c, t, g, unknown or other
  misc_feature (399)..(399): n is a, c, g, or t
  modified_base (403)..(403): a, c, t, g, unknown or other
  misc_feature (403)..(403): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctctgggcgagacgggccaccatcaactgcaagtccagccagagtcttttgtcagctcaaagaatatgagttcgttagctttggaccagcaagaaagcaacgacacgtccctaagttcgctctaatttattggtcatctacgtcggggtcgtccccggggtcccngacccgtattcagcggcagcggatcgtgggacagtactttcacttcncacntcagcagcctgcaagactgaaagatgtggacttaagtttatactggtacagcaagttattaatagtacgtcctacgtagttaccgtttcgggggacccgggggtaacaaccggtcgtaggggaaactactaaaacgaaaaccgtaactgggtaccg

SEQ ID NO: 299994 - DNA, 674 bp, Homo sapiens
  misc_feature: GZ8MTXP02FXJ8V.38.23.C01.1.454.CMB.2.raw
  modified_base (520)..(520): a, c, t, g, unknown or other
  misc_feature (520)..(520): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtgggggtccctgaagctctcctgtgcagcctctggattcattattagtaatcattggatgtaggttgggtccgcgaggctccgaggggacggggctgggagggtggggtcggaccctacgtaataaaacccgacggaatacgggaaaactaaggaaaaaacggtctaagtggtcggtaactcgttaggtagaacggggtcccgtattaccgacccgtctacccgaagacgaacgaacgacccaagtaaacttcacttagtactttagaactaaaatacggaaaacncgtaccgtagaacggtaacggtaacggaaacgacgaacccggactaaattaattaaagtttagttaagttaagtaaaaaagttacttactaacgttagtaagttaaggttacgggtacggtaccgggtacggggtacggggtacgtacgtttag

SEQ ID NO: 299995 - DNA, 555 bp, Homo sapiens
  misc_feature: GZ8MTXP02FGBVF.38.23.C01.1.454.CMB.2.raw
  modified_base (421)..(421): a, c, t, g, unknown or other
  misc_feature (421)..(421): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctcgtgggcgagagggccaccatcaactgcaagtccagccagagttcttttgtcagtctacaagaatatgagttcgtagcttggaccagcagaaagcacgacacgtccctaagttgctctatttagttgtcatctacgtcggggtgtcccggggtcctcggaccgtattcgacgcggcaggcgatcgtgggacagtactttcactctacaccatcagcacgccctgacagactgaaagntggtgtactaagtttatacgtgtacagtactaattagtagttcggtacgtaccgtcggcttcgtacgtttcggggacggtaacgggaaccgtaaggggtgaacgtacgtacgaaacggacgtaacgtggtacgg

SEQ ID NO: 299996 - DNA, 587 bp, Homo sapiens
  misc_feature: GZ8MTXP02F1K5G.38.23.C01.1.454.CMB.2.raw
  modified_base (526)..(526): a, c, t, g, unknown or other
  misc_feature (526)..(526): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtgggggtccctgaagctctcctgtgcagcctctggattcatatttagaatcattgatgagtgggtccgcaggctcgagggcgggctggagtggtggccactataaaccacgatagggaactagaaaaagtctaagtgtgggactcgtagtagaagggccgattccaccgtctacccagacgacaacgaccaagtaacttacactagtatttagacaaaattggaaacagtacccgtagaagtacgtacgaagaacgacggaacctataattaagttattaggttataaaagntacgtaaacgttgaaagttaagtaggttacggacggtacggttacggggaggtactttagg

SEQ ID NO: 299997 - DNA, 552 bp, Homo sapiens
  misc_feature: GZ8MTXP02GZDIZ.38.23.C01.1.454.CMB.2.raw
  modified_base (261)..(261): a, c, t, g, unknown or other
  misc_feature (261)..(261): n is a, c, g, or t
  modified_base (277)..(277): a, c, t, g, unknown or other
  misc_feature (277)..(277): n is a, c, g, or t
  modified_base (321)..(321): a, c, t, g, unknown or other
  misc_feature (321)..(321): n is a, c, g, or t
  modified_base (375)..(375): a, c, t, g, unknown or other
  misc_feature (375)..(375): n is a, c, g, or t
  modified_base (389)..(389): a, c, t, g, unknown or other
  misc_feature (389)..(389): n is a, c, g, or t
  modified_base (417)..(417): a, c, t, g, unknown or other
  misc_feature (417)..(417): n is a, c, g, or t
  modified_base (450)..(450): a, c, t, g, unknown or other
  misc_feature (450)..(450): n is a, c, g, or t
  modified_base (452)..(452): a, c, t, g, unknown or other
  misc_feature (452)..(452): n is a, c, g, or t
  modified_base (454)..(454): a, c, t, g, unknown or other
  misc_feature (454)..(454): n is a, c, g, or t
  modified_base (456)..(456): a, c, t, g, unknown or other
  misc_feature (456)..(456): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcgtggtttcgtgtagctatttagaaggtgtcagtgtgaggtgcagttggtggaatcgtagggggaaacttggtccagccgtgggggtccctgagctctctgtgcagcctntgatcatattagaatntatggatgtaggttcggccgcgaggccaccggaggggaccgggngtgggaggtgggtcgacctataaacgaaaccgagagtaggaactaagaaaaagntagttagcgaactntgagaagggcacttcgaccgttcacganagacaacgtacaagtatcatgtatagactaaananananacagagagagacgacgacgacatatatagtagtaagtaaataactactatagtagtaagtaggtacggtacggtacggtacggtacggtacgtacg

SEQ ID NO: 299998 - DNA, 570 bp, Homo sapiens
  misc_feature: GZ8MTXP02FO3P8.38.23.C01.1.454.CMB.2.raw
tcagtcgatcacgtcacgaccggtgctcgatttagtacacgtgattagggattgggggacaacaggcaggcaggggcagcaagatggtgttgcagacccaggtcttcatttctctgttgctctggatctctggagcctacggggacatcgtgatgacccagtctccagactccctggctgtgtctcgtgggcgagagggccaccatcaactgacaagtccagccagtagttcttttgtcagctaccaagaatatgtagttcgttagcttaggtaccagacaagaaagcaacgacacgtacccctaagttcgctactatttagtggtactacttcgttacgtcggggtcgtccccggggtcctacggaccgtacttcgacggtcggacagcggatcgtaggggacagtactttcactctacacatcagctacgcctgacagactgaaagtgtaggtcggacttagtttatactgtacagtataaatattagtgtacgtccgtcggcttacgtacgttcgggacggtaacggaccgaagggtaagagaagtacgaagacgtaacgtggtacg

SEQ ID NO: 299999 - DNA, 539 bp, Homo sapiens
  misc_feature: GZ8MTXP02FEQ2F.38.23.C01.1.454.CMB.2.raw
  modified_base (307)..(307): a, c, t, g, unknown or other
  misc_feature (307)..(307): n is a, c, g, or t
  modified_base (382)..(382): a, c, t, g, unknown or other
  misc_feature (382)..(382): n is a, c, g, or t
  modified_base (459)..(459): a, c, t, g, unknown or other
  misc_feature (459)..(459): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtggggggaaacttggtccagccgtggggggtccctgaagctctcctgtgcagccctctggattcatatttagaatcattggatgagttgggtccncaggctcgagggcggggctgggagtggggtggccactataaaacccacgatggggaaactagaaaaaagactaanggtggactctgtagaagggcgattcaacccgtctccagagacaacgccaaagaatcactgtatttgacaaatgaaanagacctgagagtcgaaagacacggcatatatatgtataaaagatacattgataagtggtaggcgacgtacgggtgactag

SEQ ID NO: 300000 - DNA, 626 bp, Homo sapiens
  misc_feature: GZ8MTXP02GHAUI.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctatttagaaggtgtccagtgtgaggtgcagttggtggaatcgtagggggaaacttggtccagccgtgggggtccctgaagctctcctgtgcacgcctctggattcattatttagtaatctattggatgtaggttcgggtccgccgaggcctccggaggggaccggggcgtgggagggtcggggtcggacctaacgtaactaaaacccgacgaacgtaggaaacctaagaaaaacgtacgtaatggtcggactcgtaggtaggaacggggctacgttcccgaccgtctacccgagaacgacgaaaccgaccaaagtaacttcacttagtatttagactaaatagacagaccgtagaagagtacgaacgacacggactagtaattattagttagtaacgtaaaagtactactattacgtataagtggttacggacgtagggtaaccggtggacgtttag

SEQ ID NO: 300001 - DNA, 788 bp, Homo sapiens
  misc_feature: GZ8MTXP02GYP2K.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcttgggttttccttgttgctattttagaaggtgtcagtgtgaggtgcagttggtggaatcgtgggggaaacttggtccagccgtgggggtccctgaagctctcctgtgcagcctcgtggattcattatttagtaatcattggatgtaggtttgggtccgccgaggctccgaggggacggggcgtggaggtcggggtggacccaactaataaaccgacgaagtaggaaactaagaaaaaagtacttaagttaggtgggaacttcgttaggtagaacgggggcccgtactttacccgaacccgttctacccgaaggaacgaaaccgaaaaccgaccgtaaaacgaactttaccgtaacttacgtttaagttttacggaacctaaaaagtttacggaaaaccgtacggtacccgttaggaaacggtaacgttaccgggaaaaggaaaccccgaaaccggggtaaccctaaaagtttaaaacgtttaaactttttaaagtttaaagggtttaaaacggtttaaaaaaaccggttaatttaaccttaaacgttttagtaaaacgtttaaggttagggggtaaccgggttaccggggtaacggggtttaaacccgggggttgggtaacccgtttttaaacggg

SEQ ID NO: 300002 - DNA, 570 bp, Homo sapiens
  misc_feature: GZ8MTXP02JHMF0.38.23.C01.1.454.CMB.2.raw
  modified_base (297)..(297): a, c, t, g, unknown or other
  misc_feature (297)..(297): n is a, c, g, or t
  modified_base (380)..(380): a, c, t, g, unknown or other
  misc_feature (380)..(380): n is a, c, g, or t
  modified_base (521)..(521): a, c, t, g, unknown or other
  misc_feature (521)..(521): n is a, c, g, or t
  modified_base (529)..(529): a, c, t, g, unknown or other
  misc_feature (529)..(529): n is a, c, g, or t
  modified_base (541)..(541): a, c, t, g, unknown or other
  misc_feature (541)..(541): n is a, c, g, or t
  modified_base (547)..(547): a, c, t, g, unknown or other
  misc_feature (547)..(547): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcgtggtttcctgttgctatttagaaggtgtccagtgtgaggtgcagttggtggaatctgggggaaacttggtccagccgtgggggtcctgagctctcctgtgcagcctctggattcatattagaatcattggatgagttgggtccncgaggctccgagggcgggcgtggaggtgggtggccactaactaaaaccgacgtacgtaggaaacctagaaaaaagtccgtaangtgggaacttcgtaggtacggaaagggggcccaaatttcccaccgtacctcccgaagacgaacgaaccgacccaaagaattcccaatgttatttaggaacaaatagaacagtccgagaagtagacgagacacggacatatnttatgtanaaagtatcattnataagngtacgacggacgtacggtcgatg

SEQ ID NO: 300003 - DNA, 556 bp, Homo sapiens
  misc_feature: GZ8MTXP02GZ0D6.38.23.C01.1.454.CMB.2.raw
  modified_base (352)..(352): a, c, t, g, unknown or other
  misc_feature (352)..(352): n is a, c, g, or t
  modified_base (376)..(376): a, c, t, g, unknown or other
  misc_feature (376)..(376): n is a, c, g, or t
  modified_base (384)..(384): a, c, t, g, unknown or other
  misc_feature (384)..(384): n is a, c, g, or t
  modified_base (404)..(404): a, c, t, g, unknown or other
  misc_feature (404)..(404): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtgggggtccctgaagctctcctgtgcagcctctggattcattattagtaatcattggatgagttggtccgccgaggctccgaggggcgggcgtggaggtgggtgccaactataaaccncgagtaggaactagaaaagctagngtggactntgtagagggcatccaccgtntaccagagacaacgacaaagatcatgtatttagactaaatagaacagacctagagagtacgaagcgaacgcaagtaatattagttagtaaagtaaaagatactaagttcgaagttaagtaggtacggtacgacgggtacggtaggctttagg

SEQ ID NO: 300004 - DNA, 673 bp, Homo sapiens
  misc_feature: GZ8MTXP02IYU3Q.38.23.C01.1.454.CMB.2.raw
  modified_base (268)..(268): a, c, t, g, unknown or other
  misc_feature (268)..(268): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgcttattttagaaggtgtccagtgtgaggtgcagttggtggaatcgtagggggaaacttggtccaggccggtcggggtcctagacgtctctccgtgtcgcncgcctgtgtatctattatttagtatctagtgatggtaggttcggtccgcgcggcctcgggacggggacggtggtagggtaggttggggcgacctaagttaacctaaaccgagtacgtacggaaacctaaaggaaaagtacttaagtggtcgtactacgtgtacgggacgggtaccgtacttacccgaccgtcctacgaacgaacgtaacccgaaccgaaccgaaagttaaacgttctaacgttacgttagtttacgaaactaaagtacgtaaagtacgtcgttaagaagtacggtacgaaacggacgaaccgacgtaattaacgttattagttagtaaagtaaatacttactacgttaagtagtaagtcggtacggtacggaccggttagggtcgtacttttagg

SEQ ID NO: 300005 - DNA, 625 bp, Homo sapiens
  misc_feature: GZ8MTXP02I3M45.38.23.C01.1.454.CMB.2.raw
tcagtcgatcacgtcacgaccggtgctcgatttagtacacgtgattagggattgggggagctacaacaggcaggcaggggcagcaagatggtgttgcagaccccaggtcttcatttctctgttgctctggatctctggagcctacggggacatcgtgatgacccagtctccagacctccctggctgtgtctctgggcgaggagggcccaccatcaactgcaagtccagccagtagttctttttgtcagcctaccaaagaatatgtagttcgttagcttaggaccagacaagaaacgcaacgacacgtacccctaagttcgactctattttacgtggtactacttcgtaccgtcggggttacggtccccccggggttccctacgtaccgtattcgacggccggcgacggcggtatccgagggtacagtactttcgacttcctacacatcagccagccgtgaccagaccgtagaaacgtgttggtggtacttagtttaacttacgtaggtactagtaacctaaattagttagttacgggtactacccgtcggtaccttacgttaccgtttacgggacgggtaacggaacgtaacgggtaggacgtagtaaccgaaggtcgtaaacgg

SEQ ID NO: 300006 - DNA, 676 bp, Homo sapiens
  misc_feature: GZ8MTXP02G439O.38.23.C01.1.454.CMB.2.raw
tcagtcgatcacgtcacgaccggtgctcgatttagtacacgtgattagggattgggggtctcagagaggagccttagccctgcactccaaggcctttgcacttggtgatcagcactgagcacagaggactcaccatggaattggggctgagctgggttttccttgttgctatttagaggtgtccagtgtgaggtgcagttggtggaatcgtgggggaaacttggtccagccgtgggggtccctgaagctctcctgtgcagcctctggattctattatttagtaatctagttggatggtaggttggtccgccgaggcctccggaggggacgggcgtgggaggtggggtcggaccgtacgtaacgtaaaccaccgaagtacggaaacgtaagaaaaacgtactaagtggtacggactcgtggtaggaacgggtccgtaattccgaccgttacctacgacgaacgacgaaaccgacccgaaaagtaacttacacttagttactttacgaactaaacgtacgaaacgacgtaccgtagaaacggacgtacgaaacggaaccgtaaccgggacctaagttaactaagtttaagtacggtttaaagttaaaacgtagttacttaagttacgtaagttaggtagggtacgggtacggtaacgggttacggggtcgggttaacg

SEQ ID NO: 300007 - DNA, 585 bp, Homo sapiens
  misc_feature: GZ8MTXP02FYOGP.38.23.C01.1.454.CMB.2.raw
  modified_base (299)..(299): a, c, t, g, unknown or other
  misc_feature (299)..(299): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttcctgttgctatttagaaggtgtccagtgtgaggtgcagttggtggaatcgtgggggaaacttggtccagccgtgggggtccctgaagctctcctgtgcagcctctggattcatatttagatcattgatgagttggtccncaggctccgagggacgggcgtggagtggggtgccataataaaccgacgataggaaactagaaaaagctatgtggactcgtgtgacgggggctaattccgaccgtctcccgagacgaccgaacgaccaagtaatacactagtatttagactaaaatacgaaacacgtacctagaacgtagtacgaaaggaaccgacggacctaataattatttataagtaagtaaaaagtactataattcgaataagttagggtacgtaccggacggtaaccgggtggacgtttagg

SEQ ID NO: 300008 - DNA, 748 bp, Homo sapiens
  misc_feature: GZ8MTXP02HR6B5.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcttgggttttccttgttgcttattttagaaggtgtccagtgtgagtgcagttggtggaatcgtgggggaaacttggtccagccgtgggggtccctgaagctctcctgtgcacgtcctctggtattcattattagtaatctattggatgtaggttcgggtccgccgacggctaccggaggggaccggggtcgtgggaggtggggtcgacctaacgtaactaaaccgacgagtaggaaactagaaaaacgtctagtgtggactgtagagtaacgggccgattacccacgttccaccgaagacgaaaccgaaaccgtaaccgtaaagtaactttaccaacgttagttaacgtttagaacaaaagtttaggaaaacctacgtacccgtagaaggttaaacgtaaccggaaaacggtaccgaaacccggtaccctaaaagtttaaatttaaacgtttaaagttttaaccgggttaaaaggttaaaaaacgttacgttaaacgtttaaactttaacggtaaagtttaaaacgggtttcggggtaccgggtaacccggggttaaacgggttttacccgggggacggtttacccgtttaaacggg

SEQ ID NO: 300009 - DNA, 554 bp, Homo sapiens
  misc_feature: GZ8MTXP02GQ4QZ.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtggggggtccctgaagctctcctgtgcagcctctggattcatatttagtaatcattggatgagttgggtccgccaggctccaggggacggggctgggagtggggtggccaatataaaccagactggaaactagaaaaaagctatgtgggactcgtggtgaaaggggcccaattccgaaccgtctaccagacgacaaacgcccaaagaattcaactgtatttgacaaatgaaacagcctgaagagtacgaagaacaggaccatatattatgtataaaagactacattacgataagtggtggtacgagtacgggtgacttag

SEQ ID NO: 300010 - DNA, 585 bp, Homo sapiens
  misc_feature: GZ8MTXP02JA4WV.38.23.C01.1.454.CMB.2.raw
  modified_base (306)..(306): a, c, t, g, unknown or other
  misc_feature (306)..(306): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcaggttggtggaatcgtgggggaaacttggtccagccgtggggggtccctgaagctctcctgtgcagcctctggattcattattagtaatcattggatgagttggtccncgaggctcgagggacggggctgggaggtggggtggccacgtataaaccgacgagtaggaactagaaaaagactatgtgggactcgtgtaggagggccgtattccgaccgtctaccagaacgaaccaacgacccaaagaacttcgaacttagtatttagacaaaattaggaaacagacctaggaagagtacgaagacctacggccaaatattatttagttgtaaagtaaaagtatctaacttgattaagtggttacggcggtaggtacggggtgactagg

SEQ ID NO: 300011 - DNA, 669 bp, Homo sapiens
  misc_feature: GZ8MTXP02HVPTM.38.23.C01.1.454.CMB.2.raw
  modified_base (282)..(282): a, c, t, g, unknown or other
  misc_feature (282)..(282): n is a, c, g, or t
  modified_base (652)..(652): a, c, t, g, unknown or other
  misc_feature (652)..(652): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcttgggttttccttgttgcttattttagaggtgtccagtgtgaggtgcgtagttggtggtaatcgtagggggaaactttgggtccgaggtccgtcggggggtccctggaacgtctctcctgtgcacgcctntggtattcattatttagtaatcattggattggaggtttcggggtcccgccgtaggcctaccggaggggacggggcgttgggaagggttggggtcggacccaacgttaaacgtaaaacccaacggacgttaggaaaccttaaagaaaaaagtcttaagtgtacggacttcgtaggttacgggaacgggtccgaatttcccgacccgtctacccgaagaacgaacgaaccgaactaaagtacttactactagttaatttagaacctaaagttacgaaacacgttacccgagtaagacgtaacgaagacgtacggactatattaattagttagtaagtaaaagtctactaagtcgtataagtggacgtacggnggtacggtagtcgttag

SEQ ID NO: 300012 - DNA, 559 bp, Homo sapiens
  misc_feature: GZ8MTXP02HMXFT.38.23.C01.1.454.CMB.2.raw
  modified_base (306)..(306): a, c, t, g, unknown or other
  misc_feature (306)..(306): n is a, c, g, or t
  modified_base (448)..(448): a, c, t, g, unknown or other
  misc_feature (448)..(448): n is a, c, g, or t
  modified_base (453)..(453): a, c, t, g, unknown or other
  misc_feature (453)..(453): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtagggggaaacttggtccagccgtgggggtccctgagctctcctgtgcagcctctggtattcattattagtaatcattggatgtagttcggccncgaggctcgagggacgggcgtgggagtggggtgccaataataaaccgacgataggaactagaaaaagtctagtagtggactcgtagtagaaacggggtccattcccgaccgtctacagaacgacaaacgacaagtatcactntattnaactaaatgaacagcgtagagagtacgaacgacacgacatatattattagaaataaagatactaattcgagtaagtggtacggacgacggttacggcgtactttag

SEQ ID NO: 300013 - DNA, 660 bp, Homo sapiens
  misc_feature: GZ8MTXP02I376L.38.23.C01.1.454.CMB.2.raw
  modified_base (613)..(613): a, c, t, g, unknown or other
  misc_feature (613)..(613): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcttgggttttccttgttgctattttagaaggtgtccagtgtgaggtgcagttggtggaatcgtgggggaaacttggtccaggccgtggggggtccctgaagctctcctgtgcagcctctggattcattatttaagtaatctagtttgggattggtaggtttcggggtcccgccgtaggcctccggagggggaccggggcgtggggacgggttggggtcggacccaaccgttaacgtaaaacccgacggtaacgtagggaaaaccttaaggaaaaaaacggtcttaagtggtcggggtaccttcgtaggtagggaacggggtcccgagtttcccacccggttctacccgagaacgaaccaaaccgaccaaagtacttacgtacttagtactttagaactaaatacgaacacgtccgtagagtagtacgaagaacgacgactatatattagttagagtaaaagntacaattcgaataagtggtacggtacgtaacgggtcggtaggcttag

SEQ ID NO: 300014 - DNA, 661 bp, Homo sapiens
  misc_feature: GZ8MTXP02F36FC.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagcctggggggtccctgaagctctcctgtgcagcctctggattcatatttagtaatcattggatgagttgggtccgccaggctccaggggacggggctggagtgggtggccactataaaccacgataggaactggaaaaaagctaagtcgtgggaactctagtaggaacggggtccgatttccaacccgttctcccgaagacggaaccaaaccggacccaaagtaaatttccaacgtgtaattttcgactaaaattgaaaacacgtacccgtagaacggaacggttacgaaagaaccgaccggggaccctaaagttaattaagtttaaatttaggttaaacggttaaaaaggtattacctaaaagttccggtaaattaaggttggggtacgggtaccgggtaaccggttaccgggggtacgggactttaacgg

SEQ ID NO: 300015 - DNA, 582 bp, Homo sapiens
  misc_feature: GZ8MTXP02IAHC3.38.23.C01.1.454.CMB.2.raw
  modified_base (261)..(261): a, c, t, g, unknown or other
  misc_feature (261)..(261): n is a, c, g, or t
tcagtcgatcacgtcacgaccggtgctcgatttagtacacgtgattagggattgggggtctcagagaggagccttagccctggactccaaggccttttgcacttggtgatcagcactgagcacagaggactcaccatggaattgggctgagctgggtttccttgttgctattttagaagtgtcagtgtgaggtgcagttggtgaatcgtgggggaaacttggtccagccgtgggggtccctgagctctcctgtgcagcctntggattcattatttagaatcattggatgagtttggccgcgaggctccgaggggacgggctgggagtggggtgccaactaataaaccaggtataggaaactagaaaaaagtctaagtgtggcttcgtggtagaaacggggccctaatttcccaacccgtctacccgaggaacgacaaaccgacctaaagtaacttacaacttgttatttagactaaatagaacacgccgtagacgtagacgaagacacggacataatattattagtaaacgtaaagatacactttgattaagtggtacggacgtaacggtacggtgacttag

SEQ ID NO: 300016 - DNA, 570 bp, Homo sapiens
  misc_feature: GZ8MTXP02IFF87.38.23.C01.1.454.CMB.2.raw
  modified_base (415)..(415): a, c, t, g, unknown or other
  misc_feature (415)..(415): n is a, c, g, or t
  modified_base (523)..(523): a, c, t, g, unknown or other
  misc_feature (523)..(523): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtggggggtccctgaagctctcctgtgcagcctctggattcatatttagaatcattggatgagttgggtccgccgaggctccgagggcggggcgtggagtggggtggccactaataaaccacgagtaggaaactagaaaaacgactatgtgactcgtgtgaggggccgattccgaccgttcncccagacgacaacgcaaagtattcactagtattagactaaatgtaaacagacctagagtaaggtacgaaagaccgacggaccaataattattattacgtaataaaagntactacttagataagtggtacggacgtacggttacgggagtacgtag

SEQ ID NO: 300017 - DNA, 585 bp, Homo sapiens
  misc_feature: GZ8MTXP02FVLHT.38.23.C01.1.454.CMB.2.raw
  modified_base (480)..(480): a, c, t, g, unknown or other
  misc_feature (480)..(480): n is a, c, g, or t
  modified_base (502)..(502): a, c, t, g, unknown or other
  misc_feature (502)..(502): n is a, c, g, or t
  modified_base (537)..(537): a, c, t, g, unknown or other
  misc_feature (537)..(537): n is a, c, g, or t
  modified_base (557)..(557): a, c, t, g, unknown or other
  misc_feature (557)..(557): n is a, c, g, or t
  modified_base (577)..(577): a, c, t, g, unknown or other
  misc_feature (577)..(577): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctatttagaaggtgtccagtgtgaggtgcaggttggtggaatcgtgggggaaacttggtccagccgtggggggtccctgaagctctcctgtgcagcctctggattcatatttagatctattggatgtagtgggtccgcgagctcgaggggacgggctggagtggggtcggccaacgtaataaaccgacgagtaggaaactaagaaaaacgactatggtgggactgtaggtagaacgggcgatctaccgtctaccgaagacgaacaacgaacaagtaaacttcaacgtagtaatttacgaactaaatacgaanacgaccgtagagtagaacgaanacgacgactaattatattaatagtaaacgtaaaanacttacaattcgaataaggnggtaggaccgaggttacggnggtcttag

SEQ ID NO: 300018 - DNA, 641 bp, Homo sapiens
  misc_feature: GZ8MTXP02JB7QG.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcttgggttttccttgttgcttattttagaaggtgtccagtgtgaggtgcagttggtggaatcgtgggggaaacttggtccagccgtgggggtccctgaagctctctgtgcagcctctggattcattatttagtatctattggatgtagttggtccgcgaggctcgagggacgggcgtggaggtgggtgccctataagaaaccgacgagtacggaactaagaaaagtctagtgtgcttcgtgtagaagggcgtatccacccgtctaccgagacgaacgaacgacccaagtaacttacgacgttagttagtttacgaactaaaagttacgaaaccgacgtacccgtaagaacggtacggtaaccggaaaggaccgaaaccggacctaaagtaatttaacttaagtttaggtaaacggtaaaacttactacgttaagtaccgttaagtaagttgggacggtaacggacggttaccgggtagtacgtttaacgg

SEQ ID NO: 300019 - DNA, 621 bp, Homo sapiens
  misc_feature: GZ8MTXP02GSKFL.38.23.C01.1.454.CMB.2.raw
  modified_base (376)..(376): a, c, t, g, unknown or other
  misc_feature (376)..(376): n is a, c, g, or t
  modified_base (384)..(384): a, c, t, g, unknown or other
  misc_feature (384)..(384): n is a, c, g, or t
  modified_base (420)..(420): a, c, t, g, unknown or other
  misc_feature (420)..(420): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagccgtacggggacatcgtgatcgacccagtcctccagacctcccgtggctgtgtctcgtgggcgaggacggcccaccatacaactcgacaagtccagccagtagttcttttgtcagtcctacaaagtatatgtagtttcgtagtcttacggaccagacgaagaaacgcaacgaccaccgtacccctaagttcgacttactatttagtgtactatccgttacggtcggggtcgtcccgggtccncgaccgtntcaggcgcaggcgatcgtacgggactagtacttccnctcctacaaccatcagcacgccctagaccagacgtagaagtgtagcgtattattatacgtcgtaactaatataaagttcgttaggtagtacctaccgggtccgttcggtaaacccgttacgggttacggggacgggtaaccgggtaccgtaaaggggtaacggaagtaccgtaaccgtaggtaacccgtaggttcgggtcg

SEQ ID NO: 300020 - DNA, 567 bp, Homo sapiens
  misc_feature: GZ8MTXP02HO6RT.38.23.C01.1.454.CMB.2.raw
  modified_base (262)..(262): a, c, t, g, unknown or other
  misc_feature (262)..(262): n is a, c, g, or t
  modified_base (268)..(268): a, c, t, g, unknown or other
  misc_feature (268)..(268): n is a, c, g, or t
  modified_base (327)..(327): a, c, t, g, unknown or other
  misc_feature (327)..(327): n is a, c, g, or t
  modified_base (475)..(475): a, c, t, g, unknown or other
  misc_feature (475)..(475): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgcttattttagaaggtgtccagtgtgaggtgcagttggtggaatcgtgggggaaacttggtccaggccgtgggggtccctgagctctcctgtgcngcctcnggtattcatatttagtatcattggatgagttggtccgcgaggctcgaggggacgggcgnggaggtggggcggccaactaactaaaaccgagacgtacggaaactaggaaaaaagtacgtatggtgggacttctggtaggtaacgggcgtattccaaccgtctaccagacgaacaacgacaagattacactgtatttgacaaatgaanagacctagagtagagaaagcgacgaccatatattattagtaataaaagtatctattcgtaataagtggaggtacgagtaggtgggttacgag

SEQ ID NO: 300021 - DNA, 526 bp, Homo sapiens
  misc_feature: GZ8MTXP02G7YNC.38.23.C01.1.454.CMB.2.raw
  modified_base (375)..(375): a, c, t, g, unknown or other
  misc_feature (375)..(375): n is a, c, g, or t
  modified_base (428)..(428): a, c, t, g, unknown or other
  misc_feature (428)..(428): n is a, c, g, or t
  modified_base (445)..(445): a, c, t, g, unknown or other
  misc_feature (445)..(445): n is a, c, g, or t
  modified_base (486)..(486): a, c, t, g, unknown or other
  misc_feature (486)..(486): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtgggggtccctgaagctctcctgtgcagccctctggattcatatttagaatcattggatgagttgggccgcaggctccgaggggacggggctggaggtggggtggccaactataaaccagactggaactagaaaaagctangtggactcgtgtgaagggcgatcaccgtctccagagacaacgcaagaatcatntattgacaaatgaaacngctagagagtacaagacacgcaatatattatgtagtaaaantacatacataagtggtcggacggacggtacggtcgattag

SEQ ID NO: 300022 - DNA, 594 bp, Homo sapiens
  misc_feature: GZ8MTXP02G9FJA.38.23.C01.1.454.CMB.2.raw
  modified_base (500)..(500): a, c, t, g, unknown or other
  misc_feature (500)..(500): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcttgggttttccttgttgctattttagaaggtgtccagtgtgaggtgcagttggtggaatcgtgggggaaacttggtccaggccgtggggggtccctgaagctctctgtgcacgcctctggattcattatttagtaatcattggatgagttcggtccgcgaggctccgaggggcgggctggaggtgggtgccacgtaataaaccgagagtaggaactaagaaaaacgactagtggtggactcgtggtagaacggggcctattacccgaccgttctacccgagacgaacaaccgacaaagattcacttagttattagactaaagtgaaacacgcctagacgtagacgaanaccgacgacagtatattagttagtaaagtaaatactctaagttcgtaaagtgtacgggtcggtacggtacgggttacggggagtaccgtttagg

SEQ ID NO: 300023 - DNA, 714 bp, Homo sapiens
  misc_feature: GZ8MTXP02J3LN2.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcttgggttttccttgttgctattttagaaggtgtccagtgtgaggtgcagttggtggaatcgtagggggtaaacttggtccaggccgtgggggtccctgaagcctctccgtgtgcacgccctcgtggtattctattattaagtaatcgtattggagttggtaggttcgggtcccgcgaggccgtaccggaggggtaccggggcgtgggagggtcggggtacgaccgtaaactaaacgtaaaccgaacgtacgtaacggaaacgtaaagaaaaaacgtactaacgtagggtcggaacgttcggttaggtacgggaacgggcccgttaacgtttcccgacccgttacccgaccgaacggaaaccgaaaacccgaacccgaaccgtaaaacgtaaacctttacaaaccgtttagttaactttacggaaacaaaacgtacgaacgacgaccgtagaagacggtaacgaaacgacgaccgactaataattagttaatagtaaacgtaaaattctacgtagttacgtagttaaggtcgggtacggtacggtacgggtcggtacgtactg

SEQ ID NO: 300024 - DNA, 573 bp, Homo sapiens
  misc_feature: GZ8MTXP02H2OKV.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagctgggggtccctgagctctcctgtgcagcctctggattcatatttagtaatcattggatgtagttgggtcccgcaggctccgagggacggggctgggagtgggtgccaactataaaccgacgataggaaacctgaaaaacgctaattgtgggactcgtgtagaaggggccattcaccgtctaccagagaacaacgaccaaagaaattcacttagtatttacgacaaaatagaacaggtcctaggaagagtacgaaacgaacgacggaccattaagtattaattgtaataaaagattacatttacgattaagtcggtggacgtaggtaacgggtcgacgttag

SEQ ID NO: 300025 - DNA, 620 bp, Homo sapiens
  misc_feature: GZ8MTXP02JCEZ8.38.23.C01.1.454.CMB.2.raw
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctcgtgggcgagaggccacatcaactgcaagtccagccagagttcttttgtcagtcctacaagaatatgtagttcgtagcgttggtaccagcaaagaaagcacgacacgtcccttaaagttgactctattttagtggtctatcgtaccgtggggtccgtacccggggtcctacggaccgtattcgacggcggtacgagcggtacgtcggacggggaactgtaactttcactctacaaccatcagtcacgtccctgacagactgaaagtgttggtacggtactttaacgttttacttacgtgtaccgtaagtactaaaattgtttaaacgtcgggttaacttccggtacggtccttacgttaacggttcggggacggtaaacggggcctaaggggtaacggtacgtaaacgacgaaacggtacgtaacggttcgtacgg

SEQ ID NO: 300026 - DNA, 551 bp, Homo sapiens
  misc_feature: GZ8MTXP02ISTQ7.38.23.C01.1.454.CMB.2.raw
  modified_base (448)..(448): a, c, t, g, unknown or other
  misc_feature (448)..(448): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggtttcctgttgctatttagaaggtgtccagtgtgaggtgcagttggtggaatctgggggaaacttggtccagcctgggggtccctgaagctctcctgtgcagcctctggattcatatttagtaatcattggatgagttgggtccgcaggctccgagggacgggctggagtgggtgccactataaaccacgatggaactagaaaaagctaatgtggactcgtggtagaaggggccattccaccgtctccagacgacaacgacaagaattcaactgtatttgactaaatagaacngcctagagagtacgaagacacggccaatataattattagtagtaaaaagactactaattcgaataagtaggtacggacgtacgggtacgggtcggtacttagg

SEQ ID NO: 300027 - DNA, 720 bp, Homo sapiens
  misc_feature: GZ8MTXP02J0DNM.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtagggggtaaacttggtccagccgtggggggtccctgaagctctcctgtgcagcctctggtattcattatttagtaatcaattggatgagttggtccgcaggctcgagggcgggctggagtgggtgcactataaaccagataggaactagaaaaagctagtggtgaacctcgtagtaggaacgggtccgtattccgacccgttcctacccgaagtacgaaccaaaccgacccaaagtaacttaccgtaacttagttaacgtttacggaactaaaacgtaggaaaaccaggtaccccgttagggaaacgaacgggttaaccggaaaacggaaccgaacccggggtaaccctaaaacgtttaaactttaacttttaaaagttttacgggttaaaacggtttaaaaaaacggtatttaaacctaactttaaaccgtaaaagtttaaggtacggggtttacgggacccgggttaaacggggtttacccgggggtacggttacgtttaaccgg

SEQ ID NO: 300028 - DNA, 699 bp, Homo sapiens
  misc_feature: GZ8MTXP02JO0PR.38.23.C01.1.454.CMB.2.raw
  modified_base (265)..(265): a, c, t, g, unknown or other
  misc_feature (265)..(265): n is a, c, g, or t
  modified_base (305)..(305): a, c, t, g, unknown or other
  misc_feature (305)..(305): n is a, c, g, or t
  modified_base (311)..(311): a, c, t, g, unknown or other
  misc_feature (311)..(311): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattgggctgagctgggttttcctgttgctattttagaaggtgtccagtgtgaggtgcagttggtggaatctgggggaaacttgggtccagcctggggggtccctgaagctctcctgtgcagccctntggattcatattagaatcaattggaatgagttgggtcccncgagcncgagggcggtctggaggtgggtcgacctaactaactaaaccgacgaacgttacggaaactaaaggaaaaaacgtactaagtaggtggtacgtacgtaggtacgggaaacgggaccggtaacgttaccgtacccgtacccgtaccgaacgaacgaaacgtaaacgtacgaaccgaaaacgtaaaacgttaacgtaacgttagttaagtttacgtaaactaaaacgtaaacgaaacgaacgtaccgtaacgaacggaacggtaacggaaacggaaacgaaccgaaccgtaactaaattaatttaagttaagttaaagttaaaacgtaaactaactaacgttaacgtaagtaagttacggtacggtacggtaacggtaacggtacggtacg

SEQ ID NO: 300029 - DNA, 636 bp, Homo sapiens
  misc_feature: GZ8MTXP02JJGVY.38.23.C01.1.454.CMB.2.raw
  modified_base (261)..(261): a, c, t, g, unknown or other
  misc_feature (261)..(261): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtgggggtccctgaagctctcctgtgcngctctggtattcattatttagtatctattgatgtagttcgggtccgccgtaggctccgaggggacggggcgtggaggtcggggtggacctaacgtaataaaaccgacgagtaggaaaccgtaagaaaaagctagtgtgggaactcgtaggtagaacgggtccgattccgacccgtctacccgaagacgaacaacgacccaagtacttcgactagtactttagaactaaagtacgaaacgacgtacctagagaacgtacggaaacgaaccgacgggacctaattaaattactttattaggtaaagtaaaataagtacctaaatttcgaagttaagtgggtacggtacgaacgggttaccggggtacgacgtttaag

SEQ ID NO: 300030 - DNA, 555 bp, Homo sapiens
  misc_feature: GZ8MTXP02GKE89.38.23.C01.1.454.CMB.2.raw
  modified_base (361)..(361): a, c, t, g, unknown or other
  misc_feature (361)..(361): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctgtctgtgtctcgtgggcgagaggccaccatcaactgcaagtccagccagagttctttgtcagctacaaagatatgtagttcgtagcttaggaccagcagaaagcacgactacgtcccctaagtcgctactatttatcggtactacttctacgtcggggtcgtcccccggggtcctgaccgtnttcgaggcgcacggcggtactcgtaggactagtactttcactcctacacatacgacgcgacgtcctgactacgacgtagaagagtgtacggacttagttactacgtgtacagtacaattataagtcggtacgttccgtcgtactacgtcgttacggacggtaggaaccgtaggagatacgtacgacggacgtag

SEQ ID NO: 300031 - DNA, 741 bp, Homo sapiens
  misc_feature: GZ8MTXP02G7MMO.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtagggggaaacttggtccagccgtgggggtcctgagctctctgtgcacgcctctggtattcattattagtaatcattggatgagttggccgcgaggctcgaggggacgggcgtgggaggtggggtcggcctaacgtaactaaaccgacgtagtacggaaactaagaaaaacgtactagtaggtggtaccttcgtaggtaggaacggggtaccgtacgttcccgtaaccgtcctacccgaagaacgaaccaaaccgaaccgtaaacgtaacttactaaacgttagttaaacgtttaggaactaaaacgtacgtaaacgtaaccggtcccgttaaaggaacggtaacggttaaccgggaaaacgaacccggaaaccgggtaaccctaaatttaaacgtttaagttttaaacgtttaggttaaaacggttaaaaaaggttaacttaaccgttaacgtttaagtaaagtttaaggtagggttacggggaaccggttaaccggggtttacggggtacgggttaccgtttaaggg

SEQ ID NO: 300032 - DNA, 629 bp, Homo sapiens
  misc_feature: GZ8MTXP02GF2CI.38.23.C01.1.454.CMB.2.raw
  modified_base (338)..(338): a, c, t, g, unknown or other
  misc_feature (338)..(338): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtagggggaaacttggtccagccgtgggggtccctgaagctctcctgtgcagcctcgtggtattctattatttagtaatcagttggatgaggtttgggtccgccgaggctccggaggggaccggggntgggaggtggggtcggacccataataaaccgagacgtaggaactaaggaaaaacgacgtagtggtcgggaacttcgtaggtagggaacgggtccgtattacccaccgttccgtacccaagaacgaacgaacccgaacccgaaagtaaactacctaacgttagttatttacggaactaaaagtacgaaactcgaccgttagaacgtagtacgaacgacgacgacatactattatagtaagtaaacatacattacgataacgtggtacggacgtacggtacggtcgtattagg

SEQ ID NO: 300033 - DNA, 577 bp, Homo sapiens
  misc_feature: GZ8MTXP02H9493.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtgggggtccctgagctctcctgtgcagcctctggattcattatttagaatcattggatgagttggtccgcaggctccgagggacgggctggagtgggtggccactataaaccacgatggaactagaaaaagctaatgtgggactcgtgtagaaggggccgattccaccgtcacccagacgacaacgacaagattcgactgtattagactaaatagaacagacctagagagtacggaagacgacggacctatattaattattagtaagtaaaagtatacaatttactaaagttaagttaggggtacgggtacggtaacggttaacggggtcggacgtttaacgg

SEQ ID NO: 300034 - DNA, 635 bp, Homo sapiens
  misc_feature: GZ8MTXP02JGHQ4.38.23.C01.1.454.CMB.2.raw
  modified_base (309)..(309): a, c, t, g, unknown or other
  misc_feature (309)..(309): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaagtgtccagtgtgaggtgcgagttggtggaatcgtgggggaacttggtccagccgtgggggtcctgagctctcctgtgcagcctcgtggattcatattagtaatctattggatgagttggtccgcgaggcnccgagggacgggcgtggaggtggggtgaccagtactaaaaccgacgagtaggaaactagaaaaaacgctaagttagtgggaacttcgtaggtaggaaggggtccgtattcccgaacccgttccttacccgaagacgaaccgaaccgaccaaaggtaacttacgtaacttaggttaattttaggacctaaaatacgtaaaccgagtacccgtagaaggaacgtacgaaaacggacaaccgggacctaatacttaattagtttagtaagtaaagtactactaatcgaataagtaggtacggaccggtagtacggggtacgacgtttag

SEQ ID NO: 300035 - DNA, 686 bp, Homo sapiens
  misc_feature: GZ8MTXP02G425I.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattgggctgagctgggttttccttgtgctattttagaagtgtccagtgtgaggtgcagttggtggaatcgtgggggaaacttggtccaggccgtgggggtccctgaagctctcctgtgcagcctctggattctattattagtaatctattggatgtaggtttggtcccgccgtaggcctaccggaggggacggggcgtaggaggtcggggtcggaccctaacgtaactaaaccggacgtagtacgggaaacctagaaaaaagtaccttagtggtacggtacttacgtaggtagggaaacggggtcccagttacccgtacccgttccgtaaccgaaggaacgaacccgaaaccgaccgtaaaacgtacttaccgaaccttaggttaagtttacgaactaaaacgtacgaaacgacgtacccgtaggaagtaacggacgaaaacgacgaccggacaagttaataatttagtaagtaagtaaaagtactactaattacggaattaaggtacggttacgggaccgtaacggggtaaggtcgtacgtttacg

SEQ ID NO: 300036 - DNA, 749 bp, Homo sapiens
  misc_feature: GZ8MTXP02IXMN8.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtagggggaaacttggtccagccgtgggggtccctgagctctcctgtgcagcctcgtggtatctatatttagtaatctagttggatggtagtttcgggtcccgccgaggccgtaccggacggggaccggggtcgtcggggtagggttggggtcggacccgtaaaccgttaacgtaaaacccctacggtaacgtaacgggaaaaccgtaaaggaaaaaacggtacttaaggtacggtcgggtaaccttcgtagggtagggaacggggtcccgtaacgtttacccgaacccggttccctacccgaagaacgaacccaaaccgaccctaaaaggtaacttacctaacgttacgtttaagtttacggaaaccttaaaagtacgaaacgaagtacccgtaaggtacgaacggtaacgaaaggaaacccgaacggacctaaattaatttaaagtttaattaggtaaaagttaaaagtacttacgtaatttacggaagttaaggttgggtacggggacgtaacgggtacgggtaggtactttagg

SEQ ID NO: 300037 - DNA, 590 bp, Homo sapiens
  misc_feature: GZ8MTXP02G80EE.38.23.C01.1.454.CMB.2.raw
  modified_base (301)..(301): a, c, t, g, unknown or other
  misc_feature (301)..(301): n is a, c, g, or t
  modified_base (458)..(458): a, c, t, g, unknown or other
  misc_feature (458)..(458): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcgtggtttcctgtgctatttagaaggtgtccagtgtgaggtgcagttggtggaatcgtgggggaaacttggtccaggccgtgggggtccctgaagctctcctgtgcagcctctggattcattatttagaatcattggatgtagtggtccncaggctcgagggcgggctggagtgggtgcccatataaacgacgatgaaactagaaaaagctagtgtggactcgtggtagaaggggtcccatttccgaacccgtctccgaagacgaacaaccgaccaaagatcactagtatttagacaaatagaaacncgacgtagaagacgtacggaacgacgacggacctaattaatatttagttagttaacgtaaaagtattacgaacgttacgtaagttaacgttggtacggtaccggtaacccggtacggggtaggctttaacgg

SEQ ID NO: 300038 - DNA, 578 bp, Homo sapiens
  misc_feature: GZ8MTXP02FWWWR.38.23.C01.1.454.CMB.2.raw
tcagtcgatcacgtcacgaccggtgctcgatttagtacacgtgattagggattggggacaacaggcaggcaggggcagcaagatggtgttgcagacccaggtcttcatttctctgttgctctggatctctggagccgtacggggacatcgtgatgacccagtctccagactccctggctgtgtctcgtgggcgagaggccaccatcaactgacaagtccagccagtagttctttgtcagctacaagaatatgtagttcgtagcttggaccagcaagaaagcaacgacacgtacccctaagtcactactatttagtggtactatccttacgtcggggtcgtcccggggtccctaggaccgtattcgaggcgcaggcggatcgtgggacagtacttcactctaccaccagtacacgtcacgccctagcaagaccgtagaaaacgtgtggtacggtacttaagttttactaacgtgtactagaactaattagttagtacggtacgtccgtacggtactcgtacgttcgggacggtaacggccgtaaagggtcgaagtacgtacgaagtccgaacgtgtacg

SEQ ID NO: 300039 - DNA, 903 bp, Homo sapiens
  misc_feature: GZ8MTXP02FZOEI.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttcctgttgctattttagaaggtgtccagtgtgaggtgcagttggtggaatcgtgggggaaacttggtccagccgtgggggtccccagctctcctgtgcagcctctggattcattattagtaatcattggatgagttgggtccgcaggctccgaggggacggggctgggaggtggggtcggaccctaacgttaacaaaacccgacggaagttaccggggaaaaccttaaggaaaaaaaacgtaccgttaagttaggttacgggtaccttaccggttagggttaggggaaaaccgggggtccccgttaaacgttttaccccgaaccccgggtttacccgttacccgaaacggtaaacggaaaacccgtaaaacccgggaaccccgtaaaaacgggtaaaacccttttaccgtaaacccgtttacggtttaaaagttttcggaaaacccttaaaaagtttacggaaaaaccctaacgggtaccccgttaacgggaaaggtaaaccgggttaaccggaaaacgggaacccgttaaacccggggacccccttaaaagtttaaaacgtttaaaattttaaacgtttaaacggggtttaaaacggtttaaaaaaaacgggttaagtttaaacccttaaagttttaaacccggtaaagttttaaaacggttgggggtttaccgggaacccgggggtttaaaccgggttaccggggggtttaacggtaaccggttaggttttttaaacccggg

SEQ ID NO: 300040 - DNA, 725 bp, Homo sapiens
  misc_feature: GZ8MTXP02IKL3X.38.23.C01.1.454.CMB.2.raw
  modified_base (257)..(257): a, c, t, g, unknown or other
  misc_feature (257)..(257): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcttgggttttccttgttgctattttagaaggtgtcagtgtgaggtgcaggttggtggaatcgtgggggaaacttggtccaggccgtgggggtcctgagctctctgngcagcctcgtggtattcattatttagtaatctattggtatggtaggttcgggtcccgcgacggcgtaccggaggggacggggtcgtgggtagggtggggtcggacccgaacgtaaactaaaacccgacggtaacgtacgggaaacgtaaaggaaaaaacgtacgttaagttaggttcgggtactttacgtagggttacgggaacggggtccgtaactttcccgacccgttcctacccgaaagacgaaaccgaacccgtaccaaagtaacttacgaacttgttaatttacgaaactaaagttacgaaactacgaccgtaaggacgaacgtaacggaaacgcggaaccggtactaaattagttaaacttagtttagaaaagttaaaacggtattaccctaaagtttacgtaaagttcggttagggtaacggggtcggtaaacggggtttccggggtaggttactttacgg

SEQ ID NO: 300041 - DNA, 535 bp, Homo sapiens
  misc_feature: GZ8MTXP02GLQC2.38.23.C01.1.454.CMB.2.raw
  modified_base (370)..(370): a, c, t, g, unknown or other
  misc_feature (370)..(370): n is a, c, g, or t
  modified_base (403)..(403): a, c, t, g, unknown or other
  misc_feature (403)..(403): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagcctggggggtccctgaagctctcctgtgcagcctctggattcatatttagtaatcattggatgagttgggtccgccaggctccgagggacggggctggaggtggggtggccacgtataaaccacgatggaactgaaaaanactatgtggactctgtgaagggcattcaccgtntccagagacaacgccaagactcactgtacttgacaaatgaacagcctagagagtcgaagacagccattatatattagagtaaaagatacgtatacgataagtggtacggcgtaccggtagggtcggacttag

SEQ ID NO: 300042 - DNA, 578 bp, Homo sapiens
  misc_feature: GZ8MTXP02G2E5K.38.23.C01.1.454.CMB.2.raw
  modified_base (352)..(352): a, c, t, g, unknown or other
  misc_feature (352)..(352): n is a, c, g, or t
  modified_base (358)..(358): a, c, t, g, unknown or other
  misc_feature (358)..(358): n is a, c, g, or t
  modified_base (378)..(378): a, c, t, g, unknown or other
  misc_feature (378)..(378): n is a, c, g, or t
  modified_base (437)..(437): a, c, t, g, unknown or other
  misc_feature (437)..(437): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctcgtgggcgaggacggccaccatcaactgcaagtccagccagtagttcttttgtcagctacaagaatatgtagttcgttagcttggaccagcaagaaagcacgacacgtaccccttaagtcgcttactatttagtcgtctatcgtacgtcggggtcgtcccggggtccngtaccngtcagtcgacagcgtatcgngggactagtactttcacctctcgaaccctatcagccagtccctgacacgactagaaagngttaggtgtactagtttacgtactggtacagtactaaattagttaagtggttacgttccgtcggtctacttacggttacggacgggtacggtaaccgagggtaacggaagtacgtacgaaacggtcgtaacgtgtaccggg

SEQ ID NO: 300043 - DNA, 632 bp, Homo sapiens
  misc_feature: GZ8MTXP02HFUR9.38.23.C01.1.454.CMB.2.raw
  modified_base (205)..(205): a, c, t, g, unknown or other
  misc_feature (205)..(205): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcttgggttttccttgttgctattttagaaggtgtcagtgtgaggtgcagttggnggaatcgtgggggtaaacttggtccagccgtgggggtcctgagctctctgtgcagcctctggtattcattatttagaatcattgatgtagttgggtccgcaggctccgaggggacgggctggaggtgggtgccactaataaacccgagacgtagaactaagaaaacgctaagtgtcggacttcgtaggtaggaaacggccgaaactttcccaccgttcacccgaagaacgaacaaaccgacctaaaagaacttacctaactagttactttagaaaccaaattacgaaactacgaccgtagaacgtaggacgaaaacgtaccgacggaacctaataaagtttaacttaagttggttaaacgtaaaaaggcttaactattacggaattgtagggttacggacggtaacgggtagggtacggacgttacg

SEQ ID NO: 300044 - DNA, 568 bp, Homo sapiens
  misc_feature: GZ8MTXP02I5LZN.38.23.C01.1.454.CMB.2.raw
  modified_base (265)..(265): a, c, t, g, unknown or other
  misc_feature (265)..(265): n is a, c, g, or t
  modified_base (301)..(301): a, c, t, g, unknown or other
  misc_feature (301)..(301): n is a, c, g, or t
  modified_base (317)..(317): a, c, t, g, unknown or other
  misc_feature (317)..(317): n is a, c, g, or t
  modified_base (340)..(340): a, c, t, g, unknown or other
  misc_feature (340)..(340): n is a, c, g, or t
  modified_base (344)..(344): a, c, t, g, unknown or other
  misc_feature (344)..(344): n is a, c, g, or t
  modified_base (359)..(359): a, c, t, g, unknown or other
  misc_feature (359)..(359): n is a, c, g, or t
  modified_base (459)..(459): a, c, t, g, unknown or other
  misc_feature (459)..(459): n is a, c, g, or t
  modified_base (516)..(516): a, c, t, g, unknown or other
  misc_feature (516)..(516): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaacttggtccagccgtgggggtccctgaagctctcctgtgcagcctntggattcatattagaatcattggatgagttggtccncgagctcgagggcggntggagtgggtgccactataaacncganggaactagaaaaacnctatgtgggactcgtggtagaacggggctagttccgaaccgtctaccagacgacaacgaccgaaagtaacttcaactgtactttagactaaaatgaaacncgaccgtagacgagtacgaaagacgacgacaatattaacttattagtaagtaaaatntactaagttcaattaagtaggtaggccgtaacgggtaccggtaggacttaag

SEQ ID NO: 300045 - DNA, 656 bp, Homo sapiens
  misc_feature: GZ8MTXP02HKU7J.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccaggccgtgggggtccctgaagctctcctgtgcagccctctggattcatattagtaatcattggatgagttggtccgcgaggctcgaggggacgggcgtggacggtgggtaggccctaacgtaactaaaacccgacggaagtagggaaaccgtaagaaaaaagtacgttaagtggtacgggtaccttacgttggtagggaaacggggtccgtaagttcccgaccgtctcccgaagacgaacaaccgaccaaaggaaattccaactgtatttagaactaaatagaaacacgaccgtagagtaacgtacggaaacgacgaccgggacctaaataacttaaagtttagttaggtaaacgttaaaaagtctaactacgttagtaagttaaggtagggtacggtacgggtacggttacgggtacggtacgtag

SEQ ID NO: 300046 - DNA, 581 bp, Homo sapiens
  misc_feature: GZ8MTXP02ICY3R.38.23.C01.1.454.CMB.2.raw
  modified_base (414)..(414): a, c, t, g, unknown or other
  misc_feature (414)..(414): n is a, c, g, or t
  modified_base (424)..(424): a, c, t, g, unknown or other
  misc_feature (424)..(424): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagccgtacggggacatcgtgatgacccagtctccagactccctggctgtgtctcgtgggcgagacgggccaaccatcaactgacaagtccagccagtagttcttttgtcagctacaagaatatgagttcgtagtcttggtaccagacaagaaagcaacgacacgtacccctaagtgctactatttatgtcatctacgtcgggtgtcccccggggtacctggacgtattcgagtcggcaggcggatcgtggggacagtacttacactctaccacctancagcacgccngacaagacgtagaagtagttggtacggtacgtaagtttatacgttcgtacaacgtactaaattagttaagttcgttacgttccgtcgtccttacgttacgttccgggacggaacgggtaacggtaaggtacggagaacgtacgaaacggtacgaacg

SEQ ID NO: 300047 - DNA, 538 bp, Homo sapiens
  misc_feature: GZ8MTXP02FW3VD.38.23.C01.1.454.CMB.2.raw
  modified_base (349)..(349): a, c, t, g, unknown or other
  misc_feature (349)..(349): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttcctgttgctattttagaaggtgtccagtgtgaggtgcagttggtggaatcgtgggggaaacttggtccagccgtggggggtccctgaagctctcctgtgcagcctctggattcatatttagtaatcattggatgagttgggtccgcaggctccgagggacggggctggagtgggtggccatataaaccncgatggaactagaaaaagctaatgtggactctgtgaagggccattcacgtctccagagacaacgccaagaatcactgtatttgacaaatgaaacagacctgacgagtacgaagacacggaccattataattattagtagtaaaaagatacgaattcgaataagtggtggacgacggtacgggtggctag

SEQ ID NO: 300048 - DNA, 571 bp, Homo sapiens
  misc_feature: GZ8MTXP02GX4D4.38.23.C01.1.454.CMB.2.raw
  modified_base (306)..(306): a, c, t, g, unknown or other
  misc_feature (306)..(306): n is a, c, g, or t
  modified_base (491)..(491): a, c, t, g, unknown or other
  misc_feature (491)..(491): n is a, c, g, or t
  modified_base (527)..(527): a, c, t, g, unknown or other
  misc_feature (527)..(527): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcttgggttttccttgttgctattttagaaggtgtccagtgtgaggtgcagttggtggaatcgtagggggtaaacttggtccaggccgtgggggtccctgaagctctctgtgcagcctctggattcattatttagtatcattgatgagttggtccncgaggctcgaggggacggctggagtgggtgccaatactaaaccgagaacgttagggaaactaaggaaaaactcgtagtggtcggactcgtaggtacgaacgggcctattccgacccgtctaccgagacgacaacgtacaagaactcactgtattagactaaatgaacagcgtagagtagacgaanacgacgacataagttattagttagtaaagtaaaatntactactagtagtaagtggacgacgtacggtacggtcgtactcg

SEQ ID NO: 300049 - DNA, 592 bp, Homo sapiens
  misc_feature: GZ8MTXP02IP8EL.38.23.C01.1.454.CMB.2.raw
  modified_base (381)..(381): a, c, t, g, unknown or other
  misc_feature (381)..(381): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtcagtgtgaggtgcagttggtggaatctgggggaaacttggtccagccgtgggggtcctgaagctctcctgtgcagctctggatcatattagaatcattgatgagttggtccgcagctccgagggacgggctggagtgggtcggaccaacgtaataaaaccgagatagggaaactagaaaaaagataagtgtggactntaggtagaaacgggccgtaattccaaccgttcaccgaagacggaacaaacgaccgaaagtaattccaactagttagtttaagaactaaataacgtaacgacgacgtagagacgacgaacgacgacgacgtaataattaattagttagtaagtaaagtaactactactatagtaagtaggtacggtacggtacggtacggtacggtacgtag

SEQ ID NO: 300050 - DNA, 587 bp, Homo sapiens
  misc_feature: GZ8MTXP02HKYAC.38.23.C01.1.454.CMB.2.raw
  modified_base (548)..(548): a, c, t, g, unknown or other
  misc_feature (548)..(548): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattgggctgagctgggttttccttgttgctattttagagtgtcagtgtgaggtgcagttggtggaatcgtagggggaaacttggtccaggccgtgggggtccctgaagctctcctgtgcagcctctggattcattatttagtaatcattggatgaggttggtccgcaggctcgaggggacggggcgtggagggtgggtggaccctacgtaactaaaaccacggagtaggaaacctaagaaaaagactaagtgtggactcgtaggtaggaacgggtccgtaattcccgaacccgttctacccgaaggacgaaccaaacccggaccaaagtaacttacgactagtatttagactaaagtgaacagcctagagagtacgaagacacgactatataattatgtaataaaagtntactatgagtgtggtcggacgtacggtacggtacgatag

SEQ ID NO: 300051 - DNA, 750 bp, Homo sapiens
  misc_feature: GZ8MTXP02HL2HS.38.23.C01.1.454.CMB.2.raw
tcagtcgatcacgtcacgaccggtgctcgatttagtacacgtgattagggagttgggggtctcagagaggagccttagccctggactccaaggcctttgcacttggtgatcagcactgagcacagaggactcaccatggaattggggctgagcttgggttttccttgttgctattttagaaggtgtccagtgtgaggtgcgtagttggtggatcgtggggaaacttggtccagccgtcgggggtccctgacgctctctgtgcacgtcctcgtggtattcattattaagtaatcgtagttggatggtacggttgggtaccgccgtaggtcctccggaggggaccggggtactaggggtagggtcggggtcggacctaacgtaacgtaaaccgacgtaacgtacggaaaactaagaaaaacgtacttaagtcggtcggtaacgttcgtaggttacgggaacggggtaccgtaacgtttacccgaacccggttctaacccgaagggtaaccaaacgaaacccggacttaaaaggtaaaccttaccgaacgtttagttaattttacgaaccgttaaaagttgaaaaccgtacgtcgttaaaccgaggagttaaacccggaaagaccgtaaccggccaaaagtttaacttattttaacgttagttaaaacggtaaaaagtctaacttacgttaacgaagtttaaccggttgggtaaccggttaacggtcggggttacggtacgttaagtttccgg

SEQ ID NO: 300052 - DNA, 631 bp, Homo sapiens
  misc_feature: GZ8MTXP02HZVCD.38.23.C01.1.454.CMB.2.raw
  modified_base (415)..(415): a, c, t, g, unknown or other
  misc_feature (415)..(415): n is a, c, g, or t
  modified_base (466)..(466): a, c, t, g, unknown or other
  misc_feature (466)..(466): n is a, c, g, or t
  modified_base (524)..(524): a, c, t, g, unknown or other
  misc_feature (524)..(524): n is a, c, g, or t
  modified_base (590)..(590): a, c, t, g, unknown or other
  misc_feature (590)..(590): n is a, c, g, or t
tcagtcgatcacgtcacgaccggtgctcgatttagtacacgtgattaggggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtagggggaaacttggtccagccgtgggggtccctgagctctcctgtgcagcctcgtggattcattatttaagtaatcagttggatggtaggtttgggtcccgccgaggtccgtaccgaggggacggggcgtggggaggtggggtcgccaacgtaacaaaaccgacgaagtacggaaactaaaggaaaaacgactagttaggngggtactcgtaggtaggaacgggcctaacttccacccgtctacgacggaanaaccaacgaaccaaagtacttacaaccttgttaattgtaacaaatagtaacagtaccngaagaggtacgaacgacgaccggactaagtattattattaggaaacgtaaaagtactatacgttanattaaggtggtacggcggaacggttagggtccgtacttagg

SEQ ID NO: 300053 - DNA, 700 bp, Homo sapiens
  misc_feature: GZ8MTXP02IJ51V.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcttgggttttccttgttgcttattttagaaggtgtccagtgtgagtgcagttggtggaatcgtagggggaaacttggtccagccgtgggggtccctgaagctctcctgtgcacgcctctggtatcattatttagtaatcagttggatgtaggttggtccgcgagctccgaggggacggggcgtggagggtgggtcgacctaactaagtaaaaccgacgtacgtaggaaacctagaaaaagtactagtaggtcgtaccgtagtagtaggaacgggccgtatttcccgaccgttcccgtaccgaacggacgaaaccaaaccgacccgaaaaggttaaacttaccgtaaccgttaggtttaattttacggaacctaaaatacggtaaaaccacgtacccgttaaggaagtacggtaaccggaaaagaccggaacggtacccgtaataagttaactttaagtttagtaaaacgttaaaagtacttacgttaattacgtaagttaagttgggtacggacggtaaacgggttccggggtaggtaccgtttaacgg

SEQ ID NO: 300054 - DNA, 692 bp, Homo sapiens
  misc_feature: GZ8MTXP02HCRXN.38.23.C01.1.454.CMB.2.raw
  modified_base (286)..(286): a, c, t, g, unknown or other
  misc_feature (286)..(286): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggtttccttgttgctatttagaggtgtccagtgtgaggtgcgtagttggtggaatcgtagggggtaaacttggtccagccgtggggggtccctgagctctctgtgcagcctctggtattcattatttagatnattggatgagtttggccgcgaggctcgaggggacggtcgtgggaggtggggtcgcctaactaacgaaacgacgacgtaggaactagaaaaagctatgtgacttcgtaggtaggaacgggccgtacttcccgaccgttctacccgaagacgaaccgaaccgacctaaagtaacttctaacttaggttaatttacggaaacctaaaagtacggaaacctacgtacccggtaaggtaacgacgggttaacggaaaacggaaccgtaacccgggtactaatttaactttaaacgtttaaagttttaaaggtaaagtaaaaaacggttacttaacgttaagttacgtaaaggttaacggttacgggggtacggtacgggttaacggggtacggggttacggtacgtttacg

SEQ ID NO: 300055 - DNA, 594 bp, Homo sapiens
  misc_feature: GZ8MTXP02JEBVP.38.23.C01.1.454.CMB.2.raw
  modified_base (386)..(386): a, c, t, g, unknown or other
  misc_feature (386)..(386): n is a, c, g, or t
tcagtcgatcacgtcacgaccggtgctcgatttagtacacgtgattagggattggggacaacaggcaggcaggggcagcaagatggtgttgcagacccaggtcttcatttctctgttgttctggatctctggagcctacggggacatcgtgatgacccagtctccagacctccctggctgtgtctcgtgggcgagacgggccaccatcaactgcaagtccagccagagttcttttgtcagctacaaagaatatgtagttcgtagctaggtaccagacaagaaagcaacgacacgtacccctaagttcgctactatttatggtctacttctacgttcgggtcggtcccgggtcctggaccccgtagttcgaggcggcgacggacggntcgtaggactagtactttacgactctaccaccgtactcgacgcacgtacctcggaccagtacgtaagaagtagtaggtacggtactttacgtttaaattacgtgtacgagtactaattagttagtaggtactcgtacgtctacgtacggttacggacggacggtaacgtagggtgaacggtacacgtacgacgtaagtcggtacgacg

SEQ ID NO: 300056 - DNA, 596 bp, Homo sapiens
  misc_feature: GZ8MTXP02IU6ON.38.23.C01.1.454.CMB.2.raw
  modified_base (482)..(482): a, c, t, g, unknown or other
  misc_feature (482)..(482): n is a, c, g, or t
  modified_base (542)..(542): a, c, t, g, unknown or other
  misc_feature (542)..(542): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattgggctgagctgggttttccttgttgctattttagaaggtgtccagtgtgaggtgcagttggtggaatcgtgggggaaacttggtccagccgtggggggtccctgagctctcctgtgcagcctcgtggtattcattatttaagtaatctattggatgtagttgggtccgccgaggctaccggaggggacggggcgtgggaggtcggggtggacctaactaagtaaaaccacgtatacggaaactagaaaaagtctaagtgtcgggacttcgtaggtagaacgggtcgtattccaccgtctaccgagacgacaacgacaagatcactagtattgaactaaanagaacagacctagacgagtacgaagacacggactagtattattagttagtaaagtaaaanacgttacaacttacgattaagtggtacggacggtacggtagggtcgtacgttag

SEQ ID NO: 300057 - DNA, 591 bp, Homo sapiens
  misc_feature: GZ8MTXP02HUH1A.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtgaatcgtgggggaaacttggtccagccgtgggggtccctgagctctcctgtgcagcctctggattcattatttaagtaatcaattggatgagtttgggtcccgccaggctccgaggggacggggcgtggaggtggggtcggccaactaactaaaccgacgactaggaaactagaaaaacgactagtgtggacttcgtgtagaagggggcccgtaattcccaccgtctccgagaagaaccaaacgccaaagaattcactagtattgacaaatgaacagcctagagagtcgaaagacgaggcctaagtaattattaatttgtaagtaaaagtatacgtattcgaattaagtacgggtacggacggtacggtacgggtcggtacgttag

SEQ ID NO: 300058 - DNA, 563 bp, Homo sapiens
  misc_feature: GZ8MTXP02IM3AH.38.23.C01.1.454.CMB.2.raw
  modified_base (357)..(357): a, c, t, g, unknown or other
  misc_feature (357)..(357): n is a, c, g, or t
  modified_base (376)..(376): a, c, t, g, unknown or other
  misc_feature (376)..(376): n is a, c, g, or t
  modified_base (381)..(381): a, c, t, g, unknown or other
  misc_feature (381)..(381): n is a, c, g, or t
  modified_base (385)..(385): a, c, t, g, unknown or other
  misc_feature (385)..(385): n is a, c, g, or t
  modified_base (389)..(389): a, c, t, g, unknown or other
  misc_feature (389)..(389): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgacaagtccagccagtagttcttttgtcagtcctaccaaagaatatgtagttcgtagtcttggtaccagacaagaaagcacgacacgtacccctaagtcgctctatttatgtctatctacgtcgggtcgtcccgggtcctcgaccgtnttcgagcgcagcggatcgnggganagtnttcnctctcacatcagcagcctagacagacgtagaaagtacgtgtaggtacttaaggttttattacgtgtacagtactaaattattagtaggtacttccgtacggtctacgtacggttccgggcgggtaacggtaccgtaaggggtgaacgtagtaccgaagtcccgtaagtggtacg

SEQ ID NO: 300059 - DNA, 603 bp, Homo sapiens
  misc_feature: GZ8MTXP02H47M6.38.23.C01.1.454.CMB.2.raw
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctctgggcgagagggccacatcaactgcaagtccagccagagtcttttgtcagctacaagatatgagttcgtagcttggtaccagcaagaaagcacgacacgtccctaagtgctcatttatgtcatctacgtcggtgtccggggtcctgaccgattcagtcgcagcggactcgtagggacagtctttcactctcacatcagcacgccctgacaagtactagaaacgtattacggtggtacttaaggttttaacttacgtacggttaccaaaggtactaaaattaactttagtacgggttaaccgttccgtaccggttacttaccgttaacggtttccggggaacgggaacggggtaacccaaagggggttcggaaacgtaacgtaccggaaaacggtacccggtaaacgtttagggtccgg

SEQ ID NO: 300060 - DNA, 591 bp, Homo sapiens
  misc_feature: GZ8MTXP02HWPTK.38.23.C01.1.454.CMB.2.raw
  modified_base (377)..(377): a, c, t, g, unknown or other
  misc_feature (377)..(377): n is a, c, g, or t
  modified_base (436)..(436): a, c, t, g, unknown or other
  misc_feature (436)..(436): n is a, c, g, or t
tcagtcgatcacgtcacgaccggtgctcgatttagtacacgtgattagggattggggacaacaggcaggcaggggcagcaagatggtgttgcagacccaggtcttcattttctctgttgctctggatctctggagcctacggggacatcgtgatgacccagtctccagactccctggctgtgtctctgggcgagaggccaccatcaactgacaagtccagccagtagtcttttgtcagctacaagatatgtagttcgtagcttggaccagcagaagcacgacacgtacccctaagtgactctatttatggtactattcgtacgtcgggttcgtccggggtccctgacccgtattcgaggcggcgtaggcgtatcggngggactagtactttcactcctacacctagtcacgcacgcctgacagactagagagtcgnggtacttagtttatatgtacagtactaattagttagtggttaacgtccgttcgggtaccttacgttaccgggtttacgggaccggggaacgggttacccggaaaggggttggaacgtaacgtaaccggaaggtaccggtaacgttacggtccggg

SEQ ID NO: 300061 - DNA, 520 bp, Homo sapiens
  misc_feature: GZ8MTXP02FGWNQ.38.23.C01.1.454.CMB.2.raw
  modified_base (303)..(303): a, c, t, g, unknown or other
  misc_feature (303)..(303): n is a, c, g, or t
  modified_base (350)..(350): a, c, t, g, unknown or other
  misc_feature (350)..(350): n is a, c, g, or t
  modified_base (441)..(441): a, c, t, g, unknown or other
  misc_feature (441)..(441): n is a, c, g, or t
  modified_base (486)..(486): a, c, t, g, unknown or other
  misc_feature (486)..(486): n is a, c, g, or t
  modified_base (499)..(499): a, c, t, g, unknown or other
  misc_feature (499)..(499): n is a, c, g, or t
  modified_base (515)..(515): a, c, t, g, unknown or other
  misc_feature (515)..(515): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttcctgttgctattttagaaggtgtccagtgtgaggtgcagttggtggaatctgggggaaacttggtccagcctggggggtccctgaagctctcctgtgcagcctctggattcatattagtaatcattggatgagtttgggtccncaggctccgaggggacggggctgggagtgggtggccactataaaccncgatggaactgaaaagctatgtgactctgtgaaggcgattcaccgtctccagacgacaacgccaagaattcactgtattgacaaatgaacngcctgagagtcgaagacacggaccatatattattgtagtaaaagntacatcgataagnggtcgcgacgtacggngctag

SEQ ID NO: 300062 - DNA, 542 bp, Homo sapiens
  misc_feature: GZ8MTXP02HQECU.38.23.C01.1.454.CMB.2.raw
  modified_base (495)..(495): a, c, t, g, unknown or other
  misc_feature (495)..(495): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttcctgttgctattttagaaggtgtccagtgtgaggtgcagttggtggaatctgggggaaacttggtccagcctgggggtccctgagctctcctgtgcagcctctggattcattattagtaatcattggatgagttggtccgcgaggctccgagggacgggctggagtggggtgccactataaaccacgataggaactgaaaaagctatgtgactcgtgtgaagggccgattccaccgtctaccgagagacaacgccaaagattcactgtattagacaaatgaaacagacctagagacgtacgaagacgacggcaatattatattgaagtaaaacgntacatttacgagttaagtggtacgacggtacggtacgggtgtactag

SEQ ID NO: 300063 - DNA, 596 bp, Homo sapiens
  misc_feature: GZ8MTXP02FX2YQ.38.23.C01.1.454.CMB.2.raw
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagactccctggctgtgtctcgtgggcgagagggccaccatcaactgcaagtccagccagtagttcttttgttcagctaccaagaatatgtagttcgtagcttcggtaccagcaagaaagcacgacacgtcccctaaagtcgctactatttatggtctatctacgtcgggtcgtccggggtcctagaccgtatcgagcgcagcgatcggtgggacagtactttcactctcaccctatacagcacgccgtgacagaacgtgaaagtagttggtacggacgttaaggttttaattacgtacgtacgaagacttaaagttatttagtcgggttaacgtcccgttcggtaccttaccggtaacgtttccggggaccgggtaacgggtaaccgtaaagggtcggaagtacgtacgaaggtaccgtaagtcggtacgg

SEQ ID NO: 300064 - DNA, 684 bp, Homo sapiens
  misc_feature: GZ8MTXP02JAFSR.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcgttgggttttccttgttgcttattttagaaggtgtccagtgtgaggtgctaggttggtggaatcggtagggggtaaacttggtccgaggccggtcggggggtcccctaggaacgtcctccgtccgtgtcgcacgtccctcgtggtattcattatttaagtaatctagttggatggtaggtttcgggtccgccgacggccgtaccggaggggacggggcgtgggagggtggggtcggacctaactaacgtaaaccgacgaacgtaggaaactaagaaaaacgtctagtgtcggacttcgtaggtaggaacggggtcctagttacccgaccgtcctacccgaagaacgaaccaaccgaccaaacgtaattaccaagttgttaatttacgaactaaagtacgaaaccacgtcgtaagacgtacggtaacgaaacgacgaaccgactaattaattattattaggtaaagtaaaatctactacgttagaagttcggtagggtacggtacggtaaacgggttcgggtcgtacgtttag

SEQ ID NO: 300065 - DNA, 691 bp, Homo sapiens
  misc_feature: GZ8MTXP02FKEWF.38.23.C01.1.454.CMB.2.raw
  modified_base (306)..(306): a, c, t, g, unknown or other
  misc_feature (306)..(306): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagccgtggggggtccctgaagctctcctgtgcagccctctggattcatatttagtatcattggatgagtttgggtccncgaggctccgaggggacggggcgtggggaggtggggtgggacccaactaagtaaaaccacggaatagggaaactagaaaaaagactatggttcgggactcgtaggttaggaaacggggtccgaattcccaacccgtcttaccccgaaagaacgaaacccgaaaaccggcccaaaaggtaaacttacaaccttaggttaacttttaggaccaaaagttacggaaacaacgggtacctaggaagaaggtacggaaaaggaaccaacggaccaaataattaagtttaaagtttaggtaaagttaaaaaaagaccttactaaagtttacggaattaagttaggggttagggacggtaacggggtttaaccgggggtgggtaacttaagg

SEQ ID NO: 300066 - DNA, 644 bp, Homo sapiens
  misc_feature: GZ8MTXP02HI47P.38.23.C01.1.454.CMB.2.raw
  modified_base (263)..(263): a, c, t, g, unknown or other
  misc_feature (263)..(263): n is a, c, g, or t
  modified_base (634)..(634): a, c, t, g, unknown or other
  misc_feature (634)..(634): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcgttgggttttccttgttgctattttagaaggtgtccagtgtgaggtgcaggttggtggaatcgtagggggaaacttggtccagccgtgggggtccctgaagctctcctgtncacgcctctggtatctattatttagtaattcattggatgtaggttcggtccgccgaggcctccggaggggacggggcgtggaggtggggtcggacctactaagtaaacccgagacgtacggaaactaaggaaaaaagtacttagtaggtggtaccttgttaggtaggaaacggggccgtaagtttccgacccgttctacccgaagacgaaacgaaccgaacccgaaagtaacttctacgttattacgtttacgactaaaataggaacacgccgtagaagtacgacgaaacgacgaccggactattaattacgttattagtaaataaagtacttactattacgtataagtgggtacggacgtaggtacgggngactttacgg

SEQ ID NO: 300067 - DNA, 620 bp, Homo sapiens
  misc_feature: GZ8MTXP02F4P1V.38.23.C01.1.454.CMB.2.raw
  modified_base (305)..(305): a, c, t, g, unknown or other
  misc_feature (305)..(305): n is a, c, g, or t
  modified_base (350)..(350): a, c, t, g, unknown or other
  misc_feature (350)..(350): n is a, c, g, or t
  modified_base (471)..(471): a, c, t, g, unknown or other
  misc_feature (471)..(471): n is a, c, g, or t
  modified_base (607)..(607): a, c, t, g, unknown or other
  misc_feature (607)..(607): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtagggggaaacttggtccagccgtgggggtccctgaagctctcctgtgcagcctctggatcatatttagaatcattggatggagtttgggccnccgaggctcgaggggacgggctgggaggtgggtggcccaactaanaaaccgacgagtaggaactaagaaaaagactagtgtgactcgtgtaggaaggcgtattccaaccgtctaccgagaacgactaacgaccaaagtaattacacttagtatttaggaactaaanacggtaacacgtaccgtagaagacgtacgaaagaacgacggtaccaattattaattagtttaagtaacgttaaaaagacttacgtaagttacgtaagttaagttacgggtacggacggtaaccggttaacgggggngtaccgtttacgg

SEQ ID NO: 300068 - DNA, 719 bp, Homo sapiens
  misc_feature: GZ8MTXP02JZ20N.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcttgggttttccttgttgctattttagaaggtgtccagtgtgaggtgcaggttggtggaatcgtagggggaaacttggtccaggtccggtggggggtccctgaacgctctcctgtcgcacgcctcgtggtattcaattatttagaattctattggatggtaggttcgggtccgccgaggtcctccggaggggacggggtctggggtaggtcggggtcggacctaacgtaacaaaaccgacgaacgtacggaaactaaggaaaaaagtctagtggtcggactcgtaggtaggaacggggtcctaattcccaacccgttcctaccgaacgacgaaccgaaccgacaaagtaacttacaacgttagtttaactttacggaaactaaagtacgaaacgacggtaccgtaggaaacgtacggtaaaccggaaacgaacccgtaacggtaacctaaatttaagttaatttaaacggtttaagtaaacgtaaaaagttcttaaactacgtttaagtagttaacggttaggggtacgggtaccgggtacggttacgggggttacgacgtttaacgg

SEQ ID NO: 300069 - DNA, 649 bp, Homo sapiens
  misc_feature: GZ8MTXP02GOJD1.38.23.C01.1.454.CMB.2.raw
  modified_base (596)..(596): a, c, t, g, unknown or other
  misc_feature (596)..(596): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccaggccgtgggggtccctgagctctctgtgcagcctctggattcattatttagtaatctagttggatgtaggtttcgggtcccgccgaggccgtccgaggggacggggcgtgggaggtggggtcggcccaactaaactaaaccccgagtaacgtaggaaacctaagaaaaacgtacttagtgtgggtactcgtaggtaggaacggggaccgtacgttaccacccgtcctaccgagaacggaaccaaaccggaccaaacgtaacttaccaacttagttaactttaggaacctaaaagtcgaaacgacgtacctagaacgaggtacgaaagaccgacggacctataagttaattagttagtaacgtaaanagtactacttagataaggttggacggtacgtacgggtacggtggtactttagg

SEQ ID NO: 300070 - DNA, 594 bp, Homo sapiens
  misc_feature: GZ8MTXP02GV6TF.38.23.C01.1.454.CMB.2.raw
  modified_base (345)..(345): a, c, t, g, unknown or other
  misc_feature (345)..(345): n is a, c, g, or t
  modified_base (372)..(372): a, c, t, g, unknown or other
  misc_feature (372)..(372): n is a, c, g, or t
  modified_base (540)..(540): a, c, t, g, unknown or other
  misc_feature (540)..(540): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttcctgttgctattttagaaggtgtccagtgtgaggtgcagttggtggaatcgtgggggaaacttggtccagccgtgggggtccctgaagctctcctgtgcagcctctggattcatattagtatcattggatgagttgggtccgccaggctccgagggacggggctggaggtggggtgccacgtaanaaaccacgatacggaactaggaaaaanctatgtgactcgtagtgaagggccattccaccgtctacccgagtaagacaacgacccaaagaacttcactagtaactttaggaccaaagtacgtaaacagacctaggaagtaaggtacgaaacgacgaccggactaaacgtataattagtttaagtacgtaaaaagtntactattcgtaataagttggtcggtacggtacggtaccggggtggacgtttagg

SEQ ID NO: 300071 - DNA, 643 bp, Homo sapiens
  misc_feature: GZ8MTXP02IYZ9Q.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcttgggttttccttgttgcttattttagaaggtgtccagtgtgaggtgcagttggtggaatcgtgggggaaacttggtccagccgtgggggtccctgaagctctcctgtgcagcctctggcttcgattattagtaatcattggatggagttgggtcccgcaggcctcgaggggacgggtcgtggaggtgggtgaccactaagtaaaacccgagacgtaggaaacctaagaaaaaacgtactaagttgtaggaccttcgtaggtagaacgggaccgtattacccgaccgtctaccagaacgacaacgaccaaagtaacttcgaacttgtagtttagactaaaagtacgaaacagtaccgtagaagtagacggaaacgaacgaccgggacctaaatacttaagtttagtttaggtaaaccgttaaaagacttactaacgttacgtaagtaaggtcggttaggaccggtaccggtacggggtaggtaccttaagg

SEQ ID NO: 300072 - DNA, 558 bp, Homo sapiens
  misc_feature: GZ8MTXP02JPN74.38.23.C01.1.454.CMB.2.raw
  modified_base (262)..(262): a, c, t, g, unknown or other
  misc_feature (262)..(262): n is a, c, g, or t
  modified_base (306)..(306): a, c, t, g, unknown or other
  misc_feature (306)..(306): n is a, c, g, or t
  modified_base (378)..(378): a, c, t, g, unknown or other
  misc_feature (378)..(378): n is a, c, g, or t
  modified_base (454)..(454): a, c, t, g, unknown or other
  misc_feature (454)..(454): n is a, c, g, or t
  modified_base (462)..(462): a, c, t, g, unknown or other
  misc_feature (462)..(462): n is a, c, g, or t
  modified_base (477)..(477): a, c, t, g, unknown or other
  misc_feature (477)..(477): n is a, c, g, or t
  modified_base (553)..(553): a, c, t, g, unknown or other
  misc_feature (553)..(553): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtgggggtccctgaagctctcctgtgcancctctggattcattatttagtaatcattggatgagttgggtccncgaggctccgagggacggggctggaggtgggtggccactaagtaaaccagatacggaactagaaaagactanggtcgactcgtagtgaagggctattccaccgtctaccgagacacgaaccgacaagaacttacactgttatttaganaaatgaangactagatagacganacgacgacatattattattagtaactaaagtactacattacgattaaggtgggtaggacggtacggtacggtaggngttag

SEQ ID NO: 300073 - DNA, 806 bp, Homo sapiens
  misc_feature: GZ8MTXP02HEM8H.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcttgggttttccttgttgcttattttagaggtgtccagtgtgagtgcagttggtgaatcgtagggggaaacttggtccaggccgtgggggtccctggaagctctcgtgtcgcacgtcctcgtggtattctaattaatttagtaacttactagttggtattaggtaggtttcgggtccccgccgtagggtcccgtacccggaagggggccggggtcggtaggggtagggttcggggtacggaccctaaacgtaacgtaaaacccgagaacgtacggaaaccgtaagaaaaacgtagtaacgtggtcgtaacttcgtaggtacgggaacggggtcctacgttaccacccgtctacccgaagacgtaaaccaaccgacctaaaagtacttaccgtaattagttaagttagaactaaagtacggaaactacggttaccgaagaaggtaaacgttaaccgggaaacgtaaccggtacccggaaaccgtaagtttaaatttaacgtttaaaacggtttaggggttaaaaaccctaaaaacgggtttactttaaaacctaaacgttttacgggtaaaacgtttaagggttaccggggttaaacggggtaccccggggttaaacggggtttaaccggggacggtttaaccggttttaaccggg

SEQ ID NO: 300074 - DNA, 640 bp, Homo sapiens
  misc_feature: GZ8MTXP02GACE0.38.23.C01.1.454.CMB.2.raw
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgacaagtccagccagagttcttttgtcagctaccaagatatgagttcgttagcttggtaccagcaagaaagcaacgacacgtcccctaaagttcgaccttctattttatggtactatactacgtcgggtcgtccccggggtccctagacgtattcacggcggcgagccggtaatcgtaggggaactagtactttacactctaccaaccatcagcaacgcctgaccaggactagaaagtagtgtaggtacgttaagtttacgttacgtaggtacctaacggtactaaaatttagtttaaccgttaggttaaccgttacccggttccggtaccttaccggttaccggtttaccgggggacgggttaaaaccggggaaccggtaaacggggttacggtaaagacgttaacgaacggaccgttaaacggg

SEQ ID NO: 300075 - DNA, 586 bp, Homo sapiens
  misc_feature: GZ8MTXP02FTGDJ.38.23.C01.1.454.CMB.2.raw
  modified_base (266)..(266): a, c, t, g, unknown or other
  misc_feature (266)..(266): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtgggggtccctgaagctctcctgtgcagcctntgattcatatttagtaatcattggatgagttggtccgcaggctccgagggacggggctgggaggtgggtcggccaactaactaaaacccgacgagtagggaaactaagaaaaaagacttaagtgtggactctggtaggaacggggaccagttccaccgtctcccgagacgacaacgcaaagaattcactgtatttgacaaatcgaaacagtacctagagacgtacgaagacacggacataacgtattagttagtacgtaaaagtactacgtaattcgattaagtggtacggtaccggacggttacggggtggtacgttag

SEQ ID NO: 300076 - DNA, 686 bp, Homo sapiens
  misc_feature: GZ8MTXP02G680S.38.23.C01.1.454.CMB.2.raw
  modified_base (304)..(304): a, c, t, g, unknown or other
  misc_feature (304)..(304): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtggggggtccctgaagctctcctgtgcagcctctggattcatattagtaatcattggatgagttggtccncaggctccgagggacgggctgggagtgggtgccaatataaaccagactggaactagaaaaagctaagtgtggactcgtagtaggaaacggggccgaatttccaacccgttctacccgaaggaacgaaccgaaaccgacccaaaaggaaaactttcctaacttaggtttaattttacggaactaaaatacggtaaacacggtacccttaaggaagaacggttacgggaaacgaaccggaaccgggacccaaaagttaactttaactttaagtttaggttaaaggttaaaaaacgtattaactaaacgtttacgtaaaagttaaggttacggggttacggggacggttaaacggggtacgggggttacggggtacctttaacgg

SEQ ID NO: 300077 - DNA, 627 bp, Homo sapiens
  misc_feature: GZ8MTXP02FVMQ1.38.23.C01.1.454.CMB.2.raw
  modified_base (308)..(308): a, c, t, g, unknown or other
  misc_feature (308)..(308): n is a, c, g, or t
  modified_base (621)..(621): a, c, t, g, unknown or other
  misc_feature (621)..(621): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcaggttggtggaatcgtgggggaaacttggtccagccgtgggggtcctgagctctcctgtgcagcctctggattctattatttagaatctattggatggagttcgggtccncgaggctaccgaggggacggggctgggaggtggggtcggccctaacgtataaaaccacggtagtacggaaactaagaaaaacgtactaagtgtaggtactcgtagtacggaacgggtccgtactttccgaccgttcctaccgaagtacgaacctaaaccgaccaaacggtaaacttccgtaacttagtactttagaacctaaaagtacgaaactaggtactagaagtagacgaagacgacgtacatatacttatagtaataaaacgttaacgtatgtagtaagtcggtacggcggtaacggttaggggtactnttaagg

SEQ ID NO: 300078 - DNA, 609 bp, Homo sapiens
  misc_feature: GZ8MTXP02FL548.38.23.C01.1.454.CMB.2.raw
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctcgtgggcgagacgggccaccatcaactgacaagtccagccagtagttctttgtcagtctacaagaatatgtagttcgtagtcttggtaccagacaagaaagcaacgacacgtacccctaagtcgctactatttagtcggtacacttcgtacgtcggggtcggtccccccggggtcctggaccgtattcgaggcggcgagcgggtatcgtaggggacaggtactttcactcctcacatcagtccacgctagacagtacgtagaagtagtggtacggtactttaagtttaactacgttaggtacaagtaactaattaagttagtacgttacgtcccgtacggtacttacgtaccggtttacgggacgggtaacgggaaaccggtagggtacggaagtacgaacggtaacggacggttaacgg

SEQ ID NO: 300079 - DNA, 574 bp, Homo sapiens
  misc_feature: GZ8MTXP02JZQXE.38.23.C01.1.454.CMB.2.raw
  modified_base (304)..(304): a, c, t, g, unknown or other
  misc_feature (304)..(304): n is a, c, g, or t
  modified_base (323)..(324): a, c, t, g, unknown or other
  misc_feature (323)..(324): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttcctgttgctattttagaaggtgtccagtgtgaggtgcagttggtggaatcgtgggggaaacttggccaggccgtggggggtcccctgaagctctcctgtgcagcctcgtggattcattatttagtatcatggatgagttggccncaggctcgaggggacgggnnggaggtgggtcgccataacaaaccagagtacggaatagaaaaagctagtgcgactgtagtagaacgggcctagttccaccgtctaccagacgacaacgacaagtaacttcgactgttattacgataaagcgaactagcctagaagtacggtacgaacgacgacggactaaagtattattagtagtaacgtaaaagcttacagttacgtagtgtacgggtacggacggtacggtacgggttcgacgtttcg

SEQ ID NO: 300080 - DNA, 731 bp, Homo sapiens
  misc_feature: GZ8MTXP02IOIIU.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattgggctgagcttgggtttccttgttgctattttagaggtgtccagtgtgaggtgcgtaggttggtaggaatcggtagggggtaaacttggtccgaggccggttcggggggtccctggaacgtcttcctccgttgtcgcacgtcccttctggtacttcgatttaatttagtaatcgtagttggattggtaggtttcgggtcccgcgacggtcctaccggaggggcggggtcgtggggtagggtcggggtcgggaccctaacgttaaacgtaaaacccgacgtaagtacgggaaaacttaaggaaaaaacgtcttaagttaggtcggtacttcgtggtagggtaacgggccgtattcccgtacgtctaccgagacgacaacgacaagtactacactattattagactaaatagaacgacgtaccgagaacgtacggtacgaaacgaaccgacggtaacctaaattaacgtttaaagtttaacgtttaagtaaaaggttaaaaagctttaacgtaacgttagttaaagttaacggttacggggttaacgggtaccgggtaaacgggtttacggggtacggtacgtttaacggg

SEQ ID NO: 300081 - DNA, 616 bp, Homo sapiens
  misc_feature: GZ8MTXP02GV8FZ.38.23.C01.1.454.CMB.2.raw
  modified_base (342)..(342): a, c, t, g, unknown or other
  misc_feature (342)..(342): n is a, c, g, or t
tcagtcgatcacgtcacgaccggtgctcgatttagtacacgtgattagggagttgggggtctcagagaggagccttagccctggactccaaggcctttgcacttggtgatcagcactgagcacagaggactcaccatggaattggggctgagcttgggttttccttgttgcttattttagaggtgtccagtgtgaggtgcgtaggttggtggaatcgtagggggtaaacttcgggtccaggccgtcgggggtccctggaagtctctccgtgtgcacgcctctggtattcattattagtatctagttggatgaggttggtccgcgagcgtcgaggggcggggntacgggaggtgggtcgacctataacgtaaaccgagacgtaggaactaagaaaatctagtgtggtactgtggtagacgggctatccctaccgtctaccgagacgacaacgacaaagtactacgactagtaatttacgataaagtacgtaaacgagtacctaggaagtacggtacgaaagacctacggacctaagtaacttattagtagtaaataaaagcttactaacgttagagttaagtggtacggtacggtaccggtaggtccggtaatttcg

SEQ ID NO: 300082 - DNA, 609 bp, Homo sapiens
  misc_feature: GZ8MTXP02GI4CN.38.23.C01.1.454.CMB.2.raw
  modified_base (304)..(304): a, c, t, g, unknown or other
  misc_feature (304)..(304): n is a, c, g, or t
  modified_base (559)..(559): a, c, t, g, unknown or other
  misc_feature (559)..(559): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtggggggtccctgaagctctcctgtgcagcctctggattcatatttagaatcattggatgagttggtccncgaggctcgaggggacgggctgggaggtggggtcggacccaaacgtaactaaaaccgacgagtacgggaaacctaaggaaaaaacgtactaagtagtcgggactcgtaggtaggaaggggccgtaattccgaaccgtctacccgaagacgaacaaacgaccaaagtaaacttcactagtatttacgactaaaatagaaacacggtccaggaagtaggacgaaagacacggacataatattagtgtaaagtaaaanatctaattacgaataagtggtacggacggaacgttacggggcgtacgtag

SEQ ID NO: 300083 - DNA, 817 bp, Homo sapiens
  misc_feature: GZ8MTXP02HCL7F.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcgagttggtggaatcgtgggggaaacttggtccagccgtgggggtccctgaagctctctgtgcagcctctggattcattatttagtaatcattggattgaggtttgggtccgccgaggtcctccgaggggacgggcgtgggaggtggggtcggccgaactaataaaacccgacgtaacgtaggaaaccttaggaaaaaaacgcttaagttcgggtggtaaccttcgtggttacggtaaaggggacccgtaattccgacccgtacctacccgaagaacgaaaccgaaacccgaaccctaaacgtaaatttaccgaaccgtttaggttaacttttacggtaaacctaaaacgtttacggaaaaccgaacggtaacccccgttagggaaacggtaaccgggttaaccggaaaaacgggtaacccgtaaacccggggaacccctaaaaggtttaaaacgttaaactttttaaaagtttaaggggttaaaaacgtttaaaaaaaggtacccttttaaacgtaaaacgtttttaaccgggtaaaacgtttaaggttagggggttaaccgggggtaccgggttaaaccggggttacggggggttaccggtaaccggttttaaacggg

SEQ ID NO: 300084 - DNA, 550 bp, Homo sapiens
  misc_feature: GZ8MTXP02FF5WX.38.23.C01.1.454.CMB.2.raw
  modified_base (308)..(308): a, c, t, g, unknown or other
  misc_feature (308)..(308): n is a, c, g, or t
  modified_base (356)..(356): a, c, t, g, unknown or other
  misc_feature (356)..(356): n is a, c, g, or t
  modified_base (424)..(424): a, c, t, g, unknown or other
  misc_feature (424)..(424): n is a, c, g, or t
  modified_base (513)..(513): a, c, t, g, unknown or other
  misc_feature (513)..(513): n is a, c, g, or t
  modified_base (544)..(544): a, c, t, g, unknown or other
  misc_feature (544)..(544): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtggggggtccctggaagctctcctgtgcagccctctggattcatatttagtaatcattggatgagttgggtccnccaggctccagggacggggctggagtgggtggaccacgtataaacccngactagggaaactaggaaaaagactagtgtcgggactctgtgaaagggccgatcaccgtctccgaganacaacgccaaagaacttcactagtatttgacaaatgaaccagaccctgagagtacgaagacgacggaccaatactattatgtagaaaantacatcgataagtggtaggcgacgtacgggngactag

SEQ ID NO: 300085 - DNA, 667 bp, Homo sapiens
  misc_feature: GZ8MTXP02G4NRO.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcttgggttttccttgttgctattttagaaggtgtccagtgtgaggtgcagttggtggaatcgtgggggaaacttggtccagccgtgggggtccctggagctctcctgtgcacgcctctggattcattatttagtaatctagttggatgagtttgggtccgcgacggctccgaggggacgggcgtgggaggtggggtcgccaacgtaactaaaccgacgaagtaggaaactaagaaaaagactaagttgtggacttcgtaggtagaacggggtccgtattaccgtaacccgtctaccgaagacgaacgaaaccgacaaagaacttacaacgttcgttaatttggaactaaaagtacgaaactacgaccgtaggaaagtacggtaccggaaagaccgaaccggtacctaaaagttaatttaaatttaagtttagtaaaggttaaaaagtcttaacgtaacgttagtaagttaaggttgggtacggtacggtaccgggttacggggtgtacgtttaagg

SEQ ID NO: 300086 - DNA, 602 bp, Homo sapiens
  misc_feature: GZ8MTXP02FS2WB.38.23.C01.1.454.CMB.2.raw
  modified_base (374)..(374): a, c, t, g, unknown or other
  misc_feature (374)..(374): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctcgtgggcgagagggccacatcaactgacaagtccagccagtagttcttttgtcagctcaagatatgtagttcgttagcgttacggtaccagacaagaaagcaacgacacgttcccctaagttcgctactatttagttcggtctatcgtacgttccggggtcgtcccccggggtccctagaccgtnttacgaggcggcgacggcggtacttcgtaggggactaaggttactttaccacttacctccaacctattaccgagccacgtcccaggaccagacgtagaaagtgtgtcggtattagtttactactagtcagtactaaattgttaagttcggttacgttccgtacggtcgttaccgtacggttcggacggtaagggaaccgtaagggtggacgacgtacgacgacgtaag

SEQ ID NO: 300087 - DNA, 704 bp, Homo sapiens
  misc_feature: GZ8MTXP02GW2QO.38.23.C01.1.454.CMB.2.raw
  modified_base (260)..(260): a, c, t, g, unknown or other
  misc_feature (260)..(260): n is a, c, g, or t
  modified_base (267)..(267): a, c, t, g, unknown or other
  misc_feature (267)..(267): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgctagttggtggaatcgtgggggaaacttggtccagccggtgggggtccctgagctctcctgtncagcctntggattcattatttagaatctattggatggaggttcgggccgcgaggtcctacggacggggacggggctgggaggtggggcggccctaaataacgtaaaaccacggtagtacggaaactaagaaaaacgtactaagtagtcgggactcgtaggtacggaagggtccgtaattcccgaccgtctacccgaagtacgaacaacgaccaaagtaacttactacgttacttacgttaagtaaactaaaagtacgtaaacgacggtaccgttaaagggacgtaacggttaacgaaacggtaccgaaaccggggtacctaaagtttaaccgttaaagtttaacggtttaggtaaacgttaaaaaaggtcttacgtaaagtttacgtaagtttaagggttccggtagggtacccggtaaggggttacgggtacggacttttagg

SEQ ID NO: 300088 - DNA, 574 bp, Homo sapiens
  misc_feature: GZ8MTXP02JLW9U.38.23.C01.1.454.CMB.2.raw
  modified_base (303)..(303): a, c, t, g, unknown or other
  misc_feature (303)..(303): n is a, c, g, or t
  modified_base (350)..(350): a, c, t, g, unknown or other
  misc_feature (350)..(350): n is a, c, g, or t
  modified_base (466)..(466): a, c, t, g, unknown or other
  misc_feature (466)..(466): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggtttcctgttgctatttagaaggtgtccagtgtgaggtgcagttggtggaatcgtgggggaaacttggtccagccgtggggggtccctgaagctctcctgtgcagcctctggattcatattagtaatcattggatgagtttgggtccncaggctccgaggggacggggctggagtggggtggccactataaaccncgatggaactagaaaaagctaatgtggactcgtggtagaaggggcccgtattccgaacccgtctacccgagacgaacaacgaccaagaacttcactcgtatttgacaaatgaaacngacctagaacgagtacgaagaccacggaccaatagtattagtagtaagtaaaacgatacaattcgaaagttaagtcgggtaggcgtacggtacggggtcggactacgg

SEQ ID NO: 300089 - DNA, 558 bp, Homo sapiens
  misc_feature: GZ8MTXP02GU2HV.38.23.C01.1.454.CMB.2.raw
  modified_base (340)..(340): a, c, t, g, unknown or other
  misc_feature (340)..(340): n is a, c, g, or t
  modified_base (346)..(346): a, c, t, g, unknown or other
  misc_feature (346)..(346): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtggggggtccctgaagctctcctgtgcagcctctggattcatatttagaatcattggatgagtgggtccgcaggctcgagggacggggctggagtgggtgccatanaaaccncgataggaactagaaaaagactatgtggactctggtagaacggggccgattccgaccgtctaccgagagacaaacgaccaagtaactacactgtatttagactaaaatgaaacacgacctagaagtagacgaaagacgacggacaatatattattagtaagtaaaagtatactaatcgataagtggtacggacgtacggtacggtgacgtag

SEQ ID NO: 300090 - DNA, 573 bp, Homo sapiens
  misc_feature: GZ8MTXP02HORD6.38.23.C01.1.454.CMB.2.raw
  modified_base (266)..(266): a, c, t, g, unknown or other
  misc_feature (266)..(266): n is a, c, g, or t
  modified_base (305)..(305): a, c, t, g, unknown or other
  misc_feature (305)..(305): n is a, c, g, or t
  modified_base (346)..(346): a, c, t, g, unknown or other
  misc_feature (346)..(346): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcttgggttttccttgttgctattttagaggtgtccagtgtgaggtgcagttggtggaatcgtgggggaaacttggtccagccgtgggggtccctgagctctcctgtgcagcctcnggattcattatttagtaatcattggatgagtttggtccncaggctccgaggggcgggctggagtgggtgcatataaaccngataggaactagaaaaagctaagtgtggactctggtaggaaggggcctatttccaccgttctccgagacgaacaacgaccaaagtaacttacacttagtatttagactaaatacgaaacagtcctagagacgtacgaaagacgtacggacaataattattattaggtaataaaacgtattacacttagattaagtggtcgtacggtaggtaccgggtgtacgtttag

SEQ ID NO: 300091 - DNA, 652 bp, Homo sapiens
  misc_feature: GZ8MTXP02GSBGJ.38.23.C01.1.454.CMB.2.raw
tcagtcgatcacgtcacgaccggtgctcgatttagtacacgtgattagggattggggggtctcagagaggagccttagccctggactccaaggcctttgcacttggtgatcagcactgagcacagaggactcaccatggaattggggctgagctgggttttccttgttgctattttagaaggtgtcagtgtgaggtgcagttggtggaatcgtgggggaaacttggtccaggccgtggggggtccctgaagctctcctgtgcacgcctctggattcattatttaagatcagttggatgtaggttcggtccaccgtaggcctccgaggggaggggctgggaggtgggcggtccgaactaacgtaaaccgacgagtacggaaactaggaaaaaacgcttaagtaggtgggaacttcgtaggtaggaacggggcctacgttacctaccgttccgacctacggaacgaacgaaacctaccgaaagtaaacttcaacgttgtaatttagaactaaagtacgaaacacgccgtagaacgtaggtaccgaaacgacgaccggtacaagttaattacgttaattaggtaagttaaaacgacttacgaacttaggtataacggtggtacggtaccggtacggtaccggggtgacgtttagg

SEQ ID NO: 300092 - DNA, 574 bp, Homo sapiens
  misc_feature: GZ8MTXP02JN9DU.38.23.C01.1.454.CMB.2.raw
  modified_base (303)..(303): a, c, t, g, unknown or other
  misc_feature (303)..(303): n is a, c, g, or t
  modified_base (377)..(377): a, c, t, g, unknown or other
  misc_feature (377)..(377): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttcctgttgctattttagaaggtgtccagtgtgaggtgcagttggtggaatcgtagggggaaacttggtccaggccgtgggggtccctgaagctctctgtgcagctctggattcattattagtatcatggatgagttcgggtccncgaggctcgaggggcgggcgtggagtgggtggaccacgtataaaccgagacgtaggaactagaaaaagtctaangtgactgtggtagagggcattcaccgtctaccagacgacaaccgaccaaagaacttacacgttagtagtttacgataaaatcggaaaccaggcctagaagtacgacgaagacgacggtacataattattagttgaaagttaaaacattaccaacgttgaagtaagtggaccggtaggtaccgtaggggtcgagttgg

SEQ ID NO: 300093 - DNA, 529 bp, Homo sapiens
  misc_feature: GZ8MTXP02G2VHZ.38.23.C01.1.454.CMB.2.raw
  modified_base (456)..(456): a, c, t, g, unknown or other
  misc_feature (456)..(456): n is a, c, g, or t
  modified_base (524)..(524): a, c, t, g, unknown or other
  misc_feature (524)..(524): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgagtgcagttgtggaatctggggaaacttggtcagccgtgggggtcctgaagctctcctgtgcagcctctggatcatattagaatcattgatgagtggtcgcaggctccgaggacggctggagtgggcgccaatataaaccacgataggaactagaaaaagactatgtgactctgtagaagggcattccaaccgtctcccaagacgaacaacgaccaagaacttcaactagttatttagacaaaattcggaaacagaccagaagngacgaagacgacggaccatatagttatgtaagaaaagatacatctaataagtgcggacgagttacggngctag

SEQ ID NO: 300094 - DNA, 541 bp, Homo sapiens
  misc_feature: GZ8MTXP02HLJO0.38.23.C01.1.454.CMB.2.raw
  modified_base (301)..(301): a, c, t, g, unknown or other
  misc_feature (301)..(301): n is a, c, g, or t
  modified_base (305)..(305): a, c, t, g, unknown or other
  misc_feature (305)..(305): n is a, c, g, or t
  modified_base (312)..(312): a, c, t, g, unknown or other
  misc_feature (312)..(312): n is a, c, g, or t
  modified_base (328)..(328): a, c, t, g, unknown or other
  misc_feature (328)..(328): n is a, c, g, or t
  modified_base (346)..(346): a, c, t, g, unknown or other
  misc_feature (346)..(346): n is a, c, g, or t
  modified_base (395)..(395): a, c, t, g, unknown or other
  misc_feature (395)..(395): n is a, c, g, or t
  modified_base (400)..(400): a, c, t, g, unknown or other
  misc_feature (400)..(400): n is a, c, g, or t
  modified_base (413)..(413): a, c, t, g, unknown or other
  misc_feature (413)..(413): n is a, c, g, or t
  modified_base (446)..(446): a, c, t, g, unknown or other
  misc_feature (446)..(446): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagccgtacggggacatcgtgatgacccagtctccagactccctggctgtgtctcgtgggcgagaggccaacatacaactgacaagtccagccagagttctttgtcagctacaagaatatgagttcgtagcttggtaccagacagaaagcaacgacacgtaccctaagtnactntatttangtcatctagtcgggtntccggggtccagaccgtnttcgagcggaccagcgatcgtaggacacgtacttcacgtctacacctancgacncacgcctcgacanagagagagtagtgtattagttattactagaganaactaattaagttagtagtacgtcgtcgtctacgtacgttacggtacggaacggaacgaaggtaaggaagaacgacgaacgacgacgtacgtcgg

SEQ ID NO: 300095 - DNA, 793 bp, Homo sapiens
  misc_feature: GZ8MTXP02JZQ08.38.23.C01.1.454.CMB.2.raw
  modified_base (288)..(288): a, c, t, g, unknown or other
  misc_feature (288)..(288): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcttgggttttccttgttgcttattttagaaggtgtccagtgtgaggtgcaggttggtggaatcggtagggggtaaacttgggtaccacggccggttggggggtccctggaacgtctctcctggtgcagccctgtggnttcattattagtaatcagttggagtgtacggtttgggtcccgcgaggcctccggaggggcgggtgtggagggtgggtgccaactataaaccaggtataggaactaagaaaaatcgtagtaggtggaacttcgtagggtaggacggggtcctacgttacccgacccgtttacgtaccgacggaacggtaaacccgtaaacccggaccgtaaaacgtaacttacccgtaaccgtttaggttaattttaacggaacttaaaacgtacgtaaaccggaaccgttccgggttaaagtaaccgaacggggttaaaccgaaaacgggaacccgttaaccggggaaccttaaagttaaactttaaacgttttaaacgttaggttaaaacgtttaaaaaacgggtacgttaaacgtaacgtttaacggtaaaggttaacggggttaaccgggggtacggggttaaaccggggttaacgggggtttaccgggggttacggttaacggtttaacgg

SEQ ID NO: 300096 - DNA, 571 bp, Homo sapiens
  misc_feature: GZ8MTXP02HQXK1.38.23.C01.1.454.CMB.2.raw
  modified_base (440)..(440): a, c, t, g, unknown or other
  misc_feature (440)..(440): n is a, c, g, or t
  modified_base (451)..(451): a, c, t, g, unknown or other
  misc_feature (451)..(451): n is a, c, g, or t
  modified_base (454)..(454): a, c, t, g, unknown or other
  misc_feature (454)..(454): n is a, c, g, or t
  modified_base (472)..(472): a, c, t, g, unknown or other
  misc_feature (472)..(472): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaaactgcaaagtccagcctagagtcttttgtcagctcaagaatatgagttcgtagcttgtaccagcagaaagcacgacagtcccctaaagtgactcattttaatggtcaagtctaactcggggtgtcccccggggtcccttgacccgattcgaacgcggtccaagcgggaatccgtagggacaagattttcaactcctacaacccatacagtaccagtcccagcaagacngaaagacttgnggnagtttatattaggcaganaataataatagtagtacgtcgcgtacctacgttacggtacggacgggaaccggttaaacggaacggttacggtaaaacgtacgtaaacggaacgtaacg

SEQ ID NO: 300097 - DNA, 753 bp, Homo sapiens
  misc_feature: GZ8MTXP02I7T00.38.23.C01.1.454.CMB.2.raw
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctcgtgggcgaggagggccacatcaactgcaagtccagccagtagttcttttgtcagctacaagatatgattgtagcttaggtacagcaagaagcaacgacacgtcccctaagttcgctactatttagtcggtcatactacgtcggggtcgtacccccggggtcctacggtaaccgtgtttaccgacgggccggggtccaacgggtacccggggtattacccggggtacggggtaacccgaaagggtttacgtttttacccgaaaccgtttacccttacccgaaacccgtaacttacccgtaacggggacccaaacgggtccccctttagggaacccttaaggaaaccgtttaagggaaaaggtacggtttacggttaggggtaccttttaaaggttttaactttaaacggttcggttacctaaaaggtacctaaatttacgtttaaggttacggttaaacggttcccgtttacgggcctttaaacggtcgtttaaccggggacggtaacggggaaccgttaaaggggacggtaacgaagttacggaaaacggtaccgttaaacgg

SEQ ID NO: 300098 - DNA, 593 bp, Homo sapiens
  misc_feature: GZ8MTXP02GVZLU.38.23.C01.1.454.CMB.2.raw
  modified_base (301)..(301): a, c, t, g, unknown or other
  misc_feature (301)..(301): n is a, c, g, or t
  modified_base (344)..(344): a, c, t, g, unknown or other
  misc_feature (344)..(344): n is a, c, g, or t
  modified_base (351)..(351): a, c, t, g, unknown or other
  misc_feature (351)..(351): n is a, c, g, or t
  modified_base (472)..(472): a, c, t, g, unknown or other
  misc_feature (472)..(472): n is a, c, g, or t
  modified_base (544)..(544): a, c, t, g, unknown or other
  misc_feature (544)..(544): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcgtggttttccttgttgctattttagaaggtgtcagtgtgaggtgcagttggtggaatcgtagggggaaacttggccagccgtgggggtccctgaagctctcctgtgcacgctctggattcatattagtatcattggatgagttggtccncgaggctccgaggggcgggctggaggtggggtgaccaacgtanaaaccgngaacgtacggaaactagaaaaaagcttaagtcggtggacttacgtaggtagggaacgggcgtattccaccgtctaccgagacgacgaaacccgacgaaagacttacaccttagtagtttanactaaaagtacaacgtacgaccgtagaacggatacgaacgacgaccgacataactattattagtagtaaaangtactattacgataaggtggtacggacgaacggttcgggagtacgttag

SEQ ID NO: 300099 - DNA, 567 bp, Homo sapiens
  misc_feature: GZ8MTXP02FZFKD.38.23.C01.1.454.CMB.2.raw
  modified_base (510)..(510): a, c, t, g, unknown or other
  misc_feature (510)..(510): n is a, c, g, or t
  modified_base (558)..(558): a, c, t, g, unknown or other
  misc_feature (558)..(558): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtggggggtccctgaagctctcctgtgcagcctctggattcatatttagtaatcattggatgagttgggtccgcaggctccgaggggacggggctgggagtggggtcggccaataataaaccacgatggaaactagaaaaacgctagtgtgaatctgtgaagggccattcaccgtctccagacacaacgacccaaagtaattcactagtatttagcaaatgaacagcctagacgtagacgaagacgacgacctatatattattagtaagtaaaacgntacagttcaagttaagtaggggtacggtacggtaccggttacgggggngtacgttag

SEQ ID NO: 300100 - DNA, 639 bp, Homo sapiens
  misc_feature: GZ8MTXP02FVNL5.38.23.C01.1.454.CMB.2.raw
  modified_base (400)..(400): a, c, t, g, unknown or other
  misc_feature (400)..(400): n is a, c, g, or t
  modified_base (411)..(411): a, c, t, g, unknown or other
  misc_feature (411)..(411): n is a, c, g, or t
  modified_base (420)..(420): a, c, t, g, unknown or other
  misc_feature (420)..(420): n is a, c, g, or t
tcagtcgatcacgtcacgaccggtgctcgatttagtacacgtgattaggggattgggggtctcagagaggagccttagccctggactccaaggcctttgcacttggtgatcagcactgagcacagaggactcaccatggaattggggctgagctggttttccttgttgctatttagaaggtgtccagtgtgaggtgcagttggtggaatcgtagggggaaacttggtccagccgtgggggtccctgaagctctcctgtgcagcctctggatcattatttagatctattgatgaggtttgggtccgcaggctccgaggggacgggcgtggaggtggggtgccactaataaaccagacagtaactaagaaaatacgtagtagcggtatcgtgaggacggctntacgacccgtntacccaganaccaacgaccaagtaactactacttgttactttaggataaagtacggaaactacgtaccggttagaaacggtaacggttacgaaacggaccggacccggtaacctaagttaaatttacgtttaaagtttaggtaaacgtaaaaaggtattaacctagtttagtacgttaaggtagggtacgggtcccggtaaggttaaccgggggtagcgttttacggg

SEQ ID NO: 300101 - DNA, 591 bp, Homo sapiens
  misc_feature: GZ8MTXP02I9BPU.38.23.C01.1.454.CMB.2.raw
  modified_base (257)..(257): a, c, t, g, unknown or other
  misc_feature (257)..(257): n is a, c, g, or t
  modified_base (260)..(260): a, c, t, g, unknown or other
  misc_feature (260)..(260): n is a, c, g, or t
  modified_base (264)..(264): a, c, t, g, unknown or other
  misc_feature (264)..(264): n is a, c, g, or t
  modified_base (275)..(275): a, c, t, g, unknown or other
  misc_feature (275)..(275): n is a, c, g, or t
  modified_base (278)..(278): a, c, t, g, unknown or other
  misc_feature (278)..(278): n is a, c, g, or t
  modified_base (294)..(294): a, c, t, g, unknown or other
  misc_feature (294)..(294): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcttgggttttccttgttgctattttagaaggtgtccagtgtgaggtgcagttggtggaatcgtagggggaaacttggtccagccgtgggggtcctgagctctctgncanctgngatcatattanatnatgatgagttggtccncgaggctcggaggcgggcgtgggaggtggtcggacctaacgtaactaaaccgagtacgtaggaaactaagaaaagtactagtgcgggtactcgtagtacggaacggggcgtacgtacccgtaccgtccaccctaagacgaaccgaacgtaccaaagtaacttacgacttagtagttagaacaaatacggaactacgacgttagacgacgtacggaacgacgacggtaccattatagttattagtaagtaaaatacgtactactgaatcgtggtcggacgtaggtacggtcgacttag

SEQ ID NO: 300102 - DNA, 533 bp, Homo sapiens
  misc_feature: GZ8MTXP02JCJ51.38.23.C01.1.454.CMB.2.raw
  modified_base (205)..(205): a, c, t, g, unknown or other
  misc_feature (205)..(205): n is a, c, g, or t
  modified_base (296)..(296): a, c, t, g, unknown or other
  misc_feature (296)..(296): n is a, c, g, or t
  modified_base (313)..(313): a, c, t, g, unknown or other
  misc_feature (313)..(313): n is a, c, g, or t
  modified_base (324)..(324): a, c, t, g, unknown or other
  misc_feature (324)..(324): n is a, c, g, or t
  modified_base (328)..(328): a, c, t, g, unknown or other
  misc_feature (328)..(328): n is a, c, g, or t
  modified_base (335)..(335): a, c, t, g, unknown or other
  misc_feature (335)..(335): n is a, c, g, or t
  modified_base (351)..(351): a, c, t, g, unknown or other
  misc_feature (351)..(351): n is a, c, g, or t
  modified_base (355)..(355): a, c, t, g, unknown or other
  misc_feature (355)..(355): n is a, c, g, or t
  modified_base (396)..(396): a, c, t, g, unknown or other
  misc_feature (396)..(396): n is a, c, g, or t
  modified_base (426)..(426): a, c, t, g, unknown or other
  misc_feature (426)..(426): n is a, c, g, or t
  modified_base (483)..(483): a, c, t, g, unknown or other
  misc_feature (483)..(483): n is a, c, g, or t
tcagtcgatcacgtcacgaccggtgctcgatttagtacacgtgattagggattgggggtctcagagaggagccttagccctggactccaaggcctttgcacttggtgatcagcactgagcaccagaggactcaccatggaattggggctgagctgggttttccttgttgctatttagaaggtgtccagtgtgacgtgcagttggnggaatcgtgggggaaacttggtccagccgtgggggtccctgaagctctctgtgcagctctggattcatattagatcatgatgagttggccncaggtctcgagggcggngtggaggtggngcanataaacncgatgaactagaaaanctangtggactcgtgtgaacggggcatcaccgtctcagacacaanccaagaatcgatagtattagagaaatgaanacgactagagagtacgaagacgacgactatagttactagttgtaaaggtaaaacttntactacgtataagtaaggtacggcggtacggtacggtacggtacgcgtag

SEQ ID NO: 300103 - DNA, 601 bp, Homo sapiens
  misc_feature: GZ8MTXP02GINNU.38.23.C01.1.454.CMB.2.raw
  modified_base (300)..(300): a, c, t, g, unknown or other
  misc_feature (300)..(300): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggtttcctgttgctatttagaaggtgtccagtgtgaggtgcagttggtggaatcgtgggggaaacttggtccaggccgtgggggtccctgaagctctcctgtgcagcctctggattcatattagtaatcattgatgagttggtccncgagcgtcgagggcgggctggaggtgggtgccactaataaaccgacgagtagaactagaaaaagactaagttggtgtactcgtaggtagaacgggccgattccgacccgtctaccgagaacgacgaaccgaccaaagtagttactactagttaatttaggaactaaagtagaaacagaccgttagaagagtacggaaacgacgacggaccattattaattagttagtaaacgtaaagactactaacgttagtaagtaagttagggacggtacggaacgggtacgggtcggtacgtttaagg

SEQ ID NO: 300104 - DNA, 650 bp, Homo sapiens
  misc_feature: GZ8MTXP02I0IK1.38.23.C01.1.454.CMB.2.raw
  modified_base (285)..(285): a, c, t, g, unknown or other
  misc_feature (285)..(285): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcttgggttttccttgttgctattttagaagggtgtccagtgtgaggtgcagttggtggaatcgtggggaacttggtccagccgtgggggtcctgaagctctcctgtgcagcctctggtatcattattagtaatnagttgatgtaggttcgggtccgcaggccgtaccgaggggcggggtacgtggaggtggggtccggcctaactaacgtaaaccgacgaagtaggaaacctaagaaaaaacgtacttagtagtcgggtacctcgttagggtacggaacggggtccgtacttacccgaccgttccgtacccgaagaacgaacccgaaacgaccaaacgtaacttacctaacttgttaagtttacgaaactaaagtacgtaacgacgtacgtagaagaacgtacggaaacgacgacggtactaaagtattaagttattagaagtaaaagacttcacttagtatgtaggtacggtaccgtagggtacggtggtacgtttag

SEQ ID NO: 300105 - DNA, 575 bp, Homo sapiens
  misc_feature: GZ8MTXP02ITB0M.38.23.C01.1.454.CMB.2.raw
  modified_base (463)..(463): a, c, t, g, unknown or other
  misc_feature (463)..(463): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtgggggtccctgagctctcctgtgcagcctctggattcattatttagtaatctattggatgagttgggtccgcgaggctccgaggggacgggcgtgggaggtgggtggcccaacgtacaaaaccgacgatacggaactagaaaaagctagtgtggactctgtagacgggcattccaccgtctacagacgacaacgacaaagactacactagtactttgactaaatgaanacgccgtagagacgtacgaagacgacgacatacttattagttagtaagtaaaagcttactagttacgaagttaagtgggtacggtacgtacggtaccgggttggactttagg

SEQ ID NO: 300106 - DNA, 708 bp, Homo sapiens
  misc_feature: GZ8MTXP02IQ4L4.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcttgggttttccttgttgctattttagaaggtgtcagtgtgaggtgcagttggtggaatcgtggggaaacttggtccagccgtgggggtccctgaagctctctgtgcacgcctcgtggtattcattatttaagtaatctaagttggatgtagtttagggtcccgcgaggtctccggaaggggaccgggtcgtgggaggtgggtcggcctaacgtaacaaaaccgacgaataggaaactaagtaaaaacgacgttaagtcgtagggtaacttcgtaggttacggaaacggggtccgtaagtttacccgaacccgtcttacccgaaagaaaccgaaccaaaacccgtaacccgaaaataaaccgttacgtaaaccttggttaaatttaccgaacgtaaaacttagaaaccgtagtacccgttaaggaacgacggttacggaaacgaaccgtacggacctaaatatttaattagttaagtaagtaaaaacgtacttactaacgttaactagttaagttggtaacggtcggtaacggttaccgggttagtacgtttaacgg

SEQ ID NO: 300107 - DNA, 656 bp, Homo sapiens
  misc_feature: GZ8MTXP02JKN6G.38.23.C01.1.454.CMB.2.raw
tcagtcgatcacgtcacgaccggtgctcgatttagtacacgtgattagggattggggacaacaggcaggcaggggcagcaagatggtgttgcagacccaggtcttcatttctctgttgctctggatctctggagccgtacggggacatcgtgatcgacccagtctccagacctccctggctgtcgtctcgtggcgagacggccacatcaacgtgacaacgtccagccagtacgttcttttgtcagacctacgaaagtaatagtgtagttcgtagtcttacggtaccagacaagaaacgcgaacgactacgtccccttaaagtctccttactagttttacgtcggtactacgttccgttaccggtcggggtccggtaccccggggttccctacggaccgtagttccgacgggtccggacgacggtcgggtactcggggtaggaactacggtactttccaaccgttctaaccgacctagtaccagtaccacgcccgtagaaccgaagtaccgtaggtaaacgtgttcggtagttacttaaggtttacttacgttcgacgacgtaataagttagtagtacggtacctccgtacgcttaacgtcggttcggaacggacggtacgtaggtaacgacgtagtacgagtaccgtacgtgtacg

SEQ ID NO: 300108 - DNA, 625 bp, Homo sapiens
  misc_feature: GZ8MTXP02FTEK0.38.23.C01.1.454.CMB.2.raw
  modified_base (313)..(313): a, c, t, g, unknown or other
  misc_feature (313)..(313): n is a, c, g, or t
  modified_base (322)..(322): a, c, t, g, unknown or other
  misc_feature (322)..(322): n is a, c, g, or t
  modified_base (352)..(352): a, c, t, g, unknown or other
  misc_feature (352)..(352): n is a, c, g, or t
  modified_base (364)..(364): a, c, t, g, unknown or other
  misc_feature (364)..(364): n is a, c, g, or t
  modified_base (374)..(374): a, c, t, g, unknown or other
  misc_feature (374)..(374): n is a, c, g, or t
  modified_base (392)..(392): a, c, t, g, unknown or other
  misc_feature (392)..(392): n is a, c, g, or t
tcagtcgatcacgtcacgaccggtgctcgatttagtacacgtgattagggattggggacaacaggcaggcaggggcagcaagatggtgttgcagacccaggtcttcatttctctgttgctctggatctctggagcctacggggacatcgtgatgacccagtctccagacctccctggctgtgtctcgtgggcgaggagggccaccatcaactgacaagtccagccagtagttcttttgtcagtctaccaaagaattagtgtagttcgttagcttaggtaccagacaagaaagcacgacacgtaccctaagtcnctctatttntgtcatctgtcgggcgtccggcctgacctntgagcgcagcgntcggaggacngtacttcacttcacactnacagtcacgcctgacagtacaggaaagtgtggacggtacttaggtttatacgtcgtactaagtacttaaattagttagttacggtaaccgttccgtaccggttacttacccgggtttaacggttaccgggggtaacccgggggaaaacggggtaacccggtaaaagggggttaacgaaaacggtaacgttaccggaaaacggttaccgggtaaaccggtttgggtaaacccgg

SEQ ID NO: 300109 - DNA, 827 bp, Homo sapiens
  misc_feature: GZ8MTXP02IFRXN.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaagttggggctgagtcgttgggttttccttgttgcttattttagaaggtgtccagtgtgaggtgcgtagttggtaggaatcggtagggggtaaacttggtccgacggtccggttcggggggtcccctggaacgtccttcgtccgtggtcgcgacgtcctcgtggtacttcgtaatttaagtttaagtaatctagttaggagttggtaggtttccgggtcccgaccgaggtccgtaccggacgggggtcgggtcgtagggagggttcggggtcgacctaaacgtaacgtaaaaccgaggaagtaacggaaaacgtaaggaaaaaactcgtagtagggtcgtaacctcgtaggtagggaaccggtcctacgttacccgacccgtccgtaaccgaagaaccgaaccgaaccgaacctaaagtaacttaccgtaacgttagtttacttaacgaaacgtaaaagttacgaaacctacggtaccgtaaggaagtaccgggttaaacgaaacggaaccgaacccggtaacttaaacgttaaacgtttaaagtttaaagtttaaagggtaaaacgtttaaaaacggtacctttaagttaaccgtttaacgtaaaaggtttaacgggttaacgggggttaccggggaccggggtttaaaccgggggttaacccgggtttggtaaaacggtttttccgg

SEQ ID NO: 300110 - DNA, 682 bp, Homo sapiens
  misc_feature: GZ8MTXP02IQVDV.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcttgggttttccttgttgctattttagaaggtgtccagtgtgaggtgcagttggtggaatcgtgggggaaacttggtccagccgtgggggtcctgagctctcctgtgcagcctctggtacttcattattagtatctattggatgtagttcgggtccgcgaggcctccggaggggacgggcgtggaggtggggtcgacctaacgtaactaaaccgacgtaagtaggaaactagaaaaagactagtgtggtactcgtgtaggaacgggctatttccgaccgtctaccagacgaaccgaaacgacaaagtaacttacaacgttagtaatttacgaactaaaagttacgaaaacgtacgtaccgttaaggaaagtaccggtaaacggaaacggaaccgtaaccgggaacctaaattaaagtttaactttaagtttaaggtaaacgttaaaaaagtcttaaccgtaatttaacgaagtttaaggtagggtacgggtaccggtaacggggttaccggggttaggtaccgtttaacgg

SEQ ID NO: 300111 - DNA, 666 bp, Homo sapiens
  misc_feature: GZ8MTXP02HX5L3.38.23.C01.1.454.CMB.2.raw
  modified_base (324)..(324): a, c, t, g, unknown or other
  misc_feature (324)..(324): n is a, c, g, or t
  modified_base (479)..(479): a, c, t, g, unknown or other
  misc_feature (479)..(479): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcttgggttttccttgttgctattttagaaggtgtccaggtgtgaggtgctagttggtggtaatcgtagggggaaacttggtccaggccgtgggggtccctgaagtctctcctgtgcacgtcctctggtattcattatttaagtatactattggtatggtaggttgggtacccnccgacggtcctccggaggggacggggtcgtaggggtagggtggggtcggaccctaacgtaaacgtaaaccgtacggagtacggaaacttaaggaaaaagtctagtaggtgtaacttcgtaggtagaacgggtccgattcgacccgtactaccganaacgtacaacgacaagtactacacttagtattagaactaaatacgaaacacgtaccgtaggaacgtaacgtacgaaaacgacgtaaccgacctaaattaagttatttagttagtaaaacgttaaaatctaactacgttagtagtaagttgggaccggttaggtaaaccggtcggttacgcgtttaag

SEQ ID NO: 300112 - DNA, 756 bp, Homo sapiens
  misc_feature: GZ8MTXP02F8F16.38.23.C01.1.454.CMB.2.raw
  modified_base (256)..(256): a, c, t, g, unknown or other
  misc_feature (256)..(256): n is a, c, g, or t
  modified_base (268)..(268): a, c, t, g, unknown or other
  misc_feature (268)..(268): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctatttagaggtgtcagtgtgaggtgcaggttggtggaatcgtagggggaaacttggccagccgtgggggtccctgaagctctcctgngcacgctcgtgnttcgatatttagtatctagttaggatggtagttcgggtcccgacgacggtccgtcggacggggtacggggcgttggggacgggttcggggtcggtacctaaccgtaacgtaaacccgaacggtacgtaacggtaaaccttaaaggaaaaacgtacgtaagttggtacgggttaactcggttacggtacgggaacgggtacccgttagttacccacccggttactacccggaaggaacgaaaccgaaaccggtaaacccgtaaaagtaacttaacccgtaacgttagtttacgtttaacggaacctttaaaaggcgaaaacctacgggtaccacggtaacggacgtaacggaacgaccgaccggtaactagtaccgtttaaactttagttaaagtaaaggttaaaacacgttaacctaacgttacgttaacgttaacggttaggggacgtttaaccgggacggttaacggggtcccggtaattttcggg

SEQ ID NO: 300113 - DNA, 741 bp, Homo sapiens
  misc_feature: GZ8MTXP02G4X78.38.23.C01.1.454.CMB.2.raw
  modified_base (261)..(261): a, c, t, g, unknown or other
  misc_feature (261)..(261): n is a, c, g, or t
  modified_base (455)..(455): a, c, t, g, unknown or other
  misc_feature (455)..(455): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtagggggtaaacttggtccagccgtgggggtcctgaagctctctgtgcngctctggatcattattaagtatctattggtatgtaggttgggtcccgcgaggtccgtcggaggggacggggtcgtgggtagggtggggtcggccgaaacgtaactaaaccgacgtacgtaggaaacgtaagaaaaagacgttaatgggtcggtacttcgtggtagggacgggtacgtacttccgaccgttaccnccgaaagacgaaacccgaacgaaccaaacgtaacttacctaacttacgttatttagactaaaatcgaaacgtacgaccgttaggaacggtacggtaccggaaaacggaccggtaacggaccttaaaagttaaacggtttaaaacttttaaggtttaaagttaaaacggttaaaaaacggtaattaacccgttaagtttaacccggtaaagtttaaggttaccgggggtttaaggaaaccgggggttaccggtttaaccgggggggtttagaacccggtttttaagg

SEQ ID NO: 300114 - DNA, 653 bp, Homo sapiens
  misc_feature: GZ8MTXP02HIH91.38.23.C01.1.454.CMB.2.raw
  modified_base (360)..(360): a, c, t, g, unknown or other
  misc_feature (360)..(360): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagaccctttttggctgtgtctctgggcgagagggccaccatcaactgcaagtcagccagagtcttttgtcagctcaagatatgagttcgtagcttggaccagcagaaagcacgactatcccctaagttgctcatttattaggtcatctagtcgggtgtccccggggtcctgacgtattcgagcggcacgnggatcgtagggacagtctttcaactctacaccataccgagtacacggtacctagaccgtagaaccgttaggaaacgtagtttgggaggtaccgtttaaggttttagttaaacctgggttacctaaagggtaccttaaaattaacgtttaacgtttagggtaaaacggtttccccgttaccggggtaccttacccgtttaaacggttttccgggaaccggggttaacggggaacccccgtaaaaggggttaccgggaggtaaaacgtttcggaaaacgttaccggtaaacccgg

SEQ ID NO: 300115 - DNA, 592 bp, Homo sapiens
  misc_feature: GZ8MTXP02JNO68.38.23.C01.1.454.CMB.2.raw
  modified_base (257)..(257): a, c, t, g, unknown or other
  misc_feature (257)..(257): n is a, c, g, or t
  modified_base (498)..(498): a, c, t, g, unknown or other
  misc_feature (498)..(498): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagacctccctggctgtgtctcgtgggcgaggagggccaccatcaactgcaagtccagccagtagttcttttgtcagcctacaagatntgattcgtagcttgaccagcaagaaagcaacgactacgtaccctaagttcgcttactatttttagttggtactacttccgttaccgtcggggttcggtacccccccggggttccctaggacccgtattccgaggtcggcgagggccggtatccggtaggggacacgttatttaccactcctaccacgatacacgcacgccctagccaggtactagaaatgtgtagacttattaacgttacngttacacgatatattagtaggtactccgtcggacttcgtacgttacggacggtacggtaaccgtaggtacggacgtagacgacggtacgtaacg

SEQ ID NO: 300116 - DNA, 657 bp, Homo sapiens
  misc_feature: GZ8MTXP02I26DQ.38.23.C01.1.454.CMB.2.raw
  modified_base (265)..(265): a, c, t, g, unknown or other
  misc_feature (265)..(265): n is a, c, g, or t
  modified_base (421)..(421): a, c, t, g, unknown or other
  misc_feature (421)..(421): n is a, c, g, or t
  modified_base (537)..(537): a, c, t, g, unknown or other
  misc_feature (537)..(537): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagacctcctggctgtgtctcgtgggcgagacggccacagtcaacgtgacaaggtcccagccagtacgttcttttgtcagcctacaaagacttagngtagtttcgttagcgtttaggaaccagacaagaaacgccacgacacgtacccctaagttcgactacgtatttagttcgactacttctaccgttcggggtcgttcccccggggtaccctacggaccgtacttcgacggtcgggcgtacgggacggtnttccggtggggaacctaaggttctttacccacttccacgaacctgtaccgacgtaccacgccgtagacgtaagtacgtaaggagtacgttggtacgtactttaacgttactcggtntactaacgtacttaagttagttacggtcgttacgttccgttacggtacgttacggttacggtacggggaacgtaacgggtaaccggtaggtacggaagtacgacgtaacggtacgtaagg

SEQ ID NO: 300117 - DNA, 723 bp, Homo sapiens
  misc_feature: GZ8MTXP02HZRCE.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcttgggttttccttgttgcttattttagaaggtgtccagtgtgaggtgctagttggtggaatcgtagggggtaaacttggtccaggccgtgggggtccctggacgctctcgtgtcgcacgtcctcgtggtattcaattatttagtaatctagttggatggtagttgggtcccgacgaggcctaccggaggggacgggtcgtgggtaggtggggtacgacctacgtaaacaaaccgacgtaacgtacggtaaaacctaagaaaaaacgtcgttaagtggtacgggtacttcgttaggtacgggtaaacggggtcctaaactttccgaacccgttcgtaccgaagaacgaaccgaaacgaacctaaagtacttaccaacgttgtaactttacgaataaaacgtacgtaaaccacggtacctaaggaacgtagtaaaccggaaagaaccgtaccggaactaaagttatttaacgttagtttaaaggtaaaggtaaaatacttactaagtttacgaaagttaaggttacggggtacggtaccggggtaaggtttaccggggtaggtaacgtttcgg

SEQ ID NO: 300118 - DNA, 928 bp, Homo sapiens
  misc_feature: GZ8MTXP02H3CSQ.38.23.C01.1.454.CMB.2.raw
  modified_base (264)..(264): a, c, t, g, unknown or other
  misc_feature (264)..(264): n is a, c, g, or t
  modified_base (333)..(333): a, c, t, g, unknown or other
  misc_feature (333)..(333): n is a, c, g, or t
tcagtcgatcacgtcacgaccggtgctcgatttagtacacgtgattagggattgggggtctcagagaggagccttagccctggactccaaggcctttgcacttggtgatcagcactgagcacagagactcaccatggaattgggctgagcttgggttttccttgttgcttattttagaaggtgtccagtgtgaggtgctaggttggtgaatcgtaggggaacttggtcagccgtgggggtcctgagctctctgtgcacgctcgngtattcattattagtatctagttggatggtaggttcgggtccgccgaggccgtccggaggggacgggtntggggaggtcggggtcgacctaacgtaacgtaaaccgacggtaagtacgggaaaaccttaaggaaaaaaacggtacgttaaggttacgggttacgggtaccgttacggttacggggtacggggtaaaccgggggtacccccgttaacgttttacccccggaaccccccggtttaccgtaaacccccggaagggtaaacccggaaaaacccggtaaaaccccgggaaacccgttaaaaaacggttaaacctttaacccgtaaaccgtttaggttaaactttttaccggggaaaactaaaaacgttacgggtaaaaccccgtaaccggtcccggttaaagggaaccgggttaaaacgggtaaacccggttaaaaccggaaaccccgggtaaacccgggtaacccttaaaagtttaaaacttttaaaacggttttaaacgttttaaaacggggtttaaaaacgtttaaaaaacgggtaaattttaacccggtaaagtttttaaacccggtaaaggtttaagggtacgggggttaaacggggtaccccgggggttaaaacgggttaccccggggggtttacggtaaaccccgttttggg

SEQ ID NO: 300119 - DNA, 566 bp, Homo sapiens
  misc_feature: GZ8MTXP02FNMUI.38.23.C01.1.454.CMB.2.raw
  modified_base (264)..(264): a, c, t, g, unknown or other
  misc_feature (264)..(264): n is a, c, g, or t
  modified_base (299)..(299): a, c, t, g, unknown or other
  misc_feature (299)..(299): n is a, c, g, or t
  modified_base (318)..(318): a, c, t, g, unknown or other
  misc_feature (318)..(318): n is a, c, g, or t
  modified_base (320)..(320): a, c, t, g, unknown or other
  misc_feature (320)..(320): n is a, c, g, or t
  modified_base (323)..(323): a, c, t, g, unknown or other
  misc_feature (323)..(323): n is a, c, g, or t
  modified_base (337)..(337): a, c, t, g, unknown or other
  misc_feature (337)..(337): n is a, c, g, or t
  modified_base (360)..(360): a, c, t, g, unknown or other
  misc_feature (360)..(360): n is a, c, g, or t
  modified_base (362)..(362): a, c, t, g, unknown or other
  misc_feature (362)..(362): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcgtggtttctgtgctatttagaagtgtccagtgtgaggtgcagttggtggaatcgtagggggaaacttggtcccagccgtgggggtccctggaagctctcctgtgcagcctcnggattcatattagtaatcagttgatgagttggtcncaggctcgagggcggtggngnggngcgatagtaaaccngatggaactagaaaagctatggngntctgagacggcgtatcaccgtctaccagagacaacgcaaagtattacactgtagtttacgataaagtacgaaacagtaccgtagaagtaacgttacggaaacggacgtaaccggactaaacttaagtactttaagtagttaaggtaaaattatacgtaacttgaagttgtacgggtcggtacgtacggttaggcggtaccttgg

SEQ ID NO: 300120 - DNA, 665 bp, Homo sapiens
  misc_feature: GZ8MTXP02FTFRM.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttcctgttgctatttagaggtgtccagtgtgaggtgctaggttggtaggaatcggtagggggaaacttggtccaggtccggtcggggggtccctaggaacgtcctctccgtggtcgccacgccttctggtattctaattatttagtaatcgtattggatggtaggttcggtcccgcgaggcctccggaggggcggggtcgtgggtagggtcggggtcggaccctaacgtaacgtaaaaccgtcgtaagtaacggaaaactaagaaaaaagctagtggtgactcgtaggacgtacgggactactccgaaccttcaccgagtaacaaccgaaacgacctaagtaactacctagttattaattacgactaaaatcgaaatacgtacgtagagacgtacgaaagaccgacggaactagttaaataagtttagtaggttaaaagtaaaacgtcttactagttacggtataacgggtttgggacgtcgggtaaccggttgggactagtttacg

SEQ ID NO: 300121 - DNA, 594 bp, Homo sapiens
  misc_feature: GZ8MTXP02H4C5L.38.23.C01.1.454.CMB.2.raw
  modified_base (266)..(266): a, c, t, g, unknown or other
  misc_feature (266)..(266): n is a, c, g, or t
  modified_base (471)..(471): a, c, t, g, unknown or other
  misc_feature (471)..(471): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattgggctgagctgggtttcttgtgctattttagaggtgtcagtgtgaggtgcagttggtggaatcgtagggggaaacttggtccgaggccgtggggggtccctgaagctctcgtgtgcagcctcgnggatcattattagaatcagttgatgagttggcgcagctcgaggcggctggagtggggtcgccaaagtaactaaaccgacgtagtaggaaacctaggaaaaaagtctaatggtggaactcggtgtaggaaaggccgatttccaccgttcaccgaagaacgaaccaaacgacaaaacgtaattaccgaaccttgttatttacgaaanaaagtaacgaacacgtactagaagacgtaacgaacgacgacgactaattataattagtagaaactaaagactagtacgttagagtaaggtacggtacggacgtaacgggtcggtacgtacgtg

SEQ ID NO: 300122 - DNA, 683 bp, Homo sapiens
  misc_feature: GZ8MTXP02JSD0M.38.23.C01.1.454.CMB.2.raw
  modified_base (202)..(202): a, c, t, g, unknown or other
  misc_feature (202)..(202): n is a, c, g, or t
  modified_base (402)..(402): a, c, t, g, unknown or other
  misc_feature (402)..(402): n is a, c, g, or t
  modified_base (429)..(429): a, c, t, g, unknown or other
  misc_feature (429)..(429): n is a, c, g, or t
  modified_base (552)..(552): a, c, t, g, unknown or other
  misc_feature (552)..(552): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggacctcaccatggaattggggctgagcttgggttttccttgttgcttattttagaaggtgtccaggtgtgaggtgngtaggttggtggtaatcggtagggggtaaacttggtccgaggccggtcggggggtccctggaacgtcctctccgtgtacgcagtccctagtggtattcattaagtttagtaactctagttagatggtaggttggtcccgcgaggtcaccggtaaggggcggtcgtggtagggtggtacggccctaacttaacaaaacccngtaagtacgtaaactaaggaaaaaccncgttatacgtggggtacctagtgggtagaaaccgggtccgtatttaacccgccgttcctacgaaacgcggaacaacgacccgtaaaagtcttcctaagttagttactttagaacttaaacganaacgtacgtacctagaagtagtaaccggaagacgtaccgtataagtagtactttaggtattaaacaaaaggttataacgtacgttatagtaacgtacggtaacggcggttaaggtacggtacgtacgttag

SEQ ID NO: 300123 - DNA, 630 bp, Homo sapiens
  misc_feature: GZ8MTXP02IS3JP.38.23.C01.1.454.CMB.2.raw
  modified_base (305)..(305): a, c, t, g, unknown or other
  misc_feature (305)..(305): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcttgggttttccttgttgcttattttagaaggtgtccagtgtgaggtgcagttggtggaatcgtgggggaaacttggtccagccgtgggggtccctgaagctctctgtgcagcctctggattcattatttagtaatcattgatgagttggtccncgaggcctaccgaggggacgggctgggaggtggggtgcccactaactaaaaccgacgataggaaactagaaaaaagctaagtgtggacttcgtggtagaacggggcctagttccaccgtctaccgagacgacaacgacgaagaacttacacttagtaatttagaacctaaagtacgaaactacgacccgttagaacgtaggtacgaacgaacgacggacctaataatttagttatttaaggtaagttaaaaagacttacgtaattcgtaagttaagtggggttacggtacggtacgggttaaccgggggtaggtacgtttaacgg

SEQ ID NO: 300124 - DNA, 634 bp, Homo sapiens
  misc_feature: GZ8MTXP02H7ILX.38.23.C01.1.454.CMB.2.raw
  modified_base (377)..(377): a, c, t, g, unknown or other
  misc_feature (377)..(377): n is a, c, g, or t
  modified_base (574)..(574): a, c, t, g, unknown or other
  misc_feature (574)..(574): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggtttcctgttgctattttagaaggtgtccagtgtgaggtgcagttggtggaatcgtgggggaaacttggtccgagccgtgggggtcccctgaagctctcctgtgcagccctgtggtattcattattagtatcattggatgtaggttgggtcccgcaggcctcgaggggacgggctggagtgggtcggcctaatataaaccgcgagtaggactagaaaacgtntagtgtgggtactcgtgttacgaacggggtccgattacccgacgtccgttcccgaagacgaacgaaacccggtacaacgtaacttacaccgtttagttatttacgaaccgtaaacttaggaacccttagggcctaaggtaagacgtacggataacccggacggacctaagtacttattagttacggtagttaaaaanctttacgatttaccgtagttaagtggttacggacgtacggtaccgggtaggacctttagg

SEQ ID NO: 300125 - DNA, 623 bp, Homo sapiens
  misc_feature: GZ8MTXP02FX2JX.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctatttagaaggtgtccagtgtgaggtgcagttggtggaatcgtgggggaaacttggtccagccgtggggggtccctgaagctctcctgtgcagcctcgtggattctattatttagtaatctagttggatggtaggtttcgggtccgccgaggcctccggaggggaccggggcgtgggaggtggggtcgggaccctaacgtaataaaaccgacgagtaggaaacctaagaaaaacgtactagtaggtcggactacgtggtagggaacgggaccgtacttccgacccgtctacccgagaacgaaccaaacgacaaagtaacttacacttagtatttagaactaaagtcgaaacacgaccgtagaagagtacgaacgtacgaccgactaatatattattagtaataaaagtctactatagtataaggtggtacggacggtacggtacggtcgtactg

SEQ ID NO: 300126 - DNA, 930 bp, Homo sapiens
  misc_feature: GZ8MTXP02JVKT6.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcttgggttttccttgttgcttatttagaaggtgtccagtgtgaggtgcgtaggttggtaggaagtcggtacggggggtaaacttcgggtaccgacggtccggtcgggggggttcccctaggaacgtccttccgttccgttggtcgaccgtacggtcccgttccggttaggtactttacgtaattttaagttttaaaggtaaagtttacctaaggtttagggtaattacggttaaggggtttcggggtccccgtaccggtacggggtacccgttacccggggaacgggggtacgggggttccggtaggggtacggggttcgggggtcgggaaccccgtaaacctaaaacgttaaaacccggaacggtaacgttacggggtaaaactaaacggtaaaaaacgacgttaagtacgggttacggggtaacccttaggtacgggggttacggggaaaccgggggtacccggttaaacgtttaccccgggtaacccccggtttacccgtaaacccggaacgggtaaacccggaaacccgaaaaccccggaaaccgaaaacggttaaacctttacccgttaaagttacgtttaaagtttaaccggtaaactaaaaggttaacgaaacgaccggtacccgtaaggaagtaaaccggtaacggaaacgacgacccggtaactaagttaagttaactttagttaagaaagttaaaacggtctaaatacgttacttaaaggtcggtacgggttaccggtacgggtacgggttacgggtggactttaacgg

SEQ ID NO: 300127 - DNA, 580 bp, Homo sapiens
  misc_feature: GZ8MTXP02GBZCA.38.23.C01.1.454.CMB.2.raw
  modified_base (303)..(303): a, c, t, g, unknown or other
  misc_feature (303)..(303): n is a, c, g, or t
  modified_base (325)..(325): a, c, t, g, unknown or other
  misc_feature (325)..(325): n is a, c, g, or t
  modified_base (341)..(341): a, c, t, g, unknown or other
  misc_feature (341)..(341): n is a, c, g, or t
  modified_base (351)..(351): a, c, t, g, unknown or other
  misc_feature (351)..(351): n is a, c, g, or t
  modified_base (455)..(455): a, c, t, g, unknown or other
  misc_feature (455)..(455): n is a, c, g, or t
  modified_base (528)..(528): a, c, t, g, unknown or other
  misc_feature (528)..(528): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttcctgttgctatttagaaggtgtccagtgtgaggtgcagttggtggaatcgtagggggaaacttggtccagccgtgggggtccctgagctctcctgtgcagcctctggattcattatttagtaatcattggatgagttgggccncgagctcgaggggcgggctggnggtgggtgccactaanaaccgagacnggaactagaaaagactaagttgtggacttcgtggtaggaacgggccgtatctacccgtctaccgagacgacaacgacccaagtaactcacttagtatttacganaaactagtaaacgagtccgtagagaacggtagaaacgacgtacgaccaataattattagttataacgtaaagntacgtattcgtaataaggtggtacggcgtacggtacggggtacgcgtttacg

SEQ ID NO: 300128 - DNA, 737 bp, Homo sapiens
  misc_feature: GZ8MTXP02FIMPQ.38.23.C01.1.454.CMB.2.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtagggggtaaacttggccaggccgtgggggtccctgagctctcctgtgcagcctctggattcatatttagtaatctattggatggtaggtttgggtccgccgaggcctacgacgggggacggggtcgtggggaggtcggggtggaccctacgtaactaaaaccgacgtaacgtagggaaaacctaaggtaaaaaacgacgttaagttacgggttgggacttacggttggttacggggaaacgggggtacccggtactttacccgtaacccccgtcctaccccgaaaggaacgaaacccaaacccgtaccccgaaaaggttaaaccttaccgtaaccgtttagttaacgttttaccgaaccgtaaaaagtacgaaaacgacggtaccgtaggaacggtaaggtaccggaaaacgaccgacggacccaattagtaatttaagtgttaaaagtaaagaacttacctaattcgtaagtaagttacggggtcggtaccggtaacgggtacgggtacggtaccgtttaagg

SEQ ID NO: 300129 - DNA, 685 bp, Homo sapiens
  misc_feature: GZ8MTXP02FIQJY.38.23.C01.1.454.CMB.2.raw
  modified_base (289)..(289): a, c, t, g, unknown or other
  misc_feature (289)..(289): n is a, c, g, or t
  modified_base (485)..(485): a, c, t, g, unknown or other
  misc_feature (485)..(485): n is a, c, g, or t
tcagtcgatcacgtcacgaccggtgctcgatttagtacacgtgattagggattggggacaacaggcaggaaggggcagcaagatggtgttgcagacccaggtcttcatttctctgttgctctggatctctggagcctacggggacatcgtgatgacccagtctccagactccctggctgtgtctcgtgggcgagacggccaccatcaactgacaacgtccagccagtagttcttttgtcagtctaccgaaagtatatgtagttcgttagtcgttgtaccagcaagaacncaacgacaccgttacccctaaaggttcacttcttaatttaagttcggtactacgtcgtacggttcggggttcggtccccggggtaccctggaccccgttcttcggacggtccgggacacgggtacggtactccgggtacgggaactaacggttacttttaccgaccttctacccaacctactacacgtcacgtccncgacgagtacgagtaagtagtcgtacggtacgtaagtttttttttacacgtttgtacgtacgtaattaaagttacgttaggtacggttaacccgttcgttaccggtaccgttaccgttacggtttaccgggacgggtaaccggtaacggtaagggtaggaacgtacgtaacggaacgtaccgtaagtcggtccggtaacg

SEQ ID NO: 300130 - DNA, 653 bp, Homo sapiens
  misc_feature: GZ8MTXP02JTWO3.38.23.C01.1.454.CMB.2.raw
  modified_base (263)..(263): a, c, t, g, unknown or other
  misc_feature (263)..(263): n is a, c, g, or t
  modified_base (300)..(300): a, c, t, g, unknown or other
  misc_feature (300)..(300): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctatttagaaggtgtccagtgtgaggtgcagttggtggaatcgtgggggaaacttggtccagccgtgggggtcctgagctctcctgtgcagcctntggattcattattaagtatcattggatgagttggtcncgaggtctccggaggggacggggcgtagggaggtggggtcggacctaacgtaactaaaaccgagtacgtacggaaactaggaaaaaagtctaatggtaggactcgtggtagaacggggcctacgttcacccgtctacgacgaagaaccgaaccgaccgaaagtacttaccaagttcgtaattttacggacaaaagttacgaaacgtacgcccgttaaggaaacgtacggtaacgaaaccggaacgtaccggacctaagttaacgtatttaagtagttaaacggtaaaatatacctaacgtttgaaaagttcgtagggacgggtacgtacggtacggggttagcctttaacggg

SEQ ID NO: 300131 - DNA, 699 bp, Homo sapiens
  misc_feature: GZ8MTXP02GMROH.38.23.C01.1.454.CMB.2.raw
  modified_base (319)..(319): a, c, t, g, unknown or other
  misc_feature (319)..(319): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcttgggttttccttgttgcttattttagaaggtgtccagtgtgaggtgctaggttggtggaatcggtagggggaaacttggtccaggccgtgggggtccctgagctctcctgtgcacgcctcgtggattcattatttagtaatctagttggatggaggtttcggtccnccgaggctcgaggggacgggcgtgggaggttggggcgtccaacgtaactaaaaccgacgagtacggaactaaggaaaaacgtactagtagggtagggtaactcgtaggttacggaacggggtacccgtagtttaccccgaaccgttcccgtacccgaacgtaacggaaacccaaacccggaacaaaacggtaaattacccgtactttaggttaactttaggaaacctaaaagttacgaaaactacggtacctaggaaacggtacgtacggaaacgaccgaacggacctaagttaactaaagtttagttaggtaaacgttaaaagatacgttaattcgaaattcggtaggtcggacgtacggtaggggtacgtacgtttag

SEQ ID NO: 300132 - DNA, 598 bp, Homo sapiens
  misc_feature: GZ8MTXP02IOHYT.38.23.C01.1.454.CMB.2.raw
  modified_base (305)..(305): a, c, t, g, unknown or other
  misc_feature (305)..(305): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagccgtggggggtccctggaagctctcctgtgcagcctctggatcatatttagtaatcattggatgagttgggtccncaggctcgagggacgggctggagtgggtggccactataaaccacgatggaactagaaaaagctattgtggactctgtagaaggcgatcacgtctaccagaacacgaacgcaaagaacttcaacgttgtacgtttacgacgtaaatagaaacgtagaccgtagagtaacgtacgaaacggaacaacgggacctaagtaacttaattatttagtaagtaaaaaggtacttacctagttaccgtaagttaagttacgggtaggaccggtaaggtaccggggttagacgtttaacgg

SEQ ID NO: 300133 - DNA, 604 bp, Homo sapiens
  misc_feature: GZ8MTXP02FKZ56.38.23.C01.1.454.CMB.2.raw
  modified_base (425)..(425): a, c, t, g, unknown or other
  misc_feature (425)..(425): n is a, c, g, or t
  modified_base (471)..(471): a, c, t, g, unknown or other
  misc_feature (471)..(471): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggtttcctgttgctattttagaaggtgtccagtgtgaggtgcagttggtggaatctgggggaaacttggtccagccgtggggggtccctgaagctctcctgtgcagcctctggatctatatttagtatcaattggatggtagttgggtacccgcctaggcctacgaggggacgggctgggagtggggtcggcactaataaacccgagatggaacctagaaaaacgactacgtgtcgaactctggtacggaagggccgattcccaacccgtntcccaaaggacgaaccaacgacccaaagtacttacgaacctagttnttaacgactaaagtcgaaacagtacccgtagagacgtacgaaggtacaccggactagacttatttacgtagtacgtaaaagctactacttagagtaagttcgggtagtcggaaaccggtttgggcggtactag

SEQ ID NO: 300134 - DNA, 721 bp, Homo sapiens
  misc_feature: GZ8MTXP02HD2D4.38.23.C01.1.454.CMB.2.raw
  modified_base (315)..(315): a, c, t, g, unknown or other
  misc_feature (315)..(315): n is a, c, g, or t
  modified_base (322)..(322): a, c, t, g, unknown or other
  misc_feature (322)..(322): n is a, c, g, or t
  modified_base (343)..(343): a, c, t, g, unknown or other
  misc_feature (343)..(343): n is a, c, g, or t
  modified_base (353)..(353): a, c, t, g, unknown or other
  misc_feature (353)..(353): n is a, c, g, or t
  modified_base (358)..(358): a, c, t, g, unknown or other
  misc_feature (358)..(358): n is a, c, g, or t
  modified_base (410)..(410): a, c, t, g, unknown or other
  misc_feature (410)..(410): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattgggctgagtcgttgggttttccttgttgtcttattttaggaaggtgtccaggtgtggaggtgcgtaggttggtaggaattcggtagggggtaaacttgggtcccgacggtcgggtccggggtcctagacgtcttcctcgtgcgacgcgtctgtgtactactattattagtatntagtagngtgtcggtcgccgcgcgtcgngggaggcggngtggnggtcgggcaacgtactaaaccgaacgagtacgtagtaaacgaaagaaacgtntacggtcgtgtactagggtaggtaaggaccgttactaccgtacccgtaccgtccgtaaccgagaacgaaccgaaaccgaacgtaacgtacttaccgtaattacgttacgtaacgtaacgtaaacgtacgtaaacgcgtaccggtaagacggtaacgtaaacggaacgaccggtactaaacgtacttaagtttaaacgtagttaaagtaaaacggtttaaagaaaccctttagttacgttaacggttaaagttgggttaccggtaacggggttaacgggtcggtttaaccgggcgtttaaaacggtttccgg

SEQ ID NO: 300135 - DNA, 527 bp, Homo sapiens
  misc_feature: GZ8MTXP01EMV3Q.11.72.G06.1.454.CMB.2.raw
  modified_base (366)..(366): a, c, t, g, unknown or other
  misc_feature (366)..(366): n is a, c, g, or t
  modified_base (414)..(414): a, c, t, g, unknown or other
  misc_feature (414)..(414): n is a, c, g, or t
  modified_base (488)..(488): a, c, t, g, unknown or other
  misc_feature (488)..(488): n is a, c, g, or t
tcagcgagagataccacgaccggtgctcgatttagctacgactgcaagggaaaggggacccaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggcttgagtgggtgggatggatcaactctcacactggaagcagagtctatgcggagagattccaagggcngagtcaccctgaccacagagacatccacgaccacagtactacatgganctgtgagccgtgagacctgacgacacggccctctattactgtgcgaaggccccttatcccttacagtcgacccncttccaacgctggttcgaccttcgtcggggccgaacggg

SEQ ID NO: 300136 - DNA, 651 bp, Homo sapiens
  misc_feature: GZ8MTXP01DWXDC.11.72.G06.1.454.CMB.2.raw
  modified_base (218)..(218): a, c, t, g, unknown or other
  misc_feature (218)..(218): n is a, c, g, or t
  modified_base (242)..(242): a, c, t, g, unknown or other
  misc_feature (242)..(242): n is a, c, g, or t
  modified_base (259)..(259): a, c, t, g, unknown or other
  misc_feature (259)..(259): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctnagtgaaggtctcctgtaaggcctnagttacaccttcaccgntaatgtatcacctggctcgacacggcccctggacaaggcttgagtgggtggatggatcaactctcacactggaagcagagtctagtcggacggagagtacttcccgaaaggggccaaggacgtcccaaccccgtgaaccccacgagacgaccactacccaaccgaacccaacacgttacctaacagtagggacgcgtggtagggacgccggtaggacgaccctggaaccgaccaccggccctacgttacttaccgtggtacgccggtaacgggtcccccttagttccccttaacgacggttacgaaccccttccgttaccccgaacggtcccgttaacgggtttaccccgacccgtttccgggtccgggggttaacccgtaaaccccggggg

SEQ ID NO: 300137 - DNA, 531 bp, Homo sapiens
  misc_feature: GZ8MTXP01C2YLB.11.72.G06.1.454.CMB.2.raw
  modified_base (241)..(241): a, c, t, g, unknown or other
  misc_feature (241)..(241): n is a, c, g, or t
  modified_base (383)..(383): a, c, t, g, unknown or other
  misc_feature (383)..(383): n is a, c, g, or t
  modified_base (455)..(455): a, c, t, g, unknown or other
  misc_feature (455)..(455): n is a, c, g, or t
  modified_base (492)..(492): a, c, t, g, unknown or other
  misc_feature (492)..(492): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagcctggggcctcagtgaaggtctcctgtaaggcctnaggttacaccttcaccgctaatggtatcactggcttcgacaggcccctggacaaggcttgagtgggtggatggatcaactctcacactggaagcagagtctagtcgcggagagatccgaagggcaagagtcaccctgaccanagagacatccacgaccacagtctacatggagctggtggacgccgtagacgacctgaaccgacaccggccctntactactgtgcgaaggcccttatccacgagtcgaccncttccaacgctggttccacgttcgtcggggcctaacggg

SEQ ID NO: 300138 - DNA, 533 bp, Homo sapiens
  misc_feature: GZ8MTXP01DSELQ.11.72.G06.1.454.CMB.2.raw
  modified_base (216)..(216): a, c, t, g, unknown or other
  misc_feature (216)..(216): n is a, c, g, or t
  modified_base (236)..(236): a, c, t, g, unknown or other
  misc_feature (236)..(236): n is a, c, g, or t
  modified_base (301)..(301): a, c, t, g, unknown or other
  misc_feature (301)..(301): n is a, c, g, or t
  modified_base (490)..(490): a, c, t, g, unknown or other
  misc_feature (490)..(490): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagcctgggcctnagtgaggtctctgtaagctnagttacaccttcacgctaatggtatcactggcttcgacaggcccctggacaaggcttgagtgggnggatggatcgaactctcacactggaagcagagtctagtgcggagagattccgaagggcaaggagtccaccctgaccacagagacatccacgaccacagtactacatggagctgtagagcgtgacgacctagacgacacggccctactacttactgtcgcgaacggtcccttatccgttacagtcgaccncttccaacgtctcggttccaccgttcgtcgggccgtaaccggg

SEQ ID NO: 300139 - DNA, 622 bp, Homo sapiens
  misc_feature: GZ8MTXP01B9VJ8.11.72.G06.1.454.CMB.2.raw
  modified_base (240)..(240): a, c, t, g, unknown or other
  misc_feature (240)..(240): n is a, c, g, or t
  modified_base (256)..(256): a, c, t, g, unknown or other
  misc_feature (256)..(256): n is a, c, g, or t
  modified_base (301)..(301): a, c, t, g, unknown or other
  misc_feature (301)..(301): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctgggcctcagtgaaggtctctgtaaggcctnagttacacttcaccgntaatggtatcactgcttcgacaggccctggacaaggctgagtggnggatggatcaactctacacacgtggaagcagagtctagtcgcggagagtacttccgaagggccaagacgtcacccgtgaccacaggacacactaccaacgaccactagtctaacgagtggagctggtggacgtcggtgaacggaccgtcggaccgaaccgtacccggcccttacgttacgtttaccgtggttccgccggtaaccgggtcccttagtaccccttaacgtaacggttccgaaccccgttacttccccgaagtcccgtttcgggtttaccccggacccttccggggtccgggggttaacccctaacccgggggg

SEQ ID NO: 300140 - DNA, 648 bp, Homo sapiens
  misc_feature: GZ8MTXP01DEEWQ.11.72.G06.1.454.CMB.2.raw
  modified_base (217)..(217): a, c, t, g, unknown or other
  misc_feature (217)..(217): n is a, c, g, or t
  modified_base (241)..(241): a, c, t, g, unknown or other
  misc_feature (241)..(241): n is a, c, g, or t
  modified_base (337)..(337): a, c, t, g, unknown or other
  misc_feature (337)..(337): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctgggcctnagtgaaggtctcctgtaaggcctnagttacaccttcaccgctaatggtatcacctggcttcgacacggcccctggacaaggcttggagtgggtggatggatcaactctcacacgtggaancagagtctagtcggacggagaagtattacccgaaaggggcaaggacgtcccaaccctcgaacccaacgagaacgacaactcccaacgactaaccagtacctaacagtggaagtccgtggtaggacgccgtggaacgaccgtagaccgaaccgaccggtccccttacgttaacgtttactcggtcgccggtaaccggtcccccttaatacccttaacgaacggttccgaaccccttccgttaccccgaaccgtccgtttaacgggttccccggtacccgttccgggtccggggttccccggtaaacccgggg

SEQ ID NO: 300141 - DNA, 683 bp, Homo sapiens
  misc_feature: GZ8MTXP01C7A2V.11.72.G06.1.454.CMB.2.raw
  modified_base (242)..(242): a, c, t, g, unknown or other
  misc_feature (242)..(242): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagccgtggggcctcagtgaaggtctcctgtaaggcctnagttacaccttcacgctaatggtatcactggcttcgacaggcccctggacaaggcttggagtgggtggatggatcaactctcacacgtggaacgcaagagtctaagtcggcggagagtacttacccggaaaggggaccaaggacgtaccaaaccccgtggaaccccaagaggaacacactacccgaacgaccaacagtactaacagtggaagctggtaggacgccgtaggaacgtaccctaggaaccgtaccgaccggtacccttacttaagttaaccgttgggtacgcccgggtaaccgggtcccctttaaacgtaccccttaaacggtaacgggttacccgaaaccccgttaccttaccccgtaaccgggtcccgtttcggggttaccccggacccgttttaccgggggtccgggggaaccccggtaaaacccgggggg

SEQ ID NO: 300142 - DNA, 545 bp, Homo sapiens
  misc_feature: GZ8MTXP01BXKMG.11.72.G06.1.454.CMB.2.raw
  modified_base (417)..(417): a, c, t, g, unknown or other
  misc_feature (417)..(417): n is a, c, g, or t
  modified_base (448)..(448): a, c, t, g, unknown or other
  misc_feature (448)..(448): n is a, c, g, or t
  modified_base (499)..(499): a, c, t, g, unknown or other
  misc_feature (499)..(499): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagctgggctcagtgaagtctctgtaagcctcagttacaccttcacgctaatggtatcacctggcttcgacaggcccctggacaggcttggagtgggtggatggatcaactctcacactggaagcagagtctatcggcggagagattccgaagggccaaggagtccaccctgacccagagacgacactaccacgaccacacgtactacatgganctggtgacgccgtagacgacctcgacgaccncggcctactatacctgtcgcgaacggtcccttagtccacgacgtcgacccncttcccaacgtctcggttccgaccttcggtcggggccgtaaccggg

SEQ ID NO: 300143 - DNA, 556 bp, Homo sapiens
  misc_feature: GZ8MTXP01DISWY.11.72.G06.1.454.CMB.2.raw
  modified_base (241)..(241): a, c, t, g, unknown or other
  misc_feature (241)..(241): n is a, c, g, or t
  modified_base (362)..(362): a, c, t, g, unknown or other
  misc_feature (362)..(362): n is a, c, g, or t
  modified_base (416)..(416): a, c, t, g, unknown or other
  misc_feature (416)..(416): n is a, c, g, or t
  modified_base (507)..(507): a, c, t, g, unknown or other
  misc_feature (507)..(507): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaagcctnagttacaccttcaccgctaatgtatcactggctcgacaggcccctgacaaggcttgagtgggtggatggatcaaactctcacactggaagcagagtctatgcggagagattccgaagggcngagtcaccctgaccacagagacatccacgacacagtactaacatggagctgggngacgcggtagacgacctacgaccgaccgaccgcccttacttacttacgtgtcgcggtaacgtcccttaatcccttaacgacgtacgacccncttacccgaacgtcgttcggttccgaccgttcggtcgggccgtaacggg

SEQ ID NO: 300144 - DNA, 546 bp, Homo sapiens
  misc_feature: GZ8MTXP01D6HRW.11.72.G06.1.454.CMB.2.raw
  modified_base (242)..(242): a, c, t, g, unknown or other
  misc_feature (242)..(242): n is a, c, g, or t
  modified_base (336)..(336): a, c, t, g, unknown or other
  misc_feature (336)..(336): n is a, c, g, or t
  modified_base (387)..(387): a, c, t, g, unknown or other
  misc_feature (387)..(387): n is a, c, g, or t
  modified_base (396)..(396): a, c, t, g, unknown or other
  misc_feature (396)..(396): n is a, c, g, or t
  modified_base (421)..(421): a, c, t, g, unknown or other
  misc_feature (421)..(421): n is a, c, g, or t
  modified_base (449)..(449): a, c, t, g, unknown or other
  misc_feature (449)..(449): n is a, c, g, or t
  modified_base (500)..(500): a, c, t, g, unknown or other
  misc_feature (500)..(500): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctnaggttacacttcaccgctaatggtatcacctggcttcgacaggcccctggacaaggacttgagtgggtggatggatcaactctcacactggaancagagtctagtgcggagagattcccgaagggcaagagtcaccctgacccanagagactanccaacgaccacagtactacatgganctgtagagccgtgacggacctgacgacnccggccctatatacctgtcgcgaacggcccttatcccttacgagtcgaccncttccgaacgtctcggttccgaccttcgtcgggggcccgtaacggg

SEQ ID NO: 300145 - DNA, 558 bp, Homo sapiens
  misc_feature: GZ8MTXP01EFCER.11.72.G06.1.454.CMB.2.raw
  modified_base (370)..(370): a, c, t, g, unknown or other
  misc_feature (370)..(370): n is a, c, g, or t
  modified_base (418)..(418): a, c, t, g, unknown or other
  misc_feature (418)..(418): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggcttgagtgggtgggatggatcaactctcacactggaagcagagtctatcgcggagagattcccgaagggcnggatcaccctgaccacagacgacatccacgacacagtactacatggancgtgtggagccgtgagacctgacgacgacggcctactatacgtgtcgcgaacggtcccttatcccgttacgacgtacgacccgccttcccgaacgtccgttcggttccgacccgttcggtcgggggcccgtaaccggggg

SEQ ID NO: 300146 - DNA, 692 bp, Homo sapiens
  misc_feature: GZ8MTXP01DSGF3.11.72.G06.1.454.CMB.2.raw
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagctgggcctcagtgaagtctcctgtaaggcctcaggttacaccttcaccgctaatggtatcacctggcttcgacacggcccctcggacaaggacttgaggtgggtgggagtggatcaactctcacactggaagcagagtctatcggcggagagacttccgaagggcaagagtccgaccctacgaccacgagaacacgactacccaacggaacccaactaacggtaccttaaccgaagtcgggaacggtcctgggttaagggacccgtaccgggtacggaacggaacccgttacgggaaaccgacccgtacccgggacccctttaccgttaagtttaacccgttcggttcgggcccggtaaacggggtccccccttaaagttcccccgttaaacgaacggttccgaaccccgttaccttaccccgaacgggtccttaacgggttcccggtacccttccggggttcggggaaccccgtaacccggggg

SEQ ID NO: 300147 - DNA, 550 bp, Homo sapiens
  misc_feature: GZ8MTXP01EQ1DN.11.72.G06.1.454.CMB.2.raw
  modified_base (310)..(310): a, c, t, g, unknown or other
  misc_feature (310)..(310): n is a, c, g, or t
  modified_base (458)..(458): a, c, t, g, unknown or other
  misc_feature (458)..(458): n is a, c, g, or t
  modified_base (466)..(466): a, c, t, g, unknown or other
  misc_feature (466)..(466): n is a, c, g, or t
  modified_base (474)..(474): a, c, t, g, unknown or other
  misc_feature (474)..(474): n is a, c, g, or t
  modified_base (506)..(506): a, c, t, g, unknown or other
  misc_feature (506)..(506): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggactgagtgggnggatggatcaactctcacactggaagcagagtctatggcggagagattcccgaaggggcaaggacgtccaccctaggaacccacgagacgacactccaacgaccacagtactacatggagctggtagagccgtgacgacctgacgacncggccctntacttacngtgcgaacgtcccttagtccttagcgtcaccncttccaacgtctcggttccgaccttcgtcgggcccgtaacgggg

SEQ ID NO: 300148 - DNA, 631 bp, Homo sapiens
  misc_feature: GZ8MTXP01EUOMM.11.72.G06.1.454.CMB.2.raw
  modified_base (329)..(329): a, c, t, g, unknown or other
  misc_feature (329)..(329): n is a, c, g, or t
  modified_base (388)..(388): a, c, t, g, unknown or other
  misc_feature (388)..(388): n is a, c, g, or t
  modified_base (406)..(406): a, c, t, g, unknown or other
  misc_feature (406)..(406): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcaacagcaacaggtgcccactcacagggtcaactggtgcagtctggacctgaggtgaagaagcctggggcctcagtgaaggtctcctgtaaggcctcaggttacaccttcaccgctaatggtatcacctggcttcgacacggcccctggacaaggcttggagtgggtggatgggatcaactctnacactgggaagcagagtctatggccggagagactccgagggcagcgtcaccctgaccanagagacatccacgaccanagtctacatggagtgtcgtggacgtccctggggaacgtacccgtaggaacccgacgaacccgggccccttacttaagtttacccgtggtacgtcccggaacgggtccccttaaagttccccttaacgacggttacccaacccttacgttccccaaccggtccttggggtttaaccccgaccgttccgggttcgggggtaaccccgttaacggggtaaccccccgg

SEQ ID NO: 300149 - DNA, 547 bp, Homo sapiens
  misc_feature: GZ8MTXP01C732Q.11.72.G06.1.454.CMB.2.raw
  modified_base (213)..(213): a, c, t, g, unknown or other
  misc_feature (213)..(213): n is a, c, g, or t
  modified_base (233)..(233): a, c, t, g, unknown or other
  misc_feature (233)..(233): n is a, c, g, or t
  modified_base (373)..(373): a, c, t, g, unknown or other
  misc_feature (373)..(373): n is a, c, g, or t
  modified_base (407)..(407): a, c, t, g, unknown or other
  misc_feature (407)..(407): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggactgagtgaagagctgggcctnagtgagtctctgtaagcctnagtacacttcaccgctaatgtatcactggcttcgacaggcccctggacaaggacttgagtgggtggatggatcaaactctcacactggaagcagagtctatcgcggagagattccgaagggcaagagtcaccctgaccanagagacatccaacgaccacagtactacagtgganctgtggagccgtgacgacctgacgaccgacggcccttactacttactgtcgcgaacggcccttagtcccagacgtcgaacccttccttacccgaacgtccttcgggttaccgaccgttcgtcgggggcccgtaaccgggg

SEQ ID NO: 300150 - DNA, 589 bp, Homo sapiens
  misc_feature: GZ8MTXP01AL6XV.11.72.G06.1.454.CMB.2.raw
  modified_base (335)..(335): a, c, t, g, unknown or other
  misc_feature (335)..(335): n is a, c, g, or t
  modified_base (524)..(524): a, c, t, g, unknown or other
  misc_feature (524)..(524): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaggcttgagtgggtggatggatcaactctcacactggaancagagtctagtcgcggagagattccgaagggcaagagtccaccctgaccacagacgacatcccaacgaccacagtacacatggagctggtggacgccgtgacgacctggaaccgaccgaccggtcccttactaacttacgtcggtcgccggaacggtccccttatccccttaacgacggttccgacccnccgttcccaaccggtccgttaacgggttcccgacccgttcggtccgggggcccgtaacccggggg

SEQ ID NO: 300151 - DNA, 638 bp, Homo sapiens
  misc_feature: GZ8MTXP01DPX1V.11.72.G06.1.454.CMB.2.raw
  modified_base (214)..(214): a, c, t, g, unknown or other
  misc_feature (214)..(214): n is a, c, g, or t
  modified_base (274)..(274): a, c, t, g, unknown or other
  misc_feature (274)..(274): n is a, c, g, or t
  modified_base (298)..(298): a, c, t, g, unknown or other
  misc_feature (298)..(298): n is a, c, g, or t
  modified_base (328)..(328): a, c, t, g, unknown or other
  misc_feature (328)..(328): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgagtgaagagcgtgggctnagtgaaggtctctgtaaggctcagttacaccttcacgctaatggtatcactggctcgacnggccctggacaggcttgagtgggnggatggatcgaactctcactacgtaggaancgagtagtctagtcggcggaagagtacttccgaaggggctaaggacgtccacccgtagacccagagacgacactcccaacgaccacagtactacagtgggacgtcgtggtaggacgtccgtaggacgtaacctcggaaccgaccgacccggtcccttacgttaacttccgtacgtcgggaccggtaaccggtccccgttaattaccccgttacggtaacgttccgaaccccttaccgttccccgaaccggtccgtttcggggttaccccgacccggttccgggttaaccgggggcccgtaaacccggggg

SEQ ID NO: 300152 - DNA, 633 bp, Homo sapiens
  misc_feature: GZ8MTXP01C83E5.11.72.G06.1.454.CMB.2.raw
  modified_base (356)..(356): a, c, t, g, unknown or other
  misc_feature (356)..(356): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagcctggggcctcagtgaaggtctcctgtaaggcctcaggttacaccttcaccgctaatggtatcactggcttcgacaggcccctggacaaggcttggagtgggtggatggatcaactctcacactggaagcagagtctagtcggcggaagngattcccgaaggggcaaggacgtccaaccctgaaccacgagacgacactacccacgaccacagtactacagtggagacgtggtaggacgccgtaggacgtacccgtaggaccgaaccgacccgggtccccttacgttaactttaccgtggtcggccggtaaccggtccccttaacgtccccttaacgtacggttcgaaaccccgttccttaccccgaaccggtccgttccgggtttcccgacccggttcgggtccgggggccccgtaaacccggggg

SEQ ID NO: 300153 - DNA, 621 bp, Homo sapiens
  misc_feature: GZ8MTXP01AZE2Q.11.72.G06.1.454.CMB.2.raw
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagccgtggggcctcagtgaaggtctcctgtaaggcctcgaggttacaccttcaccgctaatggtatcacctggcttcgacacggcccctggacaggactgagtgggtggatggatcaactctacacactggaagcagagtctagtcggcggagagattcccgaagggcaaggacgtccaaccctaggacccaacgagaacgacactacccaacgaccaacacgtactacagtggagctaggtggacgccggtagacgacctacggaccgaccgaccggtcccttacgtacttaccgtggtcgcggaacggtccccttagttacccgttacgtaacgtccgaacccttccgttacccgaacggtcccgttcgggttacccgaccccggttcggtcccgggggcccgtaaccccggggg

SEQ ID NO: 300154 - DNA, 566 bp, Homo sapiens
  misc_feature: GZ8MTXP01DP5ZX.11.72.G06.1.454.CMB.2.raw
  modified_base (431)..(431): a, c, t, g, unknown or other
  misc_feature (431)..(431): n is a, c, g, or t
  modified_base (513)..(513): a, c, t, g, unknown or other
  misc_feature (513)..(513): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcactggcttcgacaggcccctggacaaggcttgagtgggtggatggatcaaactctcacacgtggaagcagagtctatcggacggagagacttcccgaaggggcaagagtccacccgtgacccacagacgacacgtccaacgaccacagtactacagtgganctgtgacgcgtgacgacctgaccgacacggccctacgtattcgtgtcgcgaacggcccttagtcccttacgacgtcgacccncttcccgaacgccgttcgggttcccaccgttcggtcggggcccgtaaccgggg

SEQ ID NO: 300155 - DNA, 627 bp, Homo sapiens
  misc_feature: GZ8MTXP01AR0VX.11.72.G06.1.454.CMB.2.raw
  modified_base (215)..(215): a, c, t, g, unknown or other
  misc_feature (215)..(215): n is a, c, g, or t
  modified_base (235)..(235): a, c, t, g, unknown or other
  misc_feature (235)..(235): n is a, c, g, or t
  modified_base (302)..(302): a, c, t, g, unknown or other
  misc_feature (302)..(302): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagctgggcctnagtgagtctctgtaagcctnagttacaccttcaccgctaatgtatcactggcttcgacacggccctggacaaggcttggaggtgggnggatggatcaactctcacacgtggaagcaaggagtctagtcggacggagacgtattccgaaaggggcaaggacgtccacccgtacgaccacgagacgacactacccaacgaccaacgacgtacctacaagtggaacgtcgtaggtacggacgtccgtaggaaccggtaccctaggaaccgacgaacccgggtcccttacgttacgttacgtcggtacggccggtaaccggtccccttacgtacccttaacgacgttaaccgaccccttaccttacccgaacgtccgttcggttcccgaccgttcggtccggggcccgtaaccggg

SEQ ID NO: 300156 - DNA, 648 bp, Homo sapiens
  misc_feature: GZ8MTXP01DO075.11.72.G06.1.454.CMB.2.raw
  modified_base (236)..(236): a, c, t, g, unknown or other
  misc_feature (236)..(236): n is a, c, g, or t
  modified_base (460)..(460): a, c, t, g, unknown or other
  misc_feature (460)..(460): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcattccttttcttggtggcagcagcaacaggtgcccactcacagggtcaactggtgcagtctggacctgaggtgaagagcgtgggcctcagtgagtctctgtaagctnagttacacttcacgctaatgtatcactggctcgacacggccctggacaaggcttggaggtgggtggatggatcaactctacacacgtggaagcagagtctagtcggacggtaagagtacttacccgaaaggggcaaggacgtacccaaccccgtagaacccaacgaagaacgacaactcccaacgacccaacacgtactaacagtgggacgtctggtacggacncccggttaggaacggtaccctagggaacccgacgaacccgggtcccttacgttaacgttaccgtggttacgccggaacggttacccccttagttaccccaacgtaacggttccgaaacccgccttaccccgaacgtccgttcgggtttacccgacccgttcggtccgggggaacccgtaacccggggg

SEQ ID NO: 300157 - DNA, 556 bp, Homo sapiens
  misc_feature: GZ8MTXP01DQ1Q5.11.72.G06.1.454.CMB.2.raw
  modified_base (201)..(201): a, c, t, g, unknown or other
  misc_feature (201)..(201): n is a, c, g, or t
  modified_base (235)..(235): a, c, t, g, unknown or other
  misc_feature (235)..(235): n is a, c, g, or t
  modified_base (250)..(250): a, c, t, g, unknown or other
  misc_feature (250)..(250): n is a, c, g, or t
  modified_base (292)..(292): a, c, t, g, unknown or other
  misc_feature (292)..(292): n is a, c, g, or t
  modified_base (320)..(320): a, c, t, g, unknown or other
  misc_feature (320)..(320): n is a, c, g, or t
  modified_base (472)..(472): a, c, t, g, unknown or other
  misc_feature (472)..(472): n is a, c, g, or t
  modified_base (507)..(507): a, c, t, g, unknown or other
  misc_feature (507)..(507): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtnaagagcgtgggctcagtgagtctctgtaagcctnagttacacttcacgntaatgtatcactggctcgacacggccctgacagctgagtggnggatggatcaactctcacacgtgaacgnacgagtctagtcgacggagagacttccgaagggacaaggacgtccaacccgtagacccacgaagacgtaacacacccacgaaccacgacgtactacagtcggagctaggacggacgacgtagacgaccgtacgacgaaccgcgcccttactnttacgtgcgcgaacgcccttatcacgagtcgaccncttccgaacgtcgttcggttcaccgttcggtaaccgggccgtaaccggg

SEQ ID NO: 300158 - DNA, 656 bp, Homo sapiens
  misc_feature: GZ8MTXP01BP07R.11.72.G06.1.454.CMB.2.raw
  modified_base (409)..(409): a, c, t, g, unknown or other
  misc_feature (409)..(409): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagccgtggggcctcagtgaaggtctcctgtaaggcctcagttacaccttcaccgctaatgtatcactggctcgacacggccctggacaaggcttggaggtgggtggatggatcgaactctacacacgtggaagcagagtctagtcggacgggagaggtacttcccggaaagggggccaaggtacgtcccaccccgtgaacccanaacggacgaccactacccaacgacccaacgagtacctaacagtcggagtcgtaggtaggacgccgtaggaacgtacccgtaggacccgtaccgacccggtcccttacgttaacttaccgtggttccggaccggtaaccggtccccttaagttaccccaacgtacggttacgaaccccgttaccttacccgaaccggtcgttccgggttccgacccgttcggtaaccgggggccccgtaacccggggg

SEQ ID NO: 300159 - DNA, 645 bp, Homo sapiens
  misc_feature: GZ8MTXP01DCNZZ.11.72.G06.1.454.CMB.2.raw
  modified_base (218)..(218): a, c, t, g, unknown or other
  misc_feature (218)..(218): n is a, c, g, or t
  modified_base (242)..(242): a, c, t, g, unknown or other
  misc_feature (242)..(242): n is a, c, g, or t
  modified_base (260)..(260): a, c, t, g, unknown or other
  misc_feature (260)..(260): n is a, c, g, or t
  modified_base (311)..(311): a, c, t, g, unknown or other
  misc_feature (311)..(311): n is a, c, g, or t
  modified_base (326)..(326): a, c, t, g, unknown or other
  misc_feature (326)..(326): n is a, c, g, or t
  modified_base (339)..(339): a, c, t, g, unknown or other
  misc_feature (339)..(339): n is a, c, g, or t
  modified_base (360)..(360): a, c, t, g, unknown or other
  misc_feature (360)..(360): n is a, c, g, or t
  modified_base (442)..(442): a, c, t, g, unknown or other
  misc_feature (442)..(442): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagccgtggggcctnagtgaaggtctcctgtaaggcctnaggttacaccttcaccgntaatggtatcacctggcttcgacaggcccctggacaaggcttggagtgggnggatggatcaactcncacacgtaggaancagagtctagtcggacggganagtacttccgaaggggcaaggactccaacccgtgaccagagacgacatccaacgaccaacgacgtactaacagtcgggaacncgttaggacgggacgtccggtaggaacgggtacctacgggaacccgtaccgacccggtaccctttaacgtaacgtttaacgcggttacggaccggtaaaccggtccccttaggtaccccttaaacgacggttacgaccccttacgttccccgaacgtccgttcgggttcccgaccgttccggtaacggggcccgtaacccggg

SEQ ID NO: 300160 - DNA, 599 bp, Homo sapiens
  misc_feature: GZ8MTXP01DU1LX.11.72.G06.1.454.CMB.2.raw
  modified_base (284)..(284): a, c, t, g, unknown or other
  misc_feature (284)..(284): n is a, c, g, or t
  modified_base (556)..(556): a, c, t, g, unknown or other
  misc_feature (556)..(556): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagccgtggggcctcagtgaaggtctcctgtaaggcctcaggttacaccttcaccgctaatggtatcactggcttcgacnggcccctggacaaggcttgagtgggtggatggatcaactctcacacgtaggaagcagtagtctagtcgacggagagacttccgaaggggctaaggacgtcccgaaccccgtaggaaccccacgaagaacgaaccactacccaaccgaacccaacgtacgttacctaacagtaggaacgcgtaggtagggacgccggtaggacgaccgtaggaccgacgaccggccttattacttacgtgtcgcgaacgcccttatccttacgcgtcgacccncttccaacgtcttcggtccaccgttcgtcggggccgaaccggg

SEQ ID NO: 300161 - DNA, 604 bp, Homo sapiens
  misc_feature: GZ8MTXP01AU0TQ.11.72.G06.1.454.CMB.2.raw
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagccgtggggcctcagtgaaggtctcctgtaaggcctcaggttacaccttcaccgctaatggtatcacctggcttcgacacggcccctggacaaggcttggagtgggtggatggatcaactctacacactggaagcagagtctagtcggacggagagtacttccgaaggggcaaggactccgaccccgtgaacccacgagacgacactcccaacgaccaacgagtactacagtggacgcgtggagacgccggtggaacgaccgtcgaaccgaccgaccgtcccttacgtacgttacgtcgtcggcccggggtcctacgttcccgtacgacgttccgacccttaccgttccgaccgtcgtcggtccgaccgtcggacggggtccgaaccgggtaaccccg

SEQ ID NO: 300162 - DNA, 615 bp, Homo sapiens
  misc_feature: GZ8MTXP01BOPBH.11.72.G06.1.454.CMB.2.raw
  modified_base (218)..(218): a, c, t, g, unknown or other
  misc_feature (218)..(218): n is a, c, g, or t
  modified_base (284)..(284): a, c, t, g, unknown or other
  misc_feature (284)..(284): n is a, c, g, or t
  modified_base (403)..(403): a, c, t, g, unknown or other
  misc_feature (403)..(403): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctnagtgaaggtctcctgtaaggcctcaggttacaccttcaccgctaatggtatcacctggcttcgacnggcccctggacaaggcttggagtgggtggatggatcgaactctcacacgtggaagcagagtctatcggacgggagagacttccgaaaggggcaaggacgtcacccctgacccacgaganacactccaacgaccacacgtactacagtcggactcgtggaggacgccgtaggaacgtaccgtacggaacccgacgacccggtcccttacgttacgttacgtcggtcgccgggtaacggtcccttagtacccgttacgacgttaccgacccgttaccttcccgaacgtcgtcggttccgacccgttcgggtccggggaacccgtaacccgggg

SEQ ID NO: 300163 - DNA, 677 bp, Homo sapiens
  misc_feature: GZ8MTXP01AYXB5.11.72.G06.1.454.CMB.2.raw
  modified_base (216)..(216): a, c, t, g, unknown or other
  misc_feature (216)..(216): n is a, c, g, or t
  modified_base (237)..(237): a, c, t, g, unknown or other
  misc_feature (237)..(237): n is a, c, g, or t
  modified_base (254)..(254): a, c, t, g, unknown or other
  misc_feature (254)..(254): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagcctgggcctnagtgaagtctctgtaagcctnagttacaccttcaccgntaatggtatcacctggcttcgacaggcccctggacaaggcttggaggtgggtggatggatcaactctacacactggaagcaagagtctagtcggacggagagtattccgaaggggccaagacgtcccaacccgtcgaacccacgaggacgaacccacgtaccccaaaccggaacccaaccgtaacggttaccctaaccgtaaggttaggggaacgtccgttagggtacggggaaccgtccggttagggaaccgtacccgtacgggaaccgaacccgtaccgggccccttacgttacgttaaccgtggtcggaccggtaacggtccccttagtcccttaacgacgttaccgaacccgttccttcccgaacggtcgttaacgggttcccgacccgttcggtcgggggttaaccccgtaaccgggg

SEQ ID NO: 300164 - DNA, 589 bp, Homo sapiens
  misc_feature: GZ8MTXP01DRHZ5.11.72.G06.1.454.CMB.2.raw
  modified_base (213)..(213): a, c, t, g, unknown or other
  misc_feature (213)..(213): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggactgaggtgaagagctgggctnagtgagtctctgtaagctgagttacacttcacgctaatggtatcactgctcgacaggccctgacaggcttgagtgggtggatggatcgaactctacacacgtaggaagcaagagtctaagtcggacggagagtactcgaagggtcaaggactccacccgtagaccagagagacactaccgaacaccgatacgtactacgatggagtcgtggtacggacgcgtaggacgtacctacggaccgaccaccggcccttactacttcgtcggtcgaccggaacggtcccttaacgtccaacgtacgtacgaacccgttccgttacccaacggtccttaacgggttccgacccgtttcgggccggggttcccgtaaccgggg

SEQ ID NO: 300165 - DNA, 552 bp, Homo sapiens
  misc_feature: GZ8MTXP01A0XYQ.11.72.G06.1.454.CMB.2.raw
  modified_base (370)..(370): a, c, t, g, unknown or other
  misc_feature (370)..(370): n is a, c, g, or t
  modified_base (387)..(387): a, c, t, g, unknown or other
  misc_feature (387)..(387): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggcttgagtgggtgggatggatcaactctcacacgtggaagcagagtctagtgcggagagattccgaagggcngagtccaccctgaccanagagacatccacgaccacagtactacatggagctgtggacgccgtgacgacctggaccgacgaccggccctatattactgtcgcgaacggcccttatccttacgagtcgacccgcttcccaacgtcgtcggttccgacccgttcgtcgggggcccgtaaccgggg

SEQ ID NO: 300166 - DNA, 647 bp, Homo sapiens
  misc_feature: GZ8MTXP01CDULG.11.72.G06.1.454.CMB.2.raw
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagcctggggcctcagtgaaggtctcctgtaaggcctcaggttacaccttcaccgctaatggtatcacctggcttcgacacggcccctggacaaggactgagtgggtggatggatcaactctcacacgtggaagtcagagtctagtcggcggagagacttcccgaagggcaaggactccacccgtgaaccacagacgacatacccacgaccacagtactacgagtggacgtcgtaggcgggaacgccggttaggaacgtacccgaggaaccggaccgacccggtccctttacgtaacgtttaccgtggttccggccggtaaacggtccccttaagtaccccttaaacgtaccggttacgaaccccgttaccttaccccgtaaccgtccgtaacgggtttacccgacccgtttccggaacgggggttaaccccgtaacccggggg

SEQ ID NO: 300167 - DNA, 638 bp, Homo sapiens
  misc_feature: GZ8MTXP01D87XW.11.72.G06.1.454.CMB.2.raw
  modified_base (257)..(257): a, c, t, g, unknown or other
  misc_feature (257)..(257): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcattccttttcttggtggcagcagcaacaggtgcccactcacagggtcaactggtgcagtctggacctgaggtgaagagcctggggcctcagtgagtctctgtaaggcctgagttacaccttcaccgtntaatggtatcaccgtgcttcgacacgccctggacaggcttgagtgggtggatggatcaactctacacgacgtaggaagcagtagtctagtcggacggagagtacgttccgaaagggcaaggacgtccacccgtagaacccagaacgacgacacgtacccaaccgaccaacctagtacctaacgtagttacgggacgtccgtagggttacggacgtacccgggttagaaccggtaccgtacggaaccgtaccgacccggtccccttacgttacgttaccgtgtcggcgaacggtacccttatcccgttacacggtcacccgccttcccgaacgtccgttaacgggttcccgaccgttccggtcggggaacccgtaacccggg

SEQ ID NO: 300168 - DNA, 554 bp, Homo sapiens
  misc_feature: GZ8MTXP01A8VGO.11.72.G06.1.454.CMB.2.raw
  modified_base (369)..(369): a, c, t, g, unknown or other
  misc_feature (369)..(369): n is a, c, g, or t
  modified_base (499)..(499): a, c, t, g, unknown or other
  misc_feature (499)..(499): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaggacttgagtgggtgggatggatcaactctcacactggaagcagagtctatcgcggagagattccgaagggcngagtcaccctgaccacagagacatccacgaccacagtctacatggagctgtggagccgtgagcctgacgacgaccggccctctacttactgtcgcgaacgggcccttaagtccttaacgacgtcgacccncgttacccaacggcttcgggttccgacccgttcgtcgggggcccgtaaccggggg

SEQ ID NO: 300169 - DNA, 645 bp, Homo sapiens
  misc_feature: GZ8MTXP01C5P35.11.72.G06.1.454.CMB.2.raw
  modified_base (213)..(213): a, c, t, g, unknown or other
  misc_feature (213)..(213): n is a, c, g, or t
  modified_base (232)..(232): a, c, t, g, unknown or other
  misc_feature (232)..(232): n is a, c, g, or t
  modified_base (244)..(244): a, c, t, g, unknown or other
  misc_feature (244)..(244): n is a, c, g, or t
  modified_base (263)..(263): a, c, t, g, unknown or other
  misc_feature (263)..(263): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgagtgaagagctgggctnagtgaggtctctgtagctnagtacactcacntatgtatcactgctcgacncgccctggacaggcttgagtgggtggatggatcaactctacacacgtaggaagcagagtctagtcggacggagagtacgttaccgaaagggtacaaggtacgtacccaacccgtacgaacccgaacgaacggaacgaactactacccgaaaccgaccaacgtacgtaccttaacgagtagggaacgtcgtggtacgggaacgtccgtaaggaacgacccgaggaaccgacccgtaccggtcccttagtacttacgtcgtacggccggtaaccgtccttacgtacccgttagtaaccggtaccacccttccgttaccgtaaccggttccgttcgggttaccccgtaccggttaccggggtccggggaacccgttaacccgggg

SEQ ID NO: 300170 - DNA, 642 bp, Homo sapiens
  misc_feature: GZ8MTXP01CCFSO.11.72.G06.1.454.CMB.2.raw
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcacgctaatggtatcactggcttcgacaggcccctggacaaggcttggagtgggtggatggatcgaactctcacactggaagcagagtctagtcgcggagagtattccgaaggggcaagacgtccacccgtgacccaacagacgaccatcccacgaccacagtacacagtggagcgtggtggacgtccgtaggacgtacccgtggaaccgaccgaccgggtccccttacgttacgttaaccgtggtacggccggtaacccgggtaccccttaacgttccccgttaaaccgaacggttaccgaacccgttcccgttacccgtaacccggtccgtttaacgggttcccgacccgttccgggtaaccgggggaaccccgtaaccccggggg

SEQ ID NO: 300171 - DNA, 597 bp, Homo sapiens
  misc_feature: GZ8MTXP01C3T0H.11.72.G06.1.454.CMB.2.raw
  modified_base (445)..(445): a, c, t, g, unknown or other
  misc_feature (445)..(445): n is a, c, g, or t
  modified_base (538)..(538): a, c, t, g, unknown or other
  misc_feature (538)..(538): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagccgtggggcctcagtgaaggtctcctgtaacggcctcaggttacaccttcaccgctaatggtatcacctggcttcgacaggcccctggacaaggacttggagtgggtggatggatcaactctacacacgtggaagcagagtctagtcgacggagagacttccgaagggcaaggacgtcccaacccgtgacccacgagtacgactactaccaacgaccacagtactacgagtcggagtcnggtggacgcgtaggacgacctggaaccgaccaccggtccctagtacttacgtcggtacgccgaacggtccccttatcccagtacgcgaacccnccgttacccgtaacgtcgtcgggtccgtcccgttcgggtccgggaaccgtaacccgggg

SEQ ID NO: 300172 - DNA, 636 bp, Homo sapiens
  misc_feature: GZ8MTXP01EXH77.11.72.G06.1.454.CMB.2.raw
  modified_base (242)..(242): a, c, t, g, unknown or other
  misc_feature (242)..(242): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctnaggttacaccttcaccgctaatggtatcacctggcttcgacacggcccctggacaaggcttggagtgggtggatggatcaactctcacactggaagcagagtctagtcgcggagagtacttcccgaaggggcaaggacgtaccaaccccgtgaaacccacgaagaacgaccactacccgaaacgacccaacgacgttacctaacagtacgggacgcgtgggtacggaacgtcccgtaggaaccggtacccgtggaacccggaccgaccgggtccccttagtacgttaccgtggtacggcggaacggtccccttagtcccttaacgacgtacgacccgttccttccgaacgtcgttcgggttccgaccgttcgggtccggggcccgtaaccgggg

SEQ ID NO: 300173 - DNA, 613 bp, Homo sapiens
  misc_feature: GZ8MTXP01DL9MB.11.72.G06.1.454.CMB.2.raw
  modified_base (217)..(217): a, c, t, g, unknown or other
  misc_feature (217)..(217): n is a, c, g, or t
  modified_base (335)..(335): a, c, t, g, unknown or other
  misc_feature (335)..(335): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagccgtgggcctnagtgaggtctcctgtaaggcctcaggttacaccttcaccgctaatggtatcacctggctcgacacggcccctggaacaggcttgaggtgggtggatggatcaactctcacactggaancagagtctatcgcggagagtattccgaaagggcaaggacgtccaccccgtgaacccacagacgtacactacccgaacgacccacaacgtacctacaagtggacgcgtggtggacgccggtaggacgaacctcggaaccgaccgtaccggtcccttacgttacttacgtcggtacgccggtaacggtccccttataccccgttacgtaggtccgacccttaccttacccgaacgtcgttcggtcccgtacccgttcggtcggggaacccgtaaccgggg

SEQ ID NO: 300174 - DNA, 593 bp, Homo sapiens
  misc_feature: GZ8MTXP01CFR65.11.72.G06.1.454.CMB.2.raw
  modified_base (262)..(262): a, c, t, g, unknown or other
  misc_feature (262)..(262): n is a, c, g, or t
  modified_base (382)..(382): a, c, t, g, unknown or other
  misc_feature (382)..(382): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagccgtggggcctcagtgaaggtctcctgtaacggcctcaggttacaccttcaccgntaatggtatcacctggcttcgacacggcccctggacaaggcttggagtgggtggatggatcaactctacacacgtggaagcagagtctagtcggcggagagattcccggaaaggggtccnggacgtacccacccgtagacccaacgagacgacactccaacgaccacagtacctacagtggagcgtggaggcgccgtagacgacctaggaccgaccgaccggcccttagtacttacgtgtcgcgtaacggtcccttatccttacgagtcgacccttcttccgaacgtcgttaacgggttccacccggttcggtccggggccgtaaccgggg

SEQ ID NO: 300175 - DNA, 644 bp, Homo sapiens
  misc_feature: GZ8MTXP01DB5GL.11.72.G06.1.454.CMB.2.raw
  modified_base (215)..(215): a, c, t, g, unknown or other
  misc_feature (215)..(215): n is a, c, g, or t
  modified_base (234)..(234): a, c, t, g, unknown or other
  misc_feature (234)..(234): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggactgaggtgaagagcgtgggcctnagtgagtctctgtaagctnagtacacttcacgctaatgtatcactggctcgacagccctgacaggcttgagtggtggatggatcaactctcacactggaagcagatctagtcgcggagagacttccgaagggcaaggacgtaccaaccctacgaaccaacgagacgaacactaccgaacaaccctaacgacgtactaacgagtcgggaagtccgtggtacgggacgtacccggtggaaaccggtaccctaggaaccgaacccgacccggaccctttactaacttaaccttggtaccggaccggtaaccgggtcccttaaacgtaccccttaaagtacggttaccgaaccccgttacttaccccgaacggtccgtttcggggttaccccgtacccgttccgggtccggggggaacccctaaacccggggg

SEQ ID NO: 300176 - DNA, 716 bp, Homo sapiens
  misc_feature: GZ8MTXP01DMKLB.11.72.G06.1.454.CMB.2.raw
  modified_base (217)..(217): a, c, t, g, unknown or other
  misc_feature (217)..(217): n is a, c, g, or t
  modified_base (239)..(239): a, c, t, g, unknown or other
  misc_feature (239)..(239): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcattccttttcttggtggcagcagcaacaggtgcccactcacagggtcaactggtgcagtctggacctgaggtgaagagcctgggcctnagtgaagtctctgtaaggcctnagttacaccttcaccgctaatggtatcactgcttcgacaggcccctggacaggtacttgagtgggtggatggatacaaactcgtacaacgtacgtaggaaacgcaaggtacgtcgtaagtcggaccgggaagacgtacttcccgaaaggggcaaggagtacccacccgtagaaccccaagacgaacgaaccaactaccccgaacgaaccctaacgaacgtaccttaaacgagtaggaacgtcgtaggtacggaacggtcccggtaggaacggtaacccgtacggaaccgaaccgtaacccggacccctttaccgttaaacgtttaccgtacggtaccggtaccgggtaaccgggtaccccttaaacggtcccttaaaccgtacgggttaccgaaaccccgttccttacccgtaaccggtccgtttaaccgggttaccgacccgttcgggttaaccggggaacccgtaaaccccgggg

SEQ ID NO: 300177 - DNA, 724 bp, Homo sapiens
  misc_feature: GZ8MTXP01DWWEY.11.72.G06.1.454.CMB.2.raw
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcactggcttcgacaggcccctggaacaggacttgagtgggtgggatggatcaactctcacactggaagcagagtctagtcggacggagtagacgttcccgaaagggggccaagggtacgtacccgaaccccgttaggaaccccaacgaagggaacgaaccaacttaccccgaaaccggaaccccaaaccgtaacggttaaccctaaccgtaagttacggggaacggtccgttagggttacgggaccgtacccgggtttacggaacgggtaaccccgttacgggaaacccggaacccgtacccggggttacccccttaacgtttaacgtttaacccgtggttaccggccggtaaaccgggtccccttacgttacccttaacgtacgtcgaaccccgttccttacccgaacgtccgtcgggttccgaccgttcggtccgggggcccgtaaccggggg

SEQ ID NO: 300178 - DNA, 688 bp, Homo sapiens
  misc_feature: GZ8MTXP01EUYH9.11.72.G06.1.454.CMB.2.raw
  modified_base (242)..(242): a, c, t, g, unknown or other
  misc_feature (242)..(242): n is a, c, g, or t
  modified_base (308)..(308): a, c, t, g, unknown or other
  misc_feature (308)..(308): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctnagttacaccttcacgctaatggtatcacctggcttcgacaggcccctggacaggcttgaggtgggnggatggatcaactctacacacgtggaagcagagtctagtcggacggtagagtacttacccgaaaggggaccaaggtacgtcccgaaccccgtggaaccccaacgacggaacgaaccgaacgtaccccgaaaccggaaccccaacgtacggttaccctaacgtagttacgggaacggtcgtagggtacgggacgtcccggtaggaacgtacccgtagaaccgaccgacccgggtcccttacttacgttacgtcggtacgccggtaaacggtccccttaacgtcccttaacgtacggttaaccgaccccttccgttacccgtaacggtccgttaaccggtttcccgacccgttccgggtaaccggggcccgtaacccggggg

SEQ ID NO: 300179 - DNA, 672 bp, Homo sapiens
  misc_feature: GZ8MTXP01BQ9IP.11.72.G06.1.454.CMB.2.raw
  modified_base (217)..(217): a, c, t, g, unknown or other
  misc_feature (217)..(217): n is a, c, g, or t
  modified_base (255)..(255): a, c, t, g, unknown or other
  misc_feature (255)..(255): n is a, c, g, or t
  modified_base (278)..(278): a, c, t, g, unknown or other
  misc_feature (278)..(278): n is a, c, g, or t
  modified_base (303)..(303): a, c, t, g, unknown or other
  misc_feature (303)..(303): n is a, c, g, or t
  modified_base (358)..(358): a, c, t, g, unknown or other
  misc_feature (358)..(358): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagccgtgggcctnagtgagtctctgtaaggcctcgagttacaccttcacgntaatggtatcactggcttcgacnggccctggacaggcttgaggtgggnggatggatcaactctacacacgtaggaacgcaaggtagtctagtcggacggaagngtacttcccggaaaggggccaaggacgtacccaaccccgtcgaacccaacgagaccgacactacccgaaccgaccaacgtaacgtacctaacgaagtcgggaacgccgtagggtacgggtaccgtaccggttaggaaaccggtacccgtacgggaaacccgacccgtaacccggttcccctttagtacgtttacgtggtacggccggtaaccgtcccttacgtcccttacggtacgtcccgaacccttcttccccgaacggttcgttaacgggttcccgaccggttccgggtccggggaacccgtaacccgggg

SEQ ID NO: 300180 - DNA, 618 bp, Homo sapiens
  misc_feature: GZ8MTXP01DOLA3.11.72.G06.1.454.CMB.2.raw
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaaatggtatcactggcttcgacaggcccctggacaaggacttgagtgggtggatggatcaaactctcacacgtggaagcagagtctatcgcggagagattccgaaaggggcaagagtccaccctagaccacagagacagtccaacgaccacagtactacatggagctggtacggacgacccggtaggaccgtaccgtacggaaccgacccgaaccgggtccccttaagttaacgttacgtcggtacggcggtaaccgtacccttactacccttaacgacggtaccgacccgttaccttcccgtaacgtcggttcggttacccggaccttccgggtccgggaaccgtaaaccccgggg

SEQ ID NO: 300181 - DNA, 560 bp, Homo sapiens
  misc_feature: GZ8MTXP01CHVZB.11.72.G06.1.454.CMB.2.raw
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggcttggagtgggtgggatggatcaactctcacactggaagcagagtctatcggcggagagattccgaaggggccaaggacgtaccacccgtgacccacgagacgacactccacgaccacagtactacatggagcgtgtggacgccgtgacgacctgaccgacgacggccctactattactgtcgcgaacggcccttatccttacgacgtcgacccacttcccgaacgcgttcggtcgaccgttcgtcggggccgtaaccggg

SEQ ID NO: 300182 - DNA, 700 bp, Homo sapiens
  misc_feature: GZ8MTXP01DC1LN.11.72.G06.1.454.CMB.2.raw
  modified_base (376)..(376): a, c, t, g, unknown or other
  misc_feature (376)..(376): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagccgtgggcctcgagtgaaggtctcctagtaacggcctacgaggttaccaccttcaccgactaatggtatcacctggcttcgacacggcccctaggaacaaggtcttggaggtgggtagggatggatcgaactctcacacgtaggaagcgagagtctagtcggacggaagngtacgtccggaagggacaagacgtacccacccgtagaacccacgacgacgactacaccgaacgaccacgtaacggtactacgagtacggacgtgtcggtacgggaccgtccgggtaacggaccgtaacccgtacgggaacccgtaacccgtacccggtacccttaccgtttagttacccgttaggccggtaacccggtaaccggttccccttacgtacccgttaacgtaccggtcccttaaacccgttccgttaccccgtcggttaccgttccgggttacccgtaccggttccgggttaaccggggaacccggtaaccccgggg

SEQ ID NO: 300183 - DNA, 556 bp, Homo sapiens
  misc_feature: GZ8MTXP01DLATK.11.72.G06.1.454.CMB.2.raw
  modified_base (366)..(366): a, c, t, g, unknown or other
  misc_feature (366)..(366): n is a, c, g, or t
  modified_base (383)..(383): a, c, t, g, unknown or other
  misc_feature (383)..(383): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagcctggggcctcagtgaaggtctcctgtaaggcctcaggttacaccttcaccgctaatggtatcacctggcttcgacaggcccctggacaaggcttgagtgggtggatggatcaactctcacactggaagcagagtctatgcggagagattccgaagggcngagtccaccctgaccanagagacatccacgaccacagtactacatggagctgtagacgccgtagacgacctgacgaccaccggcctactattacgtgtcgcgtaacggcccttagtcccttacgacgtcgacccttcttcccgaacgtcgtcgggttccgaccgttcggtccgggggccgtaacccgggg

SEQ ID NO: 300184 - DNA, 638 bp, Homo sapiens
  misc_feature: GZ8MTXP01D2P7R.11.72.G06.1.454.CMB.2.raw
  modified_base (238)..(238): a, c, t, g, unknown or other
  misc_feature (238)..(238): n is a, c, g, or t
  modified_base (301)..(301): a, c, t, g, unknown or other
  misc_feature (301)..(301): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagcctgggcctcagtgaggtctcctgtaaggctnagttacacttcaccgctaatggtatcactggcttcgacaggcccctggacaggctgagtgggnggatggatcaactctcacacgtggaagcaagagtctatcggacggagagattaccgaagggcaaggacgtccacccgtagaaccacgagtacgacactaccaacgaccacacgtactaacagtacggaacgcgtacggtaggacgtaccgtaggacgtaccgtacgaacccgaccgtaccgggacccctttacgtaacgttaccgttcggtaccgccggaacgggtccccttaagtccccgttaaacgacggttaccgaacccttccgttaccccgtaacggtccgttccggtttccgacccggttcgggttccggggaaccccgtaaacccggggg

SEQ ID NO: 300185 - DNA, 588 bp, Homo sapiens
  misc_feature: GZ8MTXP01B2EUY.11.72.G06.1.454.CMB.2.raw
  modified_base (217)..(217): a, c, t, g, unknown or other
  misc_feature (217)..(217): n is a, c, g, or t
  modified_base (313)..(313): a, c, t, g, unknown or other
  misc_feature (313)..(313): n is a, c, g, or t
  modified_base (534)..(534): a, c, t, g, unknown or other
  misc_feature (534)..(534): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagcctggggcctnagtgaaggtctccgtgtaaggcctcgaggttacaccttcaccgctaatggtatcacctggcttcgacacggcccctggacaaggcttggagtgggnggatggatcaactctacacacgtggaagcagagtctagtcggacggagagactcgaagggcaagacgtccacccgtagaaccacgagacgacataccacgaccacagtactacgagtgggagcgtagtaggacgcgtgacgaccctggaaccgaccgaccggtcccttactattacgtcggtacgcgaaccggtcccttagtcccttacgacgtcgacccncgttacccaacgtccgttcggtacccgccgttcggtccggggccgtaaccgggg

SEQ ID NO: 300186 - DNA, 748 bp, Homo sapiens
  misc_feature: GZ8MTXP01B88JD.11.72.G06.1.454.CMB.2.raw
  modified_base (239)..(239): a, c, t, g, unknown or other
  misc_feature (239)..(239): n is a, c, g, or t
  modified_base (254)..(254): a, c, t, g, unknown or other
  misc_feature (254)..(254): n is a, c, g, or t
tcagcgagagataccacgaccggtgctcgatttagctacgactgcaagggaaaggggacccaaaaaccacaccctccttgggagaatccctagatcatagctcctcaccatggactggacctggagcattccttttcttggtggcagcagcaacaggtgcccactcacagggtcaactggtgcagtctggacctgaggtgaagagccgtgggcctcagtgaaggtctctgtaaggcctnagttacacttcacgntaatgatcactggcttcgacacggccctggacaaggtcttggaggtgggtggatggatcaactctacacacgtggaagcaagtacgtctaagtcggacgggagacgtacttcccggaaagggggaccaagggacgttacccaaccccgtaggaaaccccagaaggaacgaccaactaccccgaaccgaacccaacgtaacggtaccttaaaccgagtcggggaacgtccgttagggtacggggaaccgtccgggttaacgggaaccggtaacccgttacgggaaacccggtaccgaaccccggggttcccctttaaaccgtttaacgtttaacccggtcggttcgggacccggtaacccggggtaccccttaaacggtttaccccaaccgtaaacgggttcccgaaaccccttcgttaccccgtaaccggtccgtttaacgggtttaccgaccccggtttcgggaacccgggggttaacccgtaaacccggggg

SEQ ID NO: 300187 - DNA, 628 bp, Homo sapiens
  misc_feature: GZ8MTXP01EJXQN.11.72.G06.1.454.CMB.2.raw
  modified_base (217)..(217): a, c, t, g, unknown or other
  misc_feature (217)..(217): n is a, c, g, or t
  modified_base (237)..(237): a, c, t, g, unknown or other
  misc_feature (237)..(237): n is a, c, g, or t
  modified_base (243)..(243): a, c, t, g, unknown or other
  misc_feature (243)..(243): n is a, c, g, or t
  modified_base (251)..(251): a, c, t, g, unknown or other
  misc_feature (251)..(251): n is a, c, g, or t
  modified_base (259)..(259): a, c, t, g, unknown or other
  misc_feature (259)..(259): n is a, c, g, or t
  modified_base (272)..(272): a, c, t, g, unknown or other
  misc_feature (272)..(272): n is a, c, g, or t
  modified_base (329)..(329): a, c, t, g, unknown or other
  misc_feature (329)..(329): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagccgtgggcctnagtgagtctctgtaagcctnagtacncttcacgntaatgtancactggctcgacncggccctggacaggcttggagtgggtggatggatcaactctacactacgtaggaacncagtacgtctagtcggacgggaagtagtacgttcccgaaaggggcaaggtactacccgacccgtacgaaccacgacggaacgactacacccaacgaccaatacggtactaacgagtacggacgtcgttaggacggtacgacccggtaggaaccgaccgtacggaaccgaccacccggtcccttacgtacttacgtcgtcgaccggaacgtcccttactaccttacgacgtacgacccttaccgttccgaacgtcgttaacggtcccgaccgttcgggtccggggaacccgtaacccggg

SEQ ID NO: 300188 - DNA, 518 bp, Homo sapiens
  misc_feature: GZ8MTXP01BICP2.11.72.G06.1.454.CMB.2.raw
  modified_base (364)..(364): a, c, t, g, unknown or other
  misc_feature (364)..(364): n is a, c, g, or t
  modified_base (366)..(366): a, c, t, g, unknown or other
  misc_feature (366)..(366): n is a, c, g, or t
  modified_base (450)..(450): a, c, t, g, unknown or other
  misc_feature (450)..(450): n is a, c, g, or t
  modified_base (482)..(482): a, c, t, g, unknown or other
  misc_feature (482)..(482): n is a, c, g, or t
tcagcgagagataccacgaccggtgctcgatttagctacgactgcaagggaaagggacccaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcactggcttcgacaggcccctggacaaggcttgagtgggtgggatggatcaactctcacactggaagcagagtctatgcggagagattccaagggcngngtcaccctgaccacagagacatccacgaccacagtctacatcggagctgtgagccgtgagacctgacgcacggccctctatacngtgcgaacggcccttatccttacgagtgaccncttccaacgctcggttcgacttcgtcggcgaaccgg

SEQ ID NO: 300189 - DNA, 650 bp, Homo sapiens
  misc_feature: GZ8MTXP01BLNTB.11.72.G06.1.454.CMB.2.raw
  modified_base (281)..(281): a, c, t, g, unknown or other
  misc_feature (281)..(281): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcactgctcgacnggcccctggacaaggcttgagtggtggatggatcaactctacacactggaacgcagagtctagtcggacggagagattcccgaaggggcaaggactccgaccctcggaaccaacgagacgacactccgaacgaccacgaagtccaactagtacggaagcgtggtaggaacgtccggtaggacgaacccgtacggaaccgacccgaaccggtcccctacgttaacgttaccgtgttaccggccggtaaccgtacccgttacgttacccttacgtaaccggttacaccccttaaccgttccccgtaacgttcccgttaacgggtttccccgaccggttccgtaacccgggggttcccgtaaaccccggggg

SEQ ID NO: 300190 - DNA, 561 bp, Homo sapiens
  misc_feature: GZ8MTXP01EZL0I.11.72.G06.1.454.CMB.2.raw
  modified_base (241)..(241): a, c, t, g, unknown or other
  misc_feature (241)..(241): n is a, c, g, or t
  modified_base (369)..(369): a, c, t, g, unknown or other
  misc_feature (369)..(369): n is a, c, g, or t
  modified_base (512)..(512): a, c, t, g, unknown or other
  misc_feature (512)..(512): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagcctggggcctcagtgaaggtctcctgtaaggcctnaggttacaccttcaccgctaatggtatcacctggcttcgacaggcccctggacaaggcttgagtgggtggatggatcaactctcacactggaagcagagtcatcgacggagagattccgaaaggggcngagtccaccctgaaccacagagacatcccacgaccacagtacacatcggagctgtaggagccgtgacgacctggaaccgaccgaacggtcccctacttattaccgtggtacgcggaacggcccttatccttacacgtcgaccncttcccaacgtcgtcggttccgaccgttccgtgggggccctaaccgggg

SEQ ID NO: 300191 - DNA, 666 bp, Homo sapiens
  misc_feature: GZ8MTXP01CFY8Q.11.72.G06.1.454.CMB.2.raw
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagcctggggcctcagtgaaggtctcctgtaaggcctcaggttacaccttcaccgctaatggtatcacctggcttcgacaggcccctggacaaggcttggagtgggtgggatggatcaactctcacactggaagcagagtctagtcggcggagagacttccgaaggggcaaggacgtaccgacccctggaaccccacgacgacgacactcccaacgacccacacgtactacatcgggagtccgtggtcggacgcccgtaggacgtacccgtaggaaccgaccgaccgggtccccttacgttacgtttaacccgtggttcggcccggtaaccgggtccccctttaacgttccccgttaacgtaaccggttccgaaccccgttacccgttaccccgaaccggtcccgttcggggtttccccggacccgtttccgggtaaccggggggccccgtaaacccgggggg

SEQ ID NO: 300192 - DNA, 645 bp, Homo sapiens
  misc_feature: GZ8MTXP01EJX66.11.72.G06.1.454.CMB.2.raw
  modified_base (216)..(216): a, c, t, g, unknown or other
  misc_feature (216)..(216): n is a, c, g, or t
  modified_base (234)..(234): a, c, t, g, unknown or other
  misc_feature (234)..(234): n is a, c, g, or t
  modified_base (240)..(240): a, c, t, g, unknown or other
  misc_feature (240)..(240): n is a, c, g, or t
  modified_base (297)..(297): a, c, t, g, unknown or other
  misc_feature (297)..(297): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagcctgggcctnagtgagtctctgtagctnagtacnctcacgctaatgatcactggcttcgacacggcccctggacaggacttggaggtgggnggatggatcaactctacacacgtaggaagcagagtctagtcggcggagagtacttcccgaaaggggtcaaggacgtacccaaccccgtagaacccacgagaacgaccactacccaacgaccaacagtactaacgagtacgggagcgtggtacgggacgccggtaggaacgtacccgtacggaacccgaccgacccggtcccttacgttacgttacgtcggttacggccggtaacggtaccccttactacccgttaacgtacgtaacggaccccttaccgttaccccgaacggtcccgttcgggttcccgtacccgttccgggtccgggggaaccccgtaacccggggg

SEQ ID NO: 300193 - DNA, 584 bp, Homo sapiens
  misc_feature: GZ8MTXP01BM9HK.11.72.G06.1.454.CMB.2.raw
  modified_base (259)..(259): a, c, t, g, unknown or other
  misc_feature (259)..(259): n is a, c, g, or t
  modified_base (313)..(313): a, c, t, g, unknown or other
  misc_feature (313)..(313): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctgggcctcagtgaaggtctcctgtaaggcctcaggttacaccttcaccgntaatggtatcacctggcttcgacacggcccctggacaggcttggagtgggtggntggatcaactctacacacgtggaagcagagtctagtcggacggagagtacgttcccgaaggggcaaggagtacccaaccccgtgacccacgagacgacactcccaacgaccacagtactacagtggagcgtggtggacgccgtaggacgtaccgtagaccgaccgcccggtcccttataagttcctggtcgcggtaacggtcccttatcccttagacgtcgacccgcttccgcgtcgtcggttccgccgttcgtcggggccgtaaccgggg

SEQ ID NO: 300194 - DNA, 704 bp, Homo sapiens
  misc_feature: GZ8MTXP01C9IT7.11.72.G06.1.454.CMB.2.raw
  modified_base (282)..(282): a, c, t, g, unknown or other
  misc_feature (282)..(282): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctccgtgtaaggcctcaggttacaccttcacgctaatggtatcactggctcgacncggcccctggaacaggtcttggagtgggtggatggatcaactctacacacgtggaagcagacgtctagtcggcggagagtacttcccgaaaggggtccaaggacgtcccgaaccctggaacccacgagacactactacccacgaaccacgtacgtactaaccgagttacggacgtacgtggtacgggtaaccgcccggttaaggaaccggtaacccgttacgggaaacccggaacccgtacccgggggtcccctttaaccgttaacgtttacccggtggttaccggcccggtaaccgggtccccttaacggttcccttaaacggtacgggtacccttaacccgttcccttaccccgaaccggttccgttcggggtttaccccacccggttcgggtccgggggttaacccgtaaccccggggg

SEQ ID NO: 300195 - DNA, 718 bp, Homo sapiens
  misc_feature: GZ8MTXP01D8L4F.11.72.G06.1.454.CMB.2.raw
  modified_base (218)..(218): a, c, t, g, unknown or other
  misc_feature (218)..(218): n is a, c, g, or t
  modified_base (244)..(244): a, c, t, g, unknown or other
  misc_feature (244)..(244): n is a, c, g, or t
  modified_base (262)..(262): a, c, t, g, unknown or other
  misc_feature (262)..(262): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagccgtggggcctnagtgaaggtctccgtgtaacggcctnaggttacaccttcaccgntaatggtactcacctggcttcgacacggcccctggacaaggcttggaggtgggtaggatggatcaactctacacacgtaggaacgcaagtagtctagtcgacgggaagagtacttcccggaagggtacaagggactacccgacccgtagaacccaacgagaacgactacgtacccaaccgacctaacacgtacctacgagtggaacgtcgttagggagggccgtaccggtaggacgtaacccgtaggaacccgtaacccgacccgggtacccctttaacgttaacgtttaaccggtggtccgtacgggtaacccgttccccttaaacgttaccccgtttaaacgaccggttacccgaaaccccgttaccgttccccgtaaccggttcccgtttaacgggttaccccgtaacccgggttccgggttaacccggggggaaccccgttaaacccggggg

SEQ ID NO: 300196 - DNA, 636 bp, Homo sapiens
  misc_feature: GZ8MTXP01BVBUG.11.72.G06.1.454.CMB.2.raw
  modified_base (218)..(218): a, c, t, g, unknown or other
  misc_feature (218)..(218): n is a, c, g, or t
  modified_base (242)..(242): a, c, t, g, unknown or other
  misc_feature (242)..(242): n is a, c, g, or t
  modified_base (281)..(281): a, c, t, g, unknown or other
  misc_feature (281)..(281): n is a, c, g, or t
  modified_base (401)..(401): a, c, t, g, unknown or other
  misc_feature (401)..(401): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctnagtgaaggtctcctgtaaggcctnagttacaccttcacgctaatggtatcactggcttcgacnggcccctggacaggcttggaggtgggtggatggatcaactctcacacgtggaaagcagagtctagtcggcggagagtattcccgaaaggggccaagggtactcccacccgtagaacccanagaacgaccactccaacgaccacgtagtactacagtggagcgtaggtcggacgccggtagaacgtaccgtaggaaccggaccgacccggtcccttactacgttacgtgtccggcgtaacccgggtcccttacgtaccgttacgtacgtcgttaaccccttccgttacccgaaccgttccgttcgggttaccccgacccggttccgggttcccgggggaacccgtaaccccggggg

SEQ ID NO: 300197 - DNA, 615 bp, Homo sapiens
  misc_feature: GZ8MTXP01B6G7F.11.72.G06.1.454.CMB.2.raw
  modified_base (336)..(336): a, c, t, g, unknown or other
  misc_feature (336)..(336): n is a, c, g, or t
  modified_base (354)..(354): a, c, t, g, unknown or other
  misc_feature (354)..(354): n is a, c, g, or t
tcagcgagagataccacgaccggtgctcgatttagctacgactgcaagggaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggccctggacaaggacttgagtgggtggatggatcaactctacacactggaancagagtctatcgcggagngattccaagggcaagagtcacccgtgaccacagagacataccacgaccacagtactacatggagctggtcggaagtccgtaggacgtaccccgtaggaacccgaccgaacccgggtccccttactaacgtttaacccgtgttcggaccggttaacgggacccctttagtacccttacgacgttacggaaccccgttccttacccgaaccggtcctcgggtttacccggacccttcggttccgggggcccgtaacccggggg

SEQ ID NO: 300198 - DNA, 675 bp, Homo sapiens
  misc_feature: GZ8MTXP01EU5D9.11.72.G06.1.454.CMB.2.raw
  modified_base (214)..(214): a, c, t, g, unknown or other
  misc_feature (214)..(214): n is a, c, g, or t
  modified_base (242)..(242): a, c, t, g, unknown or other
  misc_feature (242)..(242): n is a, c, g, or t
  modified_base (244)..(244): a, c, t, g, unknown or other
  misc_feature (244)..(244): n is a, c, g, or t
  modified_base (385)..(385): a, c, t, g, unknown or other
  misc_feature (385)..(385): n is a, c, g, or t
  modified_base (454)..(454): a, c, t, g, unknown or other
  misc_feature (454)..(454): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctgacctgcgtagaagagctggggctnagtgagtctctgtagctcagtacactcncntatgtatcactgctcgacacggccctgacgaaggtacgttggtaggtgggtgggagtggatcactctcacacgtaggaagcgagagtactacgtaggacggagagtacgtacgacgggcgagacgtccacccgcgaccacnaacgaacgacactacccgaccgacccacgactacctaacgtacgtacgggtacggtcgtggtacggggnccgtaccgtacggaaccggtaacccggtaccggtaacccggtaacccggaccccggtaccccgttaccgttaaccgtttacggtttaacggtccgggttaccgggtacccggttacccgttacccgttccccaaaccgttaccggttaccgtaacccgtacccgtaacccgtacccggtaccggttaccgggtttaacccggttaacccggttaacccggg

SEQ ID NO: 300199 - DNA, 525 bp, Homo sapiens
  misc_feature: GZ8MTXP01BLUUK.11.72.G06.1.454.CMB.2.raw
  modified_base (367)..(367): a, c, t, g, unknown or other
  misc_feature (367)..(367): n is a, c, g, or t
  modified_base (448)..(448): a, c, t, g, unknown or other
  misc_feature (448)..(448): n is a, c, g, or t
  modified_base (488)..(488): a, c, t, g, unknown or other
  misc_feature (488)..(488): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctgggcctcagtgaaggtctcctgtaaggcctcaggttacaccttcaccgctaatggtatcacctggcttcgacaggcccctggacaggacttgagtgggtgggatggatcgaactctcacactggaagcagagtctatgcggagagattccaagggcngagtcaccctgaccacagagacatccacgaccacagtctacatggagctgtgagccgtgacgacctgacgacacggccctntacttactgtgcgaaggcccttatcccttagagtcgaccncttccaacgctggttcaccttcgtcgggccaacgggg

SEQ ID NO: 300200 - DNA, 561 bp, Homo sapiens
  misc_feature: GZ8MTXP01APO8B.11.72.G06.1.454.CMB.2.raw
  modified_base (368)..(368): a, c, t, g, unknown or other
  misc_feature (368)..(368): n is a, c, g, or t
  modified_base (385)..(385): a, c, t, g, unknown or other
  misc_feature (385)..(385): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcactggcttcgacaggcccctggacaaggcttgagtgggtggatggatcaactctcacactggaagcagagtctagtcgcggagagattccgaagggcngacgtcaccctgaccanagacgacatccacgaccacacgtactacatggagctggtgacgccgtgacgacctggaccgacgaccggtccctactacttaccgtggtcgcggaacggtcccttagtcccttacgagtcgacccgccttccgaaccgtcgtcggttccgaccgttcgtcggggccgtaaccgggg

SEQ ID NO: 300201 - DNA, 727 bp, Homo sapiens
  misc_feature: GZ8MTXP01CE52D.11.72.G06.1.454.CMB.2.raw
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagccgtgggcctcagtgaggtctccgtgtaacggcctcgagttacaccttcaccgctaatggtatcacctggtcttcgacacggcccctaggaacaggcttggaggtgggtggatggatcaactctacacacgtaggagtcagagtctagtcgacggagagtactccgaagggtcaaggtacgtacccgaacccgtgaaccctaacgacgaacgaacctacgaaccccgaaacgaacccgaacgtaacggtaccttaaacgaggttacgggaacgtccgttagggtagggtaaccgttccgggtaaggtaaccggtacccgttacgggaacccggaacccgtaccccgggtaccctttacggttacgtttaccgtcgggttaccggaccggtaaccccgggtacccttaacgttacccggttaccgtaacgggtaccgaaccccttccgttaccccgtaaccggtccgtttcggggtaccccgtaccggttccgggaaccgggggaaccccgtaaccccgggg

SEQ ID NO: 300202 - DNA, 686 bp, Homo sapiens
  misc_feature: GZ8MTXP01BEVSD.11.72.G06.1.454.CMB.2.raw
  modified_base (242)..(242): a, c, t, g, unknown or other
  misc_feature (242)..(242): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctnaggttacaccttcaccgctaatggtatcacctggcttcgacaggcccctggacaaggcttggagtgggtgggatggatcgaactctcacactggaagcagagtctagtgacggagagacgttaccgaaggggacaaggacgtacccaacccgtggaacccaacaggaacgaaccaacgtacccaaccgacccaaccgtacgtacctaccaagttacgggacgtccgtggttacggggaacgtcccgggtacggaacggtaacccgtacggaaccggaacccgtacccggggtacccctttacgttaacgtttaaccgtcggttacggcccgggtaacgggtccccttaggtaccccttaacgacggttccgaaccccttcgttcccgaacggtcccgtccggtttccgacccgttccgggtcgggggaacccgtaacccggggg

SEQ ID NO: 300203 - DNA, 621 bp, Homo sapiens
  misc_feature: GZ8MTXP01A81RC.11.72.G06.1.454.CMB.2.raw
  modified_base (338)..(338): a, c, t, g, unknown or other
  misc_feature (338)..(338): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggcttggagtggggtggatggatcaactctcacactggaancaggagtctagtggacggagagacttccgaaggggcaagacgtccaccctgaccacagagacatcccacgaccacagtacctacagtggaacgctaggtcgggacgcccggttggaaccgccttacggaaccgaccgacggtccccctagttaacttaccgtggttcggcgtaacggtccccttaaagtccccgttaacgtacggtcgaccccttaccgttccccgaacggtccgttcggttcccggacccgttccgggtcggggaaccccgtaacccggggg

SEQ ID NO: 300204 - DNA, 664 bp, Homo sapiens
  misc_feature: GZ8MTXP01DX0RS.11.72.G06.1.454.CMB.2.raw
  modified_base (218)..(218): a, c, t, g, unknown or other
  misc_feature (218)..(218): n is a, c, g, or t
  modified_base (236)..(236): a, c, t, g, unknown or other
  misc_feature (236)..(236): n is a, c, g, or t
  modified_base (242)..(242): a, c, t, g, unknown or other
  misc_feature (242)..(242): n is a, c, g, or t
  modified_base (250)..(250): a, c, t, g, unknown or other
  misc_feature (250)..(250): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcattcctttttcttggtggcagcagcaacaggtgcccactcacagggtcaactggtgcagtctggacctgaggtgaagagccgtgggctnagtgagtctctgtagctnagtacncttcacgntaatgtatcactgcttcgacacggccctggacaaggcttggaggtgggtaggatggatcaactctacactacgtaggaagcagtagtctagtcggacggagagacttccggaagggcaaggactacccacccgtagaacccagagacacactacccaacgacaacacgtactacgagtggagtcgtggtacggacgccgtaggacgtacccgtacggaacccgaccgtcccggtacccttacgttaacgttaccgtgggtccggccggtaacccgggttccccttacggttaccccttaaacgtaaccggttacccgaaaccccttacccgttaccccgtaaccggttcccgttaaccggggtttacccgacccggttccggggtaaccgggggaaccccggtaaacccggggg

SEQ ID NO: 300205 - DNA, 641 bp, Homo sapiens
  misc_feature: GZ8MTXP01CGCS4.11.72.G06.1.454.CMB.2.raw
  modified_base (218)..(218): a, c, t, g, unknown or other
  misc_feature (218)..(218): n is a, c, g, or t
  modified_base (236)..(236): a, c, t, g, unknown or other
  misc_feature (236)..(236): n is a, c, g, or t
  modified_base (241)..(241): a, c, t, g, unknown or other
  misc_feature (241)..(241): n is a, c, g, or t
  modified_base (245)..(245): a, c, t, g, unknown or other
  misc_feature (245)..(245): n is a, c, g, or t
  modified_base (247)..(247): a, c, t, g, unknown or other
  misc_feature (247)..(247): n is a, c, g, or t
  modified_base (266)..(266): a, c, t, g, unknown or other
  misc_feature (266)..(266): n is a, c, g, or t
  modified_base (303)..(303): a, c, t, g, unknown or other
  misc_feature (303)..(303): n is a, c, g, or t
  modified_base (582)..(582): a, c, t, g, unknown or other
  misc_feature (582)..(582): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacgagggtcaactggtgcagtctggacctgaggtgaagagccgtgggcctnagtgagtctctgtagctnagtcnctcncntatgtatcactgctcgacncgccctgacaggctgagtggtggatggatcgaactcncacacgtaggaacgcagtacgtctagtcggacggagagtacgttccggaaaggggtcaaggacgtacccaacccgtacgaacccgaacgaggaacaccactacccaaccgaccaacgtacgtactaacgaagtcgggaacgtcgttaggtacgggaacgtccggttacggaacgtaacccgtacggaaacccgtaacccgacccggtccccttaacgttacgttaccgtcggtcgaccggtaaccggtccccttagtacccttacgtacgtccgacccnccttacccgcgtcgttccggttccgcccggttacggtcccggggaaccgtaacccgggg

SEQ ID NO: 300206 - DNA, 607 bp, Homo sapiens
  misc_feature: GZ8MTXP01A54P8.11.72.G06.1.454.CMB.2.raw
  modified_base (242)..(242): a, c, t, g, unknown or other
  misc_feature (242)..(242): n is a, c, g, or t
  modified_base (260)..(260): a, c, t, g, unknown or other
  misc_feature (260)..(260): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctnaggttacaccttcaccgntaatggtatcactggcttcgacaggcccctggacaaggctgagtgggtggatggatcaactctcacacgtggaagcagagtctagtcggcggagagattccgaaagggcaagactccaccctgaccacagacgacactccaacgaccacagtactacagtggagctggtgacgccgtagacgacctaggaccgacgcccggtccctactaacttaccgtaggtcggacccgtaacgggtccccttaacgtccccttaacgacggttaccgaaccccttcttaccccgaacggtaccgttcgggttacccgtacccgttcggttccgggggaacccgtaacccggggg

SEQ ID NO: 300207 - DNA, 601 bp, Homo sapiens
  misc_feature: GZ8MTXP01ELQ5Z.11.72.G06.1.454.CMB.2.raw
  modified_base (216)..(216): a, c, t, g, unknown or other
  misc_feature (216)..(216): n is a, c, g, or t
  modified_base (238)..(238): a, c, t, g, unknown or other
  misc_feature (238)..(238): n is a, c, g, or t
  modified_base (276)..(276): a, c, t, g, unknown or other
  misc_feature (276)..(276): n is a, c, g, or t
  modified_base (292)..(292): a, c, t, g, unknown or other
  misc_feature (292)..(292): n is a, c, g, or t
  modified_base (301)..(301): a, c, t, g, unknown or other
  misc_feature (301)..(301): n is a, c, g, or t
  modified_base (326)..(326): a, c, t, g, unknown or other
  misc_feature (326)..(326): n is a, c, g, or t
  modified_base (574)..(574): a, c, t, g, unknown or other
  misc_feature (574)..(574): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagcctgggcctnagtgaggtctctgtaaggcctnagttacaccttcaccgctaatggtatcactgctcgacncgccctgacaggctgngtgggtggntggatcaactctcacacgtggaacncagacgtctagtcggcggtagagtacgttcccgaaggggcaaggtacgtccaacccgtgaacccaagagacgaccacgtacccaaccgaccaacgtagtaccacgagtagggagtcgtgggtacggacgtccgtacggaaccgtaccgacggaacccgaccgtaccggtcccttacgttactacgttgcgcgaacgtcccttatcccttagacgtacgaccttcttcccgaacgtcgtccgggtcccncgttcgggtccgggcccgtaacccggg

SEQ ID NO: 300208 - DNA, 620 bp, Homo sapiens
  misc_feature: GZ8MTXP01ELYDQ.11.72.G06.1.454.CMB.2.raw
  modified_base (238)..(238): a, c, t, g, unknown or other
  misc_feature (238)..(238): n is a, c, g, or t
  modified_base (296)..(296): a, c, t, g, unknown or other
  misc_feature (296)..(296): n is a, c, g, or t
  modified_base (431)..(431): a, c, t, g, unknown or other
  misc_feature (431)..(431): n is a, c, g, or t
tcagcgagagataccacgaccggtgctcgatttagctacgactgcaagggaaagggacccaaaaaccacacccctccttgggagaatcccctagatcatagctcctcaccatggactggacctggagcatccttttcttggtggcagcagcaacaggtgcccactcacagggtcaactggtgcagtctgggacctgaggtgaagaagcctggggcctcagtgaggtctctgtagcctnagttacacttcacgctaatgtatcactggctcgacacggccctgacaggctgagtggnggatggatcaactctcacactggaaagcaagagtctagtcggcgggaagagacttacccggaaggggacaaggactaccgaccccgtagaacccaagaggaacgacacacccaacgacccaacacgttacctaanagtcggacgtcgttaggtagggacgccggttaggaacgacctacggaaccgaccgacccggtcccttactacttaccgtgtcggccgaacggtccccttaacgtcccttaacgacggttacaacccgttccttacccgaacgtcgttcggttaccgacccgttcggtccggggaaccgtaacccggggg

SEQ ID NO: 300209 - DNA, 689 bp, Homo sapiens
  misc_feature: GZ8MTXP01B6NR2.11.72.G06.1.454.CMB.2.raw
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacacggcccctggacaaggcttggaggtgggtggatggatcgaactctacacacgtaggaagcagagtctatcggcggagagactccgaaaggggcaaggacgtccaaccccgtgaacccacgaagacgaccacgtcccaacgaccacgacgtacctaacgagttcgggagtcgtggttagggaacgtcccggttaggaaccggtaccgtacgggaaccgaccgtacccggggtaccccttacgttacgtttaacccgtcggttcgggcccgggtaaccggtcccccttaaacgttccccgttaaacggtaccggttaccggaacccccttaccgttccccgaaccggtcccggttcgggtttccccggacccgttcccgggttccgggggccccgtaaacccggggg

SEQ ID NO: 300210 - DNA, 599 bp, Homo sapiens
  misc_feature: GZ8MTXP01B5FPN.11.72.G06.1.454.CMB.2.raw
  modified_base (239)..(239): a, c, t, g, unknown or other
  misc_feature (239)..(239): n is a, c, g, or t
  modified_base (257)..(257): a, c, t, g, unknown or other
  misc_feature (257)..(257): n is a, c, g, or t
  modified_base (302)..(302): a, c, t, g, unknown or other
  misc_feature (302)..(302): n is a, c, g, or t
  modified_base (362)..(362): a, c, t, g, unknown or other
  misc_feature (362)..(362): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagcctgggcctcagtgaggtctcctgtaaggcctnaggttacaccttcaccgntaatggtatcactggcttcgacaggccctggacaggctgagtggnggatggatcaactctcacactggaagcagagtctagtcgcggagacgattccgaagggcnggacgtccaccctgacccacagacgacagtacccacgaccacgacgtactaacgagtgggacgctggtggacgcctaggacgacctggaaccgaccgaccgggtcccttactacttacgtcggtacgccggtaacgggtccccttagttcccttacgtacgttacgaccccttaccgttcccaacggtcccgttcgggtttcccgacccgttcggtccgggggcccgtaaccggggg

SEQ ID NO: 300211 - DNA, 602 bp, Homo sapiens
  misc_feature: GZ8MTXP01B3RDL.11.72.G06.1.454.CMB.2.raw
  modified_base (551)..(551): a, c, t, g, unknown or other
  misc_feature (551)..(551): n is a, c, g, or t
tcagcgagagataccacgaccggtgctcgatttagctacgactgcaagggaaagggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacacggcccctggacaaggacttggagtgggtggatggatcaacttctcacacgtggaagcagtagtctagtaggcggagagtacgttcccgaagggcaaggacgtccaaccctcgaccacgagacgacatcccaacgaccaacgagtacctacgagtggacgcgtcggtaggacgccggtggaacggtacccgtaggaaccgaccgaccggtccccttactacgttacgtgtcggcgaacggtcccttagtcccttacgacgtcgacccncgttcccaacgtcgtcgggttccgaccgttccgtcggggcccgaacccggg

SEQ ID NO: 300212 - DNA, 578 bp, Homo sapiens
  misc_feature: GZ8MTXP01CQHVP.11.72.G06.1.454.CMB.2.raw
  modified_base (236)..(236): a, c, t, g, unknown or other
  misc_feature (236)..(236): n is a, c, g, or t
  modified_base (250)..(250): a, c, t, g, unknown or other
  misc_feature (250)..(250): n is a, c, g, or t
  modified_base (299)..(299): a, c, t, g, unknown or other
  misc_feature (299)..(299): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagcctggggcctcagtgagtctctgtagcctnagtacacttcacgntaatggtatcactggcttcgacacggccctggacaaggcttgagtgggngggatggatcaactctcacacgtggaagcagagtctatcggcggagagattccgaaggggtcaagagtccaccctgaccacgagacgacactccacgaccacacgtactacatggagcgtgtgggtacgccgtgagcctaggaccgacgaccggtcctacgtacttacgtgtcgcgaacggtcccttaagtcccaactacggttcgaacccttccttaccccgaacgtccgttcgggtcccgtacccgttcggttccgggggaacccgtaacccggggg

SEQ ID NO: 300213 - DNA, 711 bp, Homo sapiens
  misc_feature: GZ8MTXP01BTSCB.11.72.G06.1.454.CMB.2.raw
  modified_base (243)..(243): a, c, t, g, unknown or other
  misc_feature (243)..(243): n is a, c, g, or t
  modified_base (308)..(308): a, c, t, g, unknown or other
  misc_feature (308)..(308): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctggaggtgaagagccgtggggcctcagtgaaggtctcctgtaaggcctnaggttaccacttcacgctaatggtatcactggctcgacacggccctggacaaggctggagtgggnggatggatcgaactctacacacgtaggaagcaagagtctagtcggacgggaagaggtacttcccgaaaggggcaaggtacgtaccgaaccccgtagaacccaacgaagacgaacaactaccaaccgaccaacgtacgtactaacgaatcgggaagtccgtaggtacgggacgccggtagaacggtaacccgtaggaaccggaccgtacccgggtacccctttaagttaacgttaccgttcggtccggaaccggtaaccgggtaccccttaaggttaccccttaaacgtaaccgggttaccgaaccccgttaccgttaccccgaacggttcccggttaacgggtttccccggtaaccccggttcggggttaacccgggggaaccccgggttaaaaccccggggg

SEQ ID NO: 300214 - DNA, 602 bp, Homo sapiens
  misc_feature: GZ8MTXP01BA13S.11.72.G06.1.454.CMB.2.raw
  modified_base (480)..(480): a, c, t, g, unknown or other
  misc_feature (480)..(480): n is a, c, g, or t
  modified_base (550)..(550): a, c, t, g, unknown or other
  misc_feature (550)..(550): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggttgcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacacggcccctggaccaaggcttggagtggggtggatggatcgaactctacacacgtggaagcagagtctagtcggcggagagtacttcccgaaggggccaaggacgtccaccccgtgacccagagacgacactcccaaccgaccaacgagtacctacgagtcgggaagcgtaggtgggacgccggtggacgtacccgngaaccgaccgaccggtccccttatacttacgtgtcgcggaacggtccccttatcccgacgacgtcacccncttcccgaacgtcgttcggttccgaccgttcggtcgggggccctaaccgggg

SEQ ID NO: 300215 - DNA, 658 bp, Homo sapiens
  misc_feature: GZ8MTXP01D27NO.11.72.G06.1.454.CMB.2.raw
  modified_base (218)..(218): a, c, t, g, unknown or other
  misc_feature (218)..(218): n is a, c, g, or t
  modified_base (242)..(242): a, c, t, g, unknown or other
  misc_feature (242)..(242): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagccgtggggcctnagtgaaggtctcctgtaaggcctnagttacaccttcacgctatgtatcactggcttcgacacggccctggacaaggctgagtgggtggatggatcaactctacacacgtggaagcaagtagtctagtcggacggaagagtacttcccgaaaggggccaaggtaggtcccaccccgtgaaccacgagacgacactaccacgaccacgtagtactacagtggacgcgtggtacggacgccgtagacggtaccgtcggaaccgaccgacccggtacccttacttacgttacgtggtacggccggtaaaccggtccccgttaacttccccgttaagtaccggttaccgaaccccgttaccgttaccccgaaccgggttccgtttccggggttaccccgtacccgggttccggtaacccggggggttcccctaaaccccgggggg

SEQ ID NO: 300216 - DNA, 681 bp, Homo sapiens
  misc_feature: GZ8MTXP01CNN4N.11.72.G06.1.454.CMB.2.raw
  modified_base (217)..(217): a, c, t, g, unknown or other
  misc_feature (217)..(217): n is a, c, g, or t
  modified_base (237)..(237): a, c, t, g, unknown or other
  misc_feature (237)..(237): n is a, c, g, or t
  modified_base (252)..(252): a, c, t, g, unknown or other
  misc_feature (252)..(252): n is a, c, g, or t
  modified_base (312)..(312): a, c, t, g, unknown or other
  misc_feature (312)..(312): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagccgtgggcctnagtgagtctctgtaagcctnagtacaccttcacgntaatgtatcactggctcgacaggccctggacaggctggagtgggtggatggatcaactcncacacgtaggaacgcagtagtctagtcggacggagagtacgttacccgaaggggacctaaggacgtacccgaacccgtacgaaccccgaacgaacgggaacgaaccctaactaccccgaaccggaacccaacgtaacgtaccttaaccgagtagggacgtcgtggtacgggacgtccggtaggaaccgaccgtacgaacccggtaccgacccggtacccttacgttaacgtttaccgacgggttacgacccggtaaccggtaccccttacgtacccttacgaacgtcccgacccgttacccgttcccgaaccggtcgtttaaccggtcccgtaccggttccgggtccgggggaaccccgtaacccgggg

SEQ ID NO: 300217 - DNA, 594 bp, Homo sapiens
  misc_feature: GZ8MTXP01CBBNM.11.72.G06.1.454.CMB.2.raw
  modified_base (353)..(353): a, c, t, g, unknown or other
  misc_feature (353)..(353): n is a, c, g, or t
  modified_base (395)..(395): a, c, t, g, unknown or other
  misc_feature (395)..(395): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggccctggacaaggcttgagtgggtggatggatcactctcacacgtggaagcagagtctagtcgcgganagattccgaagggcaagagtccaccctgaccacagacgacanacccacgaccacagtactacagtggacgcgtggtcggacgccgtggacgacctgaaccgtaccgacccggtccctacttacttaccgtgttcgcggtaacggtccccttagttcccacgtacgttcgacccgttccttacccgcggtacccgttcgggttcccgtacccgttccggtccgggggccccgtaaccggggg

SEQ ID NO: 300218 - DNA, 741 bp, Homo sapiens
  misc_feature: GZ8MTXP01BLOXB.11.72.G06.1.454.CMB.2.raw
  modified_base (216)..(216): a, c, t, g, unknown or other
  misc_feature (216)..(216): n is a, c, g, or t
tcagcgagagataccacgaccggtgctcgatttagctacgactgcaagggaaaggggaccaaaaaccacaccctccttgggagaatccctagatcatagctcctcaccatggactggacctggagcatccttttcttggtggcagcagcaacaggtgcccactcacagggtcaactggtgcagtctggacctgaggtgaagaagccgtggggcctnagtgaaggtctcctgtaagcctcaggttacaccttcaccgctaatggtatcacctggcttcgacacggcccctggacaaggacttggaggtgggggtgggatggatacaactctcacactggaacgcagagttctatggacggagagtacttcccgaaagggggcaagacgtaccgaccctggacccaacagaacgacactacccaaccggaacccactacgttaccaaacgatcgggagtccgtagggtcgggaacgccgttagggaaaccggtacccgtacggaacccggaaacccggaccccgggtaccccctttacgttaaacttttaaccgtcggggttccggccggggtaaacccgggtcccccttttaaacggccccctttaaacgacccggggttaacccgaccccgttaaaccccttccccggaaaccggggttcccgtttccgggggtttcccccggaaccccggttttccccgggtcggggggggggttaacccccctaaaccccggggggggg

SEQ ID NO: 300219 - DNA, 614 bp, Homo sapiens
  misc_feature: GZ8MTXP01B07RZ.11.72.G06.1.454.CMB.2.raw
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagcctgggcctcagtgaaggtctcctgtaaggcctcaggttacaccttcaccgctaatggtatcactggcttcgacaggcccctggacaaggacttggagtgggtggatggatcaactctcacactggaagcagagtctatcggacggagagtacttacgaaggggcaaggtacgtacccaaccccgtcgaacccaacgagaacgaaccatacccaacgacccaacacgttactacagtggacgcgtggtaggacgtcgtagacgacctacggaccgaccgaccggtacccttacgtagttccgtggtccggccggggtaaccctacgttccctacgagttaccgaacccttacgttcccgacgtccgtcggtccgccgtcggttccggggtcccgaacgggtaaccccg

SEQ ID NO: 300220 - DNA, 694 bp, Homo sapiens
  misc_feature: GZ8MTXP01CM58J.11.72.G06.1.454.CMB.2.raw
  modified_base (242)..(242): a, c, t, g, unknown or other
  misc_feature (242)..(242): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctnaggttacaccttcaccgctaatggtatcactggcttcgacacggcccctggacaaggcttggagtgggtgggatggatcaactctcacacgtggaagcagagtctagtcgcggagagattcccgaagggcaaggacgtcaccctgaccacagacgacactcccgaacgtaccacgaacgtcctaacgagttcgggaacgtcgtaggtcggggaacgtcccggtaggtaaacggtaccctcgggaaaccgacccgtaccccgggtaccccgttacttaacgtttaacccgtggttaaccgggcccggtaaaccgggtccccttaacgttacccccaaagtaccggttccggaaacccccttaccgttcccccgtaacgggtccccgtttcgggggttacccctaaccccggtttcccgggtaacgggggggttaacccctaaaccccgggggg

SEQ ID NO: 300221 - DNA, 618 bp, Homo sapiens
  misc_feature: GZ8MTXP01AU745.11.72.G06.1.454.CMB.2.raw
  modified_base (312)..(312): a, c, t, g, unknown or other
  misc_feature (312)..(312): n is a, c, g, or t
  modified_base (378)..(378): a, c, t, g, unknown or other
  misc_feature (378)..(378): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcattcctttttcttggtggcagcagcaacaggtgcccactcacagggtcaactggtgcagtctggacctgaggtgaagagccgtgggcctcagtgaggtctccgtgtaagcctcagttacaccttcaccgtctaatggtatcactggctcgacacgcccctggacaaggcttggaggttggggnggatggatcactctcacacgtggaagcagagtctagtcggacggagagtacttaccgaaagggacnggtacgtcccaaccccgtaggaacccacgaggaacgaccactacccaaccgaaccactacgtacctacgagtcgggacgtcgtggtacggacgtcggtacgacggtaccgtacggaaccgaccgccggtaccccttagttacttacgtgtcgccggtaacgtcccttattcccgttacgagtccaaccgccttccgaacgtcgttcgggtccaccggttcggtcgggaaccgtaaccggg

SEQ ID NO: 300222 - DNA, 632 bp, Homo sapiens
  misc_feature: GZ8MTXP01AIUZW.11.72.G06.1.454.CMB.2.raw
  modified_base (389)..(389): a, c, t, g, unknown or other
  misc_feature (389)..(389): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacacggcccctggacaaggacttgaggtgggtggatggatcaactctcacacgtggaagcagagtctatgcggagagattccgaagggcaagacgtccacctgaccanagacgacactccacgaccacagctacagtggagtcgtggtggacgccgtaggacgaccgtaggaacccgaccgaccgggtccccttacttaacgtttaccgtggttacggccggtaaccgggtccccttaattccccgttacgaacggttccgaccccttacccgttcccgtaacccggtcccgttcggggttaccccgtacccgttaccggggttccgggggaacccggtaaaccccggggg

SEQ ID NO: 300223 - DNA, 766 bp, Homo sapiens
  misc_feature: GZ8MTXP01EQECN.11.72.G06.1.454.CMB.2.raw
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagccgtggggcctcgaggtgaaggtcctccgtgtaacggcctcaggttacaccttcaccgctaatggtatcacctggcttcgacacggcccctggaacaaggcttgaggtggggtgggactggatacaactctacacacgttggaagcagagtactagtcggacggagagtagttaccgaaggggaccaaggaacgtcccaaccccgttggaaccccaacgaggaaccgacaacgtacccaaccgaaccaaccgaacggtaacctacgtaacgtacgggaacgtccgttaggtacggggtaccgacccggggttacggaaaccggtaccccggttacgggaacccgtaaaccccggaccccgggttaccctttacccgttaacgttttacccgttacgggttaccgggacccgggtaaccgggttacccccttacgttacccccgttaacgtaccggtacccggttaaccccttcccttaccccggtaaccgtccggtttaaccggggttaccccgtacccgttaccgggttaacccgggggcccggttaaaccccggggg

SEQ ID NO: 300224 - DNA, 579 bp, Homo sapiens
  misc_feature: GZ8MTXP01CV99W.11.72.G06.1.454.CMB.2.raw
  modified_base (239)..(239): a, c, t, g, unknown or other
  misc_feature (239)..(239): n is a, c, g, or t
  modified_base (257)..(257): a, c, t, g, unknown or other
  misc_feature (257)..(257): n is a, c, g, or t
  modified_base (279)..(279): a, c, t, g, unknown or other
  misc_feature (279)..(279): n is a, c, g, or t
  modified_base (499)..(499): a, c, t, g, unknown or other
  misc_feature (499)..(499): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagcctgggcctcagtgaaggtctcctgtaagcctnaggttacaccttcaccgntaatggtatcactggctcgacnggccctgacaaggctgagtgggtggatggatcaactctcacactggaagcagagtctagtcgcggagagattccgaaagggcaaggactccacccgtgacccacagacgacagtacccaacgaccacacgtctacactgggagctgtcggagccgtggacgacctggaacgaccgaccggtccctacttattacctggtcggccgtaacggtaccccttntccttacgaaacgttcgaacccgttccttccaacgtcccttaagggttcccgacgttccggtcggggcccgtaaccgggg

SEQ ID NO: 300225 - DNA, 616 bp, Homo sapiens
  misc_feature: GZ8MTXP01APQ60.11.72.G06.1.454.CMB.2.raw
  modified_base (241)..(241): a, c, t, g, unknown or other
  misc_feature (241)..(241): n is a, c, g, or t
  modified_base (259)..(259): a, c, t, g, unknown or other
  misc_feature (259)..(259): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagcctggggcctgagtgaaggtctcctgtaaggcctnaggttacaccttcaccgntaatggtatcactggctcgacacggccctggacaaggcttggagtgggtggatggatcaactctacacactggaagcagagtctagtcgcggagagacttcgaaagggcaaggacgtaccacccgtgaaccacgagacgacactaccacgacacagtactacgacgtaggatcgtggtagacgccgtaggacggacctggaaccgaccgaccggacccttacgttacgttacgtggtcggcgtaacggtacccttagtacccttacgtacgtccggaacccttccgttacccgtaaccggtccgttcgggttacccgtacccggttcgggtaaccgggggcccggtaaacccggggg

SEQ ID NO: 300226 - DNA, 686 bp, Homo sapiens
  misc_feature: GZ8MTXP01D98Q6.11.72.G06.1.454.CMB.2.raw
  modified_base (243)..(243): a, c, t, g, unknown or other
  misc_feature (243)..(243): n is a, c, g, or t
  modified_base (341)..(341): a, c, t, g, unknown or other
  misc_feature (341)..(341): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagccgtggggcctcagtgaaggtctcctgtaaggcctnagttacaccttcaccgctaatggtatcacctggcttcgacacggcccctggaacaaggcttggagtgggtggatggatcaaactctacacactggaancagagtctaagtggcggaagagtacttacccggaaagggggaccaaggtacgtacccaaaccccgtggaaccccaagagggaacacactacccgaacgaaccaacaagttacctaacagtgggaagtccgttggaggaccgaccgttaggaacgtaacctggaaaccgtacccgaacccggtccctttaaaccgttatttaacccggtacgggtccgacccggtaaccgttcccttaacgttacccgttaacgacggtaccaaccccgttaccttacccgtaaccgttccggtttccgggtacccgtaccggttaccgggtaaccggggttaacccgtaaccggg

SEQ ID NO: 300227 - DNA, 592 bp, Homo sapiens
  misc_feature: GZ8MTXP01EE74S.11.72.G06.1.454.CMB.2.raw
  modified_base (217)..(217): a, c, t, g, unknown or other
  misc_feature (217)..(217): n is a, c, g, or t
  modified_base (235)..(235): a, c, t, g, unknown or other
  misc_feature (235)..(235): n is a, c, g, or t
  modified_base (249)..(249): a, c, t, g, unknown or other
  misc_feature (249)..(249): n is a, c, g, or t
  modified_base (269)..(269): a, c, t, g, unknown or other
  misc_feature (269)..(269): n is a, c, g, or t
  modified_base (288)..(288): a, c, t, g, unknown or other
  misc_feature (288)..(288): n is a, c, g, or t
  modified_base (376)..(376): a, c, t, g, unknown or other
  misc_feature (376)..(376): n is a, c, g, or t
  modified_base (397)..(397): a, c, t, g, unknown or other
  misc_feature (397)..(397): n is a, c, g, or t
  modified_base (407)..(407): a, c, t, g, unknown or other
  misc_feature (407)..(407): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagccgtgggcctnagtgagtctctgagcctnagtacacttcacgntaatgtatcactgctcgacngccctgacagctgagtggnggatgatcaactctcacacgtaggaagcagagtctagtcggacggagacgtacttcccgaaagggcaaggacgtccaccctagaccanagacgacactaccacgaccanacgtacctanagtcggagcgtggtagacgtcggtaggacgtaccgacggacccgaccgtacccggtcccttacttaacgttaccgtcggtcggccggtaaccggtcccttacgtcccttacgacgtaccgacccgccttacccgtaacgtccgttcggttcccgaccggttcggtccggggcccgtaacccgggg

SEQ ID NO: 300228 - DNA, 648 bp, Homo sapiens
  misc_feature: GZ8MTXP01B6J6R.11.72.G06.1.454.CMB.2.raw
  modified_base (217)..(217): a, c, t, g, unknown or other
  misc_feature (217)..(217): n is a, c, g, or t
  modified_base (434)..(434): a, c, t, g, unknown or other
  misc_feature (434)..(434): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagccgtgggcctnagtgaaggtctcctgtaacggcctcaggttacaccttcaccgctaatggtatcacctggcttcgacaggcccctggacaaggcttggagtgggtggatggatcaactctacacacgtggaagcagtagtctatcggacggagagtattcccgaagggcaaggagtccaccctggaccacgagagacactaccaacgaccacagtacctagatggacncgttggagggacgccggttggaacgtacccgtaggaacccgaccgaacccgggtcccttacgttacgtttaccgtcggtcggcccggtaacgggtccccttaagttcccttaaccgaacggttccggaaccccttccgttaccctaaccggtccgtttcggggtttaccccacccggtttccggaaccggggggttaaccctaaacccgggggg

SEQ ID NO: 300229 - DNA, 584 bp, Homo sapiens
  misc_feature: GZ8MTXP01ELRP4.11.72.G06.1.454.CMB.2.raw
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagccgtgggcctcagtgaagtctctgtaagctgagttacacttcaccgctaatgtatcactggcttcgacaggccctggacaaggcttggagtgggtggatggatcgaactcgacacgactaggaacgcgagagtctaagtcggacggagagacttcccgaagggcaaggagtaccacccctaggaaccaagagacgacactaccaacgacacagtacacaagtggacgcgtggtagacgccgtagacgaccgcgaaccgaccgacggtccctagtacttacgtgtcgcggaacgtcccttataccttagtacgtaccgaccgttaaccttcccgaacgtcgttcggtccgaacgttccggcgggaaccgtaacccgggg

SEQ ID NO: 300230 - DNA, 635 bp, Homo sapiens
  misc_feature: GZ8MTXP01D645J.11.72.G06.1.454.CMB.2.raw
  modified_base (217)..(217): a, c, t, g, unknown or other
  misc_feature (217)..(217): n is a, c, g, or t
  modified_base (256)..(256): a, c, t, g, unknown or other
  misc_feature (256)..(256): n is a, c, g, or t
  modified_base (277)..(277): a, c, t, g, unknown or other
  misc_feature (277)..(277): n is a, c, g, or t
  modified_base (302)..(302): a, c, t, g, unknown or other
  misc_feature (302)..(302): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagccgtgggcctnagtgaggtctctgtaacgcctcagttacaccttcaccgntaatggtatcactgctcgacncggccctgacaggcttgaggtgggnggatggatcgaactctacacacgtaggaacgcagagtctaagtcggacgggagtagtacgttacccgaaagggcaacggacgtacccacccgtagaaccacgagaacgacactccaacgaccaacgagtaccacgatggagcgtggtacggacgcgtaggacgtaccaggaaccgaccgaccggtccttactacttacgtcggtacgcggaaccgtacccttacgtacccgttaacgtaacgtccggaaacccttccgttacccgtaacggtccgtttaaccgggttccgtacccggttcgggtaacccggggttaacccgtaaacccggggg

SEQ ID NO: 300231 - DNA, 643 bp, Homo sapiens
  misc_feature: GZ8MTXP01B8C7O.11.72.G06.1.454.CMB.2.raw
  modified_base (216)..(216): a, c, t, g, unknown or other
  misc_feature (216)..(216): n is a, c, g, or t
  modified_base (236)..(236): a, c, t, g, unknown or other
  misc_feature (236)..(236): n is a, c, g, or t
  modified_base (250)..(250): a, c, t, g, unknown or other
  misc_feature (250)..(250): n is a, c, g, or t
  modified_base (270)..(270): a, c, t, g, unknown or other
  misc_feature (270)..(270): n is a, c, g, or t
  modified_base (295)..(295): a, c, t, g, unknown or other
  misc_feature (295)..(295): n is a, c, g, or t
  modified_base (323)..(323): a, c, t, g, unknown or other
  misc_feature (323)..(323): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagcctgggcctnagtgagtctcgtgtaggctnagtacacttcacgntaatgtatcactgctcgacnggccctggacaggcttggagtgggnggatggatcaactcacactacgtggaancgagagtctagtcggcggagtagtacttccgaaaggggcaaggacgtcccaccccgtagaacccacgaagacgactactacccaacgaaccaacgacgttactaacgacgtgggacgccgtaggttacggacgtacccggtaggaacgtaccctaggaacccgtaccgacccggtcctacgttacttaccggttgtacggcggtaaccggtcccttagtaccccgttagacggttaccgacccgttccttacccgtaacggtccggttcgggttaccggaccccgttcgggtaacccgggggccccgttaaacccggggg

SEQ ID NO: 300232 - DNA, 657 bp, Homo sapiens
  misc_feature: GZ8MTXP01CZ6CN.11.72.G06.1.454.CMB.2.raw
  modified_base (211)..(211): a, c, t, g, unknown or other
  misc_feature (211)..(211): n is a, c, g, or t
  modified_base (342)..(342): a, c, t, g, unknown or other
  misc_feature (342)..(342): n is a, c, g, or t
tcagcgagagataccacgaccggtgctcgatttagctacgactgcaagggaaagggacccaaaaaccacaccctccttgggagaatccctagatcatagctcctcaccatggactggacctggagcattccttttcttggtggcagcagcaacaggtgcccactcacagggtcaactggtgcagtctggactgagtgaagagcgtgggctnagtgaaggtctctgtaacggctgagttacacttcaccgctaagtggtatcacgtggcttcgacacggcccctggaacaaggtacttggaggtgggtggagtggactcaacgtctacacgtacgtagggaancgaggtagtcgtagcggacggagtagtacttaccggaaaggggtacaaggacgtcccaacccgtacgaaccaagacgacgaacactaccgaaccgacacgtacgtacctagagtacgggacgtcgtaggtacgggaacgccggtagaacgtaccgaggaaccgaccgtaccggtcccttagtaacgttacgtcggtacgccggtaaccggtcccttaacgtcccgttaacgacggttaccaacccttccgttacccgaacggttccgtcgggtttacccgaccgttcgggtcccggggaacccgtaacccggggg

SEQ ID NO: 300233 - DNA, 577 bp, Homo sapiens
  misc_feature: GZ8MTXP01ETS1K.11.72.G06.1.454.CMB.2.raw
  modified_base (241)..(241): a, c, t, g, unknown or other
  misc_feature (241)..(241): n is a, c, g, or t
  modified_base (257)..(257): a, c, t, g, unknown or other
  misc_feature (257)..(257): n is a, c, g, or t
  modified_base (277)..(277): a, c, t, g, unknown or other
  misc_feature (277)..(277): n is a, c, g, or t
  modified_base (297)..(297): a, c, t, g, unknown or other
  misc_feature (297)..(297): n is a, c, g, or t
  modified_base (322)..(323): a, c, t, g, unknown or other
  misc_feature (322)..(323): n is a, c, g, or t
  modified_base (434)..(434): a, c, t, g, unknown or other
  misc_feature (434)..(434): n is a, c, g, or t
  modified_base (446)..(446): a, c, t, g, unknown or other
  misc_feature (446)..(446): n is a, c, g, or t
  modified_base (530)..(530): a, c, t, g, unknown or other
  misc_feature (530)..(530): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcattccttttcttggtggcagcagcaacaggtgcccactcacagggtcaactggtgcagtctggacctgaggtgaagagccgtgggcctcgagtgaggtctctgtaaggcctnagtacaccttcaccgntatgtatcactggctcgacncgccctgacagctgagtggnggatggatcactcacacactggaannagagtctagtggacggtagagtacgttacccgaaggggtcaaggtacgtccaacccgtacgaacccacgagaacgacacgtacccaacgaccacacgtactacgagaggancgttggaggacnccggtagacgacctacggaccgaccgaccggtcctactacttacgtgacgtcgaaccgtcccttatccgttagcgtacgacccncttcccaacggtcgtcggttccgacgttcggtcgggaacgtaacggg

SEQ ID NO: 300234 - DNA, 566 bp, Homo sapiens
  misc_feature: GZ8MTXP01EXN4W.11.72.G06.1.454.CMB.2.raw
  modified_base (242)..(242): a, c, t, g, unknown or other
  misc_feature (242)..(242): n is a, c, g, or t
  modified_base (354)..(354): a, c, t, g, unknown or other
  misc_feature (354)..(354): n is a, c, g, or t
  modified_base (369)..(369): a, c, t, g, unknown or other
  misc_feature (369)..(369): n is a, c, g, or t
  modified_base (397)..(397): a, c, t, g, unknown or other
  misc_feature (397)..(397): n is a, c, g, or t
  modified_base (424)..(424): a, c, t, g, unknown or other
  misc_feature (424)..(424): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctnaggttacaccttcacgctaatggtatcacctggctcgacacggcccctggacaaggcttgagtgggtggatggatcaactctacacacgtggaagcagagtctagtgcgganagattccgaagggcngacgtcacccgtgaccacgagacgacanaccacgaccacagtactacagtcggancgtggtagacgccgtaggacgacctggaaccgaccgaccggtcctatacgttaccgtggtcgcgaacggtcccttatcccttagacgtcgaccacttccaacgcttcggttcgaccgttcggtccggggttccgaaccgggg

SEQ ID NO: 300235 - DNA, 631 bp, Homo sapiens
  misc_feature: GZ8MTXP01D3H8G.11.72.G06.1.454.CMB.2.raw
  modified_base (217)..(217): a, c, t, g, unknown or other
  misc_feature (217)..(217): n is a, c, g, or t
tcagcgagagataccacgaccggtgctcgatttagctacgactgcaagggaaagggacccaaaaaccacacccctccttgggagaatcccctagatcatagctcctcaccatggactggacctggagcattccttttcttggtggcagcagcaacaggtgcccactcacagggtcaactggtgcagtctggacctgaggtgaagagccgtgggcctnagtgagtctctgtagctgagttacacttcacgctatgtatcactggcttcgacacggccctggaacaggcttggaggtgggtggatggatcaactctacactacgtaggaagcagacgtctagtcggacggagacgtactccggaaaggggcaaggacgtaccacccgtagaacccagacgaacgacactacccaacgaccaactacgttacaacgtagtggacgtcgtggacggacgtccggtagaacgacccgtacggaaccgaccgtacccggtcccttacttaaacgttcgtcggtccggaccgaaccggtccccttatacccgttaacgacggtaccaaccccttccgttacccgaacgtccgttcgggttaccccgaccgttcgggtccggggaacccgtaacccggg

SEQ ID NO: 300236 - DNA, 631 bp, Homo sapiens
  misc_feature: GZ8MTXP01AQ9FH.11.72.G06.1.454.CMB.2.raw
  modified_base (239)..(239): a, c, t, g, unknown or other
  misc_feature (239)..(239): n is a, c, g, or t
  modified_base (253)..(253): a, c, t, g, unknown or other
  misc_feature (253)..(253): n is a, c, g, or t
  modified_base (300)..(300): a, c, t, g, unknown or other
  misc_feature (300)..(300): n is a, c, g, or t
  modified_base (314)..(314): a, c, t, g, unknown or other
  misc_feature (314)..(314): n is a, c, g, or t
  modified_base (325)..(325): a, c, t, g, unknown or other
  misc_feature (325)..(325): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcattccttttcttggtggcagcagcaacaggtgcccactcacgagggtcaacgtggtgcagtctggacctgaggtgaagagccgtgggcctgagtgagtctctgtagcctnagtacacttcacgntagtgtatcacgtgctcgacacggccctaggacaggctggagtgggnggatggatcactcncacacgtggancgagagtctagtcggacggagacgtacgtccggaaagggacctaagggcgtaccccgacccgtacggaacccacgaagaacgaccactacccgaaccggaccaactacgtacctagagtgggaatcgtaggacggacgtcggtaggaacgtccacggaccgaccgccggtacccttacgttaagtccgttggccgaccggtaaccgtcccttatacccgttacgtaacgttaccgaccccttacgttccccgaacgtccggttcgttcccgaccgttcgggaacccggggttccgtaaccccgggg

SEQ ID NO: 300237 - DNA, 546 bp, Homo sapiens
  misc_feature: GZ8MTXP01C6DR4.11.72.G06.1.454.CMB.2.raw
  modified_base (241)..(241): a, c, t, g, unknown or other
  misc_feature (241)..(241): n is a, c, g, or t
  modified_base (407)..(407): a, c, t, g, unknown or other
  misc_feature (407)..(407): n is a, c, g, or t
  modified_base (432)..(432): a, c, t, g, unknown or other
  misc_feature (432)..(432): n is a, c, g, or t
  modified_base (438)..(438): a, c, t, g, unknown or other
  misc_feature (438)..(438): n is a, c, g, or t
  modified_base (447)..(447): a, c, t, g, unknown or other
  misc_feature (447)..(447): n is a, c, g, or t
  modified_base (475)..(475): a, c, t, g, unknown or other
  misc_feature (475)..(475): n is a, c, g, or t
  modified_base (490)..(490): a, c, t, g, unknown or other
  misc_feature (490)..(490): n is a, c, g, or t
  modified_base (505)..(505): a, c, t, g, unknown or other
  misc_feature (505)..(505): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagcctggggcctcagtgaaggtctcctgtaaggcctnaggttacaccttcaccgctaatggtatcacctggcttcgacaggcccctggacaggcttgaggtgggtggatggatcgaaactctacacacgtggaacgcaagacgtctagtcggacgggagagtacttccggaaggggtcaaggacgtcccacccgtagacccanagacgacatccacgacacagctacngtgganctggtgacncgtgacgacctgacacgcgcctatctangcgcgaagcccttanccagcgtcaccttcnccgaacgtctcggttccgacgttcgtcgggccgtaaccggg

SEQ ID NO: 300238 - DNA, 672 bp, Homo sapiens
  misc_feature: GZ8MTXP01EXVWL.11.72.G06.1.454.CMB.2.raw
  modified_base (218)..(218): a, c, t, g, unknown or other
  misc_feature (218)..(218): n is a, c, g, or t
  modified_base (241)..(241): a, c, t, g, unknown or other
  misc_feature (241)..(241): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcattccttttcttggtggcagcagcaacaggtgcccactcacagggtcaactggtgcagtctggacctgaggtgaagagcctggggcctnagtgaaggtctctgtaaggcctnaggttacaccttcaccgctaatgtatcactggcttcgacacggcccctggacaaggacttggagtgggtgggatggatcaactctcacacgtggaagcagagtctagtcggacggagacgtacttacccgaaagggacaaggacgtacccaaccctggaaccccaacgacggaacggaacaacgtacccaaccgaacccaacgacgttacctaacgaatcggggaacgtcgtaggtacgggacgtcccggtaggaacggtacctacggaaccgaccgaccggtccctacttacgtttaccgtcggtcgccgggtaaccggtccccttaacgtcccttacgacggttacccgaacccttaccgttccccgaacgggtccgttaaccgggttccgacccgttcgggtaaccgggggaaccccgtaaccggggg

SEQ ID NO: 300239 - DNA, 714 bp, Homo sapiens
  misc_feature: GZ8MTXP01A4WUN.11.72.G06.1.454.CMB.2.raw
  modified_base (218)..(218): a, c, t, g, unknown or other
  misc_feature (218)..(218): n is a, c, g, or t
  modified_base (242)..(242): a, c, t, g, unknown or other
  misc_feature (242)..(242): n is a, c, g, or t
  modified_base (348)..(348): a, c, t, g, unknown or other
  misc_feature (348)..(348): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctnagtgaaggtctcctgtaaggcctnaggttacaccttcaccgctaatgtatcactggcttcgacacggcccctggacaaggacttggaggtgggtaggatggatccgaacttctacacgacgtgggaaacncgaaggtagtctaagtcggacggtagaggtacttcccggaaaggggccaaggacgttcccgaccccgtacggacccaacgagaacgaccataccccgaacggacccaacgtaacgtacctaaccgagtgggaacgccgtaggtacgggacgcccggtaggacggaccctacggaaccgacccgaccggtccccttacgttaacgttacccgtggttacggcccggtaaccgggtccccctttaaggtaccccttaacggtaacgttcccggaaccccgttacccgttccccgaaccggtcccgtttaacgggggttcccctaacccgggttcccggttccggggggaaccccgttaacccgggggg

SEQ ID NO: 300240 - DNA, 704 bp, Homo sapiens
  misc_feature: GZ8MTXP01BFQ9F.11.72.G06.1.454.CMB.2.raw
  modified_base (263)..(263): a, c, t, g, unknown or other
  misc_feature (263)..(263): n is a, c, g, or t
  modified_base (315)..(315): a, c, t, g, unknown or other
  misc_feature (315)..(315): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcattccttttcttggtggcagcagcaacaggtgcccactcacagggtcaactggtgcagtctggacctgaggtgaagagccgtggggcctcagtgaaggttctcctgtaaggcctcaggttaccaccttcaccgntaatggtatcactggcttcgacacggcccctggacaaggcttggaggtgggnggatggatcgaactctacacacgtggaagcagtagtctagtcggacggagacgtacgttcccgaagggggtacaaggtacgtacccgaacccgtacggaacccaacgaacggaacgtacccaactaccccgaaccggacccaactaacggtaccttaacgaggttacgggacgtccgtgggttaggaccgtccgggtaggacggtaccctacggaacccgaccgtacccggtcccttaagttacgttacgtcggtacgggtccgtaacgggtccccttacggtcccttaacggaccggttaccgaaccccttccgttaccccgtaaccggtcggtttccgggttcccggacccgttaccggggtccgggggaacccgtaaccccggggg

SEQ ID NO: 300241 - DNA, 647 bp, Homo sapiens
  misc_feature: GZ8MTXP01DGCSS.11.72.G06.1.454.CMB.2.raw
  modified_base (218)..(218): a, c, t, g, unknown or other
  misc_feature (218)..(218): n is a, c, g, or t
  modified_base (330)..(330): a, c, t, g, unknown or other
  misc_feature (330)..(330): n is a, c, g, or t
  modified_base (601)..(601): a, c, t, g, unknown or other
  misc_feature (601)..(601): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcattccttttcttggtggcagcagcaacaggtgcccactcacagggtcaactggtgcagtctggacctgaggtgaagagccgtgggcctnagtgagtctctgtacgcctcagttacaccttcaccgctatgtatcacgtggctcgacacggccctggacaaggctgagtgggaggagtggatcactctacacacgtaggaancgagacgtctagtcggcggaagagtacgttcccggaaggggaccaaggtacgtaccaccccgtaggaaccccaagaaacgtacgaaccaacgtacccgaaaccgaaccaacaacggttacctaaacgtaggtacggacggtaccgtagggtacgggaaccgtccgggttaggaaccggtaacccacggaacccgtaacccgcccgggtacccttacgttaacgtttcgacggttcgacgtaaccggtcccttagtacccagactcgacccncgttcctaacgcgttcgtcccgacttccgggcggccgtaacccggg

SEQ ID NO: 300242 - DNA, 608 bp, Homo sapiens
  misc_feature: GZ8MTXP01CCGR2.11.72.G06.1.454.CMB.2.raw
  modified_base (392)..(392): a, c, t, g, unknown or other
  misc_feature (392)..(392): n is a, c, g, or t
  modified_base (399)..(399): a, c, t, g, unknown or other
  misc_feature (399)..(399): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacacggcccctggacaaggacttggagtgggtggatggatcaactctcacactggaagcagagtctagtggcggagagattccgaagggcaaggacgtccaccctgaccanagagacntacccacgaccacagtacctacagtggagcgtggtgacgccgtaggacgtaccctggaaccgtacccgaccggtccccttacttacttaccgtggttacggccggtaacggtccccttacgtcccttaacgacgttcgaccccttccttccccgaaccggtcgttcgggttcccgaccgttcccgggtcgggggcccgtaacccggggg

SEQ ID NO: 300243 - DNA, 582 bp, Homo sapiens
  misc_feature: GZ8MTXP01BFF51.11.72.G06.1.454.CMB.2.raw
  modified_base (242)..(242): a, c, t, g, unknown or other
  misc_feature (242)..(242): n is a, c, g, or t
  modified_base (477)..(477): a, c, t, g, unknown or other
  misc_feature (477)..(477): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctnaggttacaccttcaccgctaatggtatcacctggcttcgacaggcccctggacaggcttgagtgggtggatggatcgaactcgtcacacgtggaagcagagtctatcgcggagagattccgaagggcaagacgtcaccctagacccacgagacgacatccacgaccacagtactacatcgggatcgtggtgacgccgtagtacgacccgtggaaccgcgaacccggcccttactnttaccgtgtcgacgcggtaccccttagtcccttacgacgtcgacccgcccttccgaaccgtcgttaacgggtccgaccgttcggtccgggggccgtaacccgggg

SEQ ID NO: 300244 - DNA, 718 bp, Homo sapiens
  misc_feature: GZ8MTXP01B16RO.11.72.G06.1.454.CMB.2.raw
  modified_base (216)..(216): a, c, t, g, unknown or other
  misc_feature (216)..(216): n is a, c, g, or t
  modified_base (259)..(259): a, c, t, g, unknown or other
  misc_feature (259)..(259): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagcctgggcctnagtgaaggtctccgtgtaaggcctcaggttacaccttcaccgntaatggtatcacctggcttcgacacggccctaggacaaggtacttggaggtgggtggatggattcaactctacacacgtaggaacgcagtagtctagtcggacgggagtagtacttcccggaaaggggccaaggtacgtacccgaacccgtcgaacccaacgaggaacgacctacgtaccccgaacgtacccaacgtagtacctaagacgtgggacgcgtggtaggacgtccggtaggaacggtacccgtaggacccgaaccgtacccggtaccccttacgttaacgttaccgtcggttaccggcccgggtaaccggtcccctttaacgtaccccgttaaccgtaacggtttacccgaaccccgttaccgttaccccgtaaccgggttccggtttccgggtttaacccggtccccggttacgggggtccccgggggttaaccccggtaaaccccggggg

SEQ ID NO: 300245 - DNA, 608 bp, Homo sapiens
  misc_feature: GZ8MTXP01A4S7M.11.72.G06.1.454.CMB.2.raw
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcactggcttcgacaggcccctggacaggcttgagtgggtggatggatcaactctcacacgtggaagcagtagtctatcggacggagagacttccgaagggcaagacgtccaccctgaccacagacgacagtcccaacgaccacagtactacagtggagctaggtcgacgccgtgacgaccgtcgaccgaccgacccggtccctacgttaacttacgtcggtacgccggtaacggtccccttagtccccgttaacgtacgttacccgaacccgttccttaccccgtaacggtccgttaacgggtttccgacgttccgttccggttccgggggtaaccccg

SEQ ID NO: 300246 - DNA, 701 bp, Homo sapiens
  misc_feature: GZ8MTXP01C7OYK.11.72.G06.1.454.CMB.2.raw
tcagcgagagataccacgaccggtgctcgatttagctacgactgcaagggaaaggggacccaaaaaccacacccctccttgggagaatcccctagatcatagctcctcaccatggactggacctggagcatcctttttcttggtggcagcagcaacaggtgcccactcacagggtcaactggtgcagtctggacctgaggtgaagagcctggggcctcagtgaaggtctcctgtaacggcctcaggttacaccttcaccgctaatggtatcactggcttcgacacggccctggacaaggactggagtgggtggatggatcgaactcacacacgtaggaagcagtagtctagtcgcggaagagtacttcccgaaagggggacaaggaacgtcccaaccccgttacgaacccaacgaagaacgacactacccgaacgaaccacgtacgtactacgagtagggacgtcgtagggtacggacgtccggttacggacggtaacccgtacggaacccgaaccgtacccgggtccccttacgttaacgtttaccgtcgggttaccggaccggtaaaccgggttccccttaacgttaccccgttaacgtaaccggttccgaaccccttccgttaccccgtaaccggtcccgttcgggtttacccgacccggtttcgggttaaccgggggaaccccgttaaacccggggg

SEQ ID NO: 300247 - DNA, 602 bp, Homo sapiens
  misc_feature: GZ8MTXP01CLNF5.11.72.G06.1.454.CMB.2.raw
  modified_base (238)..(238): a, c, t, g, unknown or other
  misc_feature (238)..(238): n is a, c, g, or t
  modified_base (256)..(256): a, c, t, g, unknown or other
  misc_feature (256)..(256): n is a, c, g, or t
  modified_base (301)..(301): a, c, t, g, unknown or other
  misc_feature (301)..(301): n is a, c, g, or t
  modified_base (448)..(448): a, c, t, g, unknown or other
  misc_feature (448)..(448): n is a, c, g, or t
  modified_base (503)..(503): a, c, t, g, unknown or other
  misc_feature (503)..(503): n is a, c, g, or t
tcagcgagagataccacgaccggtgctcgatttagctacgactgcaagggaaagggacccaaaaccacaccctccttgggagaatccctagatcatagctcctcaccatggactggacctggagcatccttttcttggtggcagcagcaacaggtgcccactcacagggtcaactggtgcagtctggacctgaggtgaagagccgtggggcctcagtgaaggtctcctgtaaggcctnaggttacaccttcaccgntaatggtatcactggcttcgacagccctggacaggctgagtgggnggatggatcaactctacacacgtggaaagcaggagtctaagtcggacggtagagtaacttccggaaaggggccaaggacgtacccacccgtagacccaacgagaacgacactaccgaacgaccacagtacctagatggagctagggngacgcggtaggacgtaccgtacggaccgaccgtaccgtaccttactacgttacgngtcgcggtaaccgtacccttagtccgttaacgacgtaccgacccgccttccgaacgtcgtccggtccgtaccggttcggtccggggaacccgtaacggg

SEQ ID NO: 300248 - DNA, 586 bp, Homo sapiens
  misc_feature: GZ8MTXP01EPRK8.11.72.G06.1.454.CMB.2.raw
  modified_base (216)..(216): a, c, t, g, unknown or other
  misc_feature (216)..(216): n is a, c, g, or t
  modified_base (235)..(235): a, c, t, g, unknown or other
  misc_feature (235)..(235): n is a, c, g, or t
  modified_base (244)..(244): a, c, t, g, unknown or other
  misc_feature (244)..(244): n is a, c, g, or t
  modified_base (247)..(247): a, c, t, g, unknown or other
  misc_feature (247)..(247): n is a, c, g, or t
  modified_base (255)..(255): a, c, t, g, unknown or other
  misc_feature (255)..(255): n is a, c, g, or t
  modified_base (530)..(530): a, c, t, g, unknown or other
  misc_feature (530)..(530): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagcctgggcctnagtgagtctctgtagcctnagtacactnacnctatgtancactggctcgacaggccctggacaggcttgagtgggtggatggatcaactctacacacgttaggaacgcaagacgtactagtggcggtagagtattcccgaaagggcaaggacgttccgaccctagaaccccagagacgaacactaccgaccggacaaccgagtacctacgatcgggaatctggtacgacggtcctaggacgaccctagaccgaccgcggtccctatacgttatgtcgcgtcggtcccttatcccttagacggtacacccgttcncccgtaacgtccgttcgggttcccacccgttcggtccgggggcccgtaacccgggg

SEQ ID NO: 300249 - DNA, 662 bp, Homo sapiens
  misc_feature: GZ8MTXP01EKKYS.11.72.G06.1.454.CMB.2.raw
  modified_base (242)..(242): a, c, t, g, unknown or other
  misc_feature (242)..(242): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctnagttacaccttcaccgctaatgtatcactggctcgacaggccctggacagcttgagtgggtggatggatcaactcgtacacacgtggaagcagatctagtcggcggagagtacttcccgaagggacaaggacgtaccacccgtagaccacagacgacacacccaacgaccacagtactaacagtcggagcgtggtacggaacgtccgtaggaacggtaccgaggaccgaaaccgccggtacccttaccttaagtttacccgtggttacgccggaaccggttaccccttaacgtccccttaaacgtacggttaacccggaaccccttaacccgttccccgaaccgggttccccgttaacggggtttcccccggacccggtttaccggggtcccggggttaaccccgggtaaaccccggggg

SEQ ID NO: 300250 - DNA, 645 bp, Homo sapiens
  misc_feature: GZ8MTXP01EQDLY.11.72.G06.1.454.CMB.2.raw
  modified_base (236)..(236): a, c, t, g, unknown or other
  misc_feature (236)..(236): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcattccttttcttggtggcagcagcaacaggtgcccactcacagggtcaactggtgcagtctggacctgaggtgaagagccgtgggcctcagtgagtctctgtagctnagttacacttcacgctatgtatcactgctcgacaggccctgacaggcttggagtggtggatggatcaatctacactacgtagagcaggatcgtagtcggacggagacgtacgtccgaagggcaagggacgtacccaccccgtacaacccgacgaacgacgaccacgtacccaacgaccaacgtagtctaaacagtggaacgtcgtaggtacgggacgtccgggtaggaaccgttacccgacggaaccggacccgtaacccgggtccctttacgtaacgttgtcggttacggccgaacggtcccttaacgtccgttaacgtacggtaccgaacccttccgttacccgtaacggtcccgttaacgggtttccccgaccggttcgggccggggttaacccgtaacccggggg

SEQ ID NO: 300251 - DNA, 618 bp, Homo sapiens
  misc_feature: GZ8MTXP01AGG2N.11.72.G06.1.454.CMB.2.raw
  modified_base (259)..(259): a, c, t, g, unknown or other
  misc_feature (259)..(259): n is a, c, g, or t
  modified_base (306)..(306): a, c, t, g, unknown or other
  misc_feature (306)..(306): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagcctggggcctcagtgaaggtctcctgtaaggcctcaggttacaccttcaccgntaatggtatcacctggcttcgacaggccctggacaggctgagtgggnggatggatcgaactctcacactggaacgcagagtctagtcgcggagagtacttccgaagggtcaaggacgtaccacccgtacggaccaacgagaacgacacgtacccacgaaccacacgtactaacagtacggagcgtggtacggacgccggtagacgaccgtacgaaccgaccgaccggtcccttacgttacttccgtgtacggcggaaccggtccccttatcccgttacgtacgtacggacccaccgttcccgaaccgtcggttccggttaccgacccggttcggtccgggggaacccgtaacccggggg

SEQ ID NO: 300252 - DNA, 693 bp, Homo sapiens
  misc_feature: GZ8MTXP01ANJA1.11.72.G06.1.454.CMB.2.raw
  modified_base (315)..(315): a, c, t, g, unknown or other
  misc_feature (315)..(315): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcattcctttttcttggtggcagcagcaacaggtgcccactcacagggtcaactggtgcagtctggacctgaggtgaagagcctgggcctcagtgaaggtctcctgtaaggcctcaggttacaccttcaccgctaatggtactcactggcttcgacacggcccctaggacaacggcttggaggtgggngggatggatcaactctacacgacgtaggaagcgagtacgtctagtcggacgggagacgtacgttacccgaaagggacaacggtacgtacccacccgtacgaacccacgaagacgaaccacacccgacgaacccacgaacgttacctaacgacgtagggaacgtcgtgggtaggacgtccggtaggaccgaccgtaggaacccgaacgacccggtacccttagtaaccgttacgtcggtacggccgggtaaccggacccctttacgaccccttaaacggtaccgaccgttaccccttacccgttcccggtaaccggtccggttaaccgggtttacccacccggtttcccgggtaacgggggccccgttaaacccggggg

SEQ ID NO: 300253 - DNA, 668 bp, Homo sapiens
  misc_feature: GZ8MTXP01C2W84.11.72.G06.1.454.CMB.2.raw
  modified_base (377)..(377): a, c, t, g, unknown or other
  misc_feature (377)..(377): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggactgaggtgaagagcctggggcctcagtgaaggtctcctgtaaggcctcagttacaccttcaccgctaatggtatcacctggcttcgacacggcccctggaacaaggacttggagtgggtggatggatcaactctacacacgtggaagcaagagtctatcggacggagagagttcccgaaagggcngacgtccaacccgtgaacccacgagacgaccatacccgaacgaccactacgtactaacgagtggaagcgtggtacgggacgaccgttggaacgtaccctaggaaccgaacccgacccggtccccttacgttacgtttaacccgtggtccggacccgggtaacgggtcccccttaacgttaccccttacgtaacgggttcccgaaacccttcccgttaccccgtaaccggtccgtttaacgggtttccccgaccgttccgggttaaccgggggaaccccgttaacccggggg

SEQ ID NO: 300254 - DNA, 649 bp, Homo sapiens
  misc_feature: GZ8MTXP01BZR2U.11.72.G06.1.454.CMB.2.raw
  modified_base (237)..(237): a, c, t, g, unknown or other
  misc_feature (237)..(237): n is a, c, g, or t
  modified_base (294)..(294): a, c, t, g, unknown or other
  misc_feature (294)..(294): n is a, c, g, or t
  modified_base (465)..(465): a, c, t, g, unknown or other
  misc_feature (465)..(465): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagccgtggggcctcagtgagtctctgtagcctnagtcaccttcacgctaatgatcactgctcgcacggccctggacaggctggagtgggnggatggatcgaactcgtaccacgtacgtgggaaacgtcgaaggtacgttctaaggtccggacggggtaagagtacgttccggaaaggggctaaggacgtacccaacccgtcgaacccacgacggaacaccgactacccgaaccgacccaacgtaaggttaccctaaacggngttacgggacgccgtaggtacgggacctacggggtacgacggacctacggaccgtaccgacccggtcctctataccgtgtacgcggtaacggtccccttagacccttagtacgtcgacccttcttacccggaacgtcgttaaccggttccggaccgttcggaaccgggggaaccgtaacccggg

SEQ ID NO: 300255 - DNA, 703 bp, Homo sapiens
  misc_feature: GZ8MTXP01BIB9E.11.72.G06.1.454.CMB.2.raw
  modified_base (217)..(217): a, c, t, g, unknown or other
  misc_feature (217)..(217): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagcctggggcctnagtgaaggtctcctgtaaggcctcagttacaccttcaccgctaatggtatcactggctcgacaggccctggacaggcttggagtgggtggatggatcaactctacacacgtggaacgcagagtctagtcggacggagagtacgttcccggaaaggggtaccaaggtacgttacccgaaccccgttaggaaaccccaacgaacgggaaacgaaccctaacgtaccccgaaccggaacccaaccgtacgtacctaacgtagtgggaacgtccgtaggtacggaacgtccggtaggaacgtacccgtaggaaccgtacccgacccgggtcccttactttaacgttacccgtggtaccggccggtaaccgggtccccttacgtaccccgttacgtacgggttaccgaaccccttaccgttccccgaaccggtccgtttcgggttaccccgaccggttccgggtccgggggaaccccgttaaacccggggg

SEQ ID NO: 300256 - DNA, 658 bp, Homo sapiens
  misc_feature: GZ8MTXP01D3D4R.11.72.G06.1.454.CMB.2.raw
  modified_base (217)..(217): a, c, t, g, unknown or other
  misc_feature (217)..(217): n is a, c, g, or t
  modified_base (236)..(236): a, c, t, g, unknown or other
  misc_feature (236)..(236): n is a, c, g, or t
  modified_base (252)..(252): a, c, t, g, unknown or other
  misc_feature (252)..(252): n is a, c, g, or t
  modified_base (273)..(273): a, c, t, g, unknown or other
  misc_feature (273)..(273): n is a, c, g, or t
  modified_base (293)..(293): a, c, t, g, unknown or other
  misc_feature (293)..(293): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagccgtgggcctnagtgagtctctgtagcctnagttacaccttcacgntaatgtatcactggctcgacncgccctgacagctgagtggngatgatcaactcacacacgtaggaacgcagtacgtctaagtcggacggaagtacgtacgttacccggaaaggggcaacgggtacgtaccccgaacccgtacgaacccaagtacgacgacctactacccgaacgaccacgtacgtactacgagtgggacgtcgtaggtagggaccgtacggtacggacgtacccgtacggaacccgaaccgtcccggtacccttagttaccgttacgtcggtaccggaccggtaaccggtacccttacgtccccgttaagtacggttaccgaccccttcgttacccgcggttccgttcgggttaccccaccggttaccggggtccggggaacccgtaaccccgggg

SEQ ID NO: 300257 - DNA, 642 bp, Homo sapiens
  misc_feature: GZ8MTXP01B6R1S.11.72.G06.1.454.CMB.2.raw
  modified_base (242)..(242): a, c, t, g, unknown or other
  misc_feature (242)..(242): n is a, c, g, or t
  modified_base (431)..(431): a, c, t, g, unknown or other
  misc_feature (431)..(431): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagccgtgggcctcagtgaaggtctcctgtaaggcctnaggttacaccttcaccgctaatggtatcacctggcttcgacacggcccctggacaaggcttggagtgggtggatggatcaactctacacacgtggaagcaggagtctagtcggcggagagtactcccgaagggcaagcgtccacccgtgaccacagacacactaccacgaccacagtactacagtggancgtgtggacgccgtagaccggacctggaaccgcgaccccggtccttaccgtaacgttcgtcggtacgccggtaaccggtccccttaacgtccccgttaaacgaccggttccgaaaccccttaccttaccccggtaaccggttccgtttaacccggggtttacccgtacccggttccgggtccggggggttaaccccgtaaaccccgggggg

SEQ ID NO: 300258 - DNA, 777 bp, Homo sapiens
  misc_feature: GZ8MTXP01AQVV0.11.72.G06.1.454.CMB.2.raw
  modified_base (215)..(215): a, c, t, g, unknown or other
  misc_feature (215)..(215): n is a, c, g, or t
  modified_base (233)..(233): a, c, t, g, unknown or other
  misc_feature (233)..(233): n is a, c, g, or t
  modified_base (250)..(250): a, c, t, g, unknown or other
  misc_feature (250)..(250): n is a, c, g, or t
  modified_base (272)..(272): a, c, t, g, unknown or other
  misc_feature (272)..(272): n is a, c, g, or t
  modified_base (295)..(295): a, c, t, g, unknown or other
  misc_feature (295)..(295): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagctgggcctnagtgagtctctgtagctnagttacacttcaccgtntaatgtatcacctgcttcgacncggccctggacaggctgagtggnggatggatcaactctcactacgtaggaagcagagtcgtatccggacggagaggtacttaccggaagggaccaacggacgttaccccgaaccccgtacggaacccaacgacgggaaacgaccaccgtaccccaaaccggaccaaaccgtacgtacccgtaacctaggtacgggtaacgtccgtagggtacggtaccggtaccgggtaggtaacccggttaccggtaaccggtaacccggaaacccggtaccccggtacccccgttttaacggtttaaacctttacccgggttaggttacccgggaaccgggttaaaccccgggtcccctttaacgttaacccccgttaaacggtaaccggttaccccggttaaaccccttccccgttaaaccccgggtcccgttcccgggttcccggggttttaaaccccgcccccgggttccggggtaaccgggggttaacccccgggttaaaccccggggg

SEQ ID NO: 300259 - DNA, 611 bp, Homo sapiens
  misc_feature: GZ8MTXP01A61ID.11.72.G06.1.454.CMB.2.raw
  modified_base (218)..(218): a, c, t, g, unknown or other
  misc_feature (218)..(218): n is a, c, g, or t
  modified_base (240)..(240): a, c, t, g, unknown or other
  misc_feature (240)..(240): n is a, c, g, or t
  modified_base (257)..(257): a, c, t, g, unknown or other
  misc_feature (257)..(257): n is a, c, g, or t
  modified_base (401)..(401): a, c, t, g, unknown or other
  misc_feature (401)..(401): n is a, c, g, or t
  modified_base (412)..(412): a, c, t, g, unknown or other
  misc_feature (412)..(412): n is a, c, g, or t
  modified_base (555)..(555): a, c, t, g, unknown or other
  misc_feature (555)..(555): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcattccttttcttggtggcagcagcaacaggtgcccactcacagggtcaactggtgcagtctggacctgaggtgaagagccgtgggcctnagtgaaggtctctgtaagcctnagttacaccttcaccgntaatggtatcacctggcttcgacacggccctaggacaaggcttggaggtgggtggatggatcaactctacacactaggagcagagtctagtcggcggagacgtatccgaagggcaaggactccaccctagaccagagacgacanccacgaccaangtactacgagtcggacgtcgtaggtaggacgtaccggtagaccggtaccgtacgggaacccgtaccgaccccggtccttaacgttaacgttacgtcggtacgaccggtaaccgtcccttacgtacccagtaccgtacgacccnccttcccgaacgtcgttaacggtccgaccgttcggtaacggggcccgtaacccggg

SEQ ID NO: 300260 - DNA, 616 bp, Homo sapiens
  misc_feature: GZ8MTXP01B2MP8.11.72.G06.1.454.CMB.2.raw
  modified_base (217)..(217): a, c, t, g, unknown or other
  misc_feature (217)..(217): n is a, c, g, or t
  modified_base (238)..(238): a, c, t, g, unknown or other
  misc_feature (238)..(238): n is a, c, g, or t
  modified_base (254)..(254): a, c, t, g, unknown or other
  misc_feature (254)..(254): n is a, c, g, or t
  modified_base (346)..(346): a, c, t, g, unknown or other
  misc_feature (346)..(346): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctgggcctnagtgaggtctctgtaagcctnagtacaccttcaccgntatgtatcacctggcttcgacaggcccctggacaggcttgagtgggtggatggatcaactctcacacgtggaagcagagtctatcggcgganaggtactccgaagggcaagacgtccaccctgaccacagacgacactaccacgacccacgagtacctaacagtcggagctggtaggacgccgtaggacgtaccctaggaacccgaccgaccgggtccccttacttacttaccgtggtccggaccggtaacggtccccttacgtccccgttagtaccggtacgaacccttccggttcccaaccggtccgttcgggttcccgacccggttaccgggtccgggggaaccccgtaaccccggggg

SEQ ID NO: 300261 - DNA, 683 bp, Homo sapiens
  misc_feature: GZ8MTXP01A15SB.11.72.G06.1.454.CMB.2.raw
  modified_base (216)..(216): a, c, t, g, unknown or other
  misc_feature (216)..(216): n is a, c, g, or t
  modified_base (238)..(238): a, c, t, g, unknown or other
  misc_feature (238)..(238): n is a, c, g, or t
  modified_base (254)..(254): a, c, t, g, unknown or other
  misc_feature (254)..(254): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagcctgggcctnagtgaggtctcctgtaagcctnagttacaccttcacgntaatgtatcactgctcgacagccctggacaggctgagtgggtggatggatcgaactctacacacgtaggaagcgagagtctagtcggacggagagacgttccgaaggggactaaggacgtcccgaaaccccgtcgaacccgaacgaacggacgaaccaacctaccccgaaaccggaaccccaaccgtaacgttacccgtaacgaacgttagggacgtccgttaggtacgggacgtaccggttacggaacggtacccgtacggaacccgtaccgtaacccgggtccccttacgttacgttaaccgtcggttcggccggtaaccggtaccccttacgtaccccgttacgtacgttaccgaccccttccgttacccgtaaccgtccgttccggttccgacccgttaccggtcggggaacccgtaacccgggg

SEQ ID NO: 300262 - DNA, 700 bp, Homo sapiens
  misc_feature: GZ8MTXP01EV4QA.11.72.G06.1.454.CMB.2.raw
  modified_base (218)..(218): a, c, t, g, unknown or other
  misc_feature (218)..(218): n is a, c, g, or t
  modified_base (239)..(239): a, c, t, g, unknown or other
  misc_feature (239)..(239): n is a, c, g, or t
  modified_base (253)..(253): a, c, t, g, unknown or other
  misc_feature (253)..(253): n is a, c, g, or t
  modified_base (411)..(411): a, c, t, g, unknown or other
  misc_feature (411)..(411): n is a, c, g, or t
  modified_base (436)..(436): a, c, t, g, unknown or other
  misc_feature (436)..(436): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcattccttttcttggtggcagcagcaacaggtgcccactcacagggtcaactggtgcagtctggacctgaggtgaagagccgtgggcctnagtgaagtctctgtaagcctnagtacaccttcacnctaatgtatcactgctcgacacggccctgacaaggctgagtgggtggatggatcaactctacacgactaggaagcagagtactagtcggacgggtaagacgtattcccgaaaggggacaaggacgtacccaaccctaggaacccaagagaacgacacncccgaaacgaccaacagtacctaanagtacggagtcgttaggtacgggaacgtcccgggtaggaaaccggtaacccgtaggaaacccggaacccgtacccgggtccccgtttaacttaaacgtttaccggttcgggtacggacccggtaaccgggtaccccctttaaacggtacccttaaaccgagggttaacccgaaaccccgttaccttaccccgaacggtccgtttaaccggggttcccgtacccggtttaccgggtcccggggggaacccgtaaaccccgggggg

SEQ ID NO: 300263 - DNA, 607 bp, Homo sapiens
  misc_feature: GZ8MTXP01AXCIG.11.72.G06.1.454.CMB.2.raw
  modified_base (244)..(244): a, c, t, g, unknown or other
  misc_feature (244)..(244): n is a, c, g, or t
  modified_base (261)..(261): a, c, t, g, unknown or other
  misc_feature (261)..(261): n is a, c, g, or t
  modified_base (283)..(283): a, c, t, g, unknown or other
  misc_feature (283)..(283): n is a, c, g, or t
  modified_base (309)..(309): a, c, t, g, unknown or other
  misc_feature (309)..(309): n is a, c, g, or t
  modified_base (376)..(376): a, c, t, g, unknown or other
  misc_feature (376)..(376): n is a, c, g, or t
  modified_base (460)..(460): a, c, t, g, unknown or other
  misc_feature (460)..(460): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagccgtggggcctcgagtgaaggtctcctgtaaggcctnagttacaccttcaccgntaatgtatcactggcttcgacncggccctggacaaggcttgagtgggnggatggatcaacgtctacacgtacgtaggaacgcagtagtctagtcgcggagagattccgaagggcngacgtccaccctgaccagagacacactccaacgaccacacgtactaacagtcggagcttggacgtacgccgttaggacgtaccnggaccgaccgaccggtcccttacgttaacgttcgtggtcgacggtaacggccccttacgtccttaaccgacgtaccgaacccttcccgttcccgaacggtcgttccggtcccgtaccgttcgggtcccgggaaccggtaacccgggg

SEQ ID NO: 300264 - DNA, 587 bp, Homo sapiens
  misc_feature: GZ8MTXP01AMPOF.11.72.G06.1.454.CMB.2.raw
  modified_base (413)..(413): a, c, t, g, unknown or other
  misc_feature (413)..(413): n is a, c, g, or t
  modified_base (431)..(431): a, c, t, g, unknown or other
  misc_feature (431)..(431): n is a, c, g, or t
  modified_base (441)..(441): a, c, t, g, unknown or other
  misc_feature (441)..(441): n is a, c, g, or t
  modified_base (471)..(471): a, c, t, g, unknown or other
  misc_feature (471)..(471): n is a, c, g, or t
  modified_base (524)..(524): a, c, t, g, unknown or other
  misc_feature (524)..(524): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacacggcccctggacaaggacttgagtgggtggatggatcaactctcacactggaagcagagtctagtcgcggagagatccgaagggcaagagtccacccgtgaccacgagacgacagtacccaacgaccanacgtactacgatcgggancgttggacgngccgtagacgactgaccgacgaccgtcctntacttcgcgtggccgtaacggtccccttatccccgttagacgtccgaaccccncttacccaaccggtcgttccgggttccgacccgttcgggtccgggggaaccctaacccggggg

SEQ ID NO: 300265 - DNA, 625 bp, Homo sapiens
  misc_feature: GZ8MTXP01A0NLC.11.72.G06.1.454.CMB.2.raw
  modified_base (240)..(240): a, c, t, g, unknown or other
  misc_feature (240)..(240): n is a, c, g, or t
  modified_base (275)..(275): a, c, t, g, unknown or other
  misc_feature (275)..(275): n is a, c, g, or t
  modified_base (299)..(299): a, c, t, g, unknown or other
  misc_feature (299)..(299): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcattccttttcttggtggcagcagcaacaggtgcccactcacagggtcaactggtgcagtctggacctgaggtgaagagccgtggggcctcagtgagtctccgtgtagcctnagtacacctcacgctaatgtatcactggctcgacncgccctggacaggctgaggtgggnggatggatcaactctcacacgtaggaagcagagtctagtcggaggagagtacgttcccgaaaggggtcaaggacgtacccaacccgtagaacccacgaaggaacgaccaactacccgaacgaaccctaacgacgttaccaagacgtacgggactcgtaggacggacgtccggtaggaacgtacccgtaggaacccgaccgaccggtacccttacgttacgttacgtcgttcgaccggtaacgtaccccttagtccccttaagacgtccaaccgccttccgaacgtcgttccgggtaccgaccgttcgggtccgggcccgaaccggg

SEQ ID NO: 300266 - DNA, 659 bp, Homo sapiens
  misc_feature: GZ8MTXP01CV6II.11.72.G06.1.454.CMB.2.raw
  modified_base (243)..(243): a, c, t, g, unknown or other
  misc_feature (243)..(243): n is a, c, g, or t
  modified_base (281)..(281): a, c, t, g, unknown or other
  misc_feature (281)..(281): n is a, c, g, or t
  modified_base (303)..(303): a, c, t, g, unknown or other
  misc_feature (303)..(303): n is a, c, g, or t
  modified_base (306)..(306): a, c, t, g, unknown or other
  misc_feature (306)..(306): n is a, c, g, or t
  modified_base (317)..(317): a, c, t, g, unknown or other
  misc_feature (317)..(317): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagccgtggggcctcagtgaaggtctcctgtaaggcctnagtacaccttcaccgactaatggtatcactgctcgacnggccctggacaggctgagtggnggntggatcactcncacacgtggaagcagagtctagtcggcggagagtacttccgaaagggcaaggacgtccaacccgtgaacccacacgacgacactaccgaaccgacaacacgtactaacgagtggagtcgttggacggtacgaccggtaacggaccgtaccgtacggaacccggaaccgtaccccggtacccttaaccgttaacttaccggtacggtaccggccgggtaacccgtaacccgttacgttacccgttacgtaaacggtacccgttacccgttacccgttcccgaacgtccggttccggttaccgtacccggttccgggtaaccggggaaccccgtaacccggggg

SEQ ID NO: 300267 - DNA, 681 bp, Homo sapiens
  misc_feature: GZ8MTXP01AR245.11.72.G06.1.454.CMB.2.raw
  modified_base (347)..(347): a, c, t, g, unknown or other
  misc_feature (347)..(347): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagcctggggcctcagtgaaggtctctgtaacggcctcaggttacaccttcaccgctaagtggtatccacctggcttcgacacggcccctggacaaggcttggagtgggtgggatggatcgaactcgtacacgacgtgggaacncgaagacgtacgtagtcggcggagacgtacttacccggaaggggccaagacggtaccacccgtcgaaccagtaacgacgaccacgacccaacggacccaagacgtacctaacgatacggagccgtggtacggacgcccgtagggaacgtaccgacggaccgtaccgaccgggtccccttagttaacttcgtacggtccggcgggtaaacccggtccccttaaatccccgttaaacgaccggttaccgaaccccttccgttaccccgaaccggttccgtttcccgggttcgaccccgtttcggggtcccgggggttaacccgtaaaccccggggg

SEQ ID NO: 300268 - DNA, 619 bp, Homo sapiens
  misc_feature: GZ8MTXP01ENP3L.11.72.G06.1.454.CMB.2.raw
  modified_base (183)..(183): a, c, t, g, unknown or other
  misc_feature (183)..(183): n is a, c, g, or t
  modified_base (217)..(217): a, c, t, g, unknown or other
  misc_feature (217)..(217): n is a, c, g, or t
  modified_base (234)..(234): a, c, t, g, unknown or other
  misc_feature (234)..(234): n is a, c, g, or t
  modified_base (267)..(267): a, c, t, g, unknown or other
  misc_feature (267)..(267): n is a, c, g, or t
  modified_base (568)..(568): a, c, t, g, unknown or other
  misc_feature (568)..(568): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtncagtctggacctgaggtgaagagccgtgggcctnagtgagtctctgagctnagtacactcacgctaatgtatcactgctcgacncgccctaggacaggcttggagtgggtggatggatcaactctcacgacgtaggaacgcagagtactagcggacggagagtacgttaccgaaaggggctaaggacgtccaaccccgtagaacccgacgaacggaacgacccacgtaaccccaaacggaccaaaccgtacgttaccgtaaacgagtacgggaacgcgtaggtacgggacgccggtaggacgaccgtagaccgaccgaccggtcccttagtacttacgtcgtcgccggtaacgtccccttataccccgttaatcgtaccgacccnccgttaccgaacgtcgttcgttaccgcgttacggtcgggcccgtaaccggg

SEQ ID NO: 300269 - DNA, 652 bp, Homo sapiens
  misc_feature: GZ8MTXP01BL0W0.11.72.G06.1.454.CMB.2.raw
  modified_base (262)..(262): a, c, t, g, unknown or other
  misc_feature (262)..(262): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctccgtgtaacggcctcaggttacaccttcaccgntaaatgtatccactggcttcgacacgggcccctaggacaagggtacttaggacggtggggtgggatggatccaacgtctccacgtacgtaggaacgcaagtaggtctagtcggacgggagacgtattcccggaaagggtccaaggacgtcccaacccgtacggaccccaagaggacacctacacccgaacgaccaacacgttactaacgagttacgggatccgtgggtacgaacggtccggttagaacgggtaccctagggaaacccgacccgtaccggaccctttactaacgttaccgtggttacggccgaacgtccccttacgtcccttagacgtcaaccttcttccgaacgtctcgggttcaccgttcggtcgggcccgtaacgggg

SEQ ID NO: 300270 - DNA, 597 bp, Homo sapiens
  misc_feature: GZ8MTXP01EPFT0.11.72.G06.1.454.CMB.2.raw
  modified_base (217)..(217): a, c, t, g, unknown or other
  misc_feature (217)..(217): n is a, c, g, or t
  modified_base (236)..(236): a, c, t, g, unknown or other
  misc_feature (236)..(236): n is a, c, g, or t
  modified_base (241)..(241): a, c, t, g, unknown or other
  misc_feature (241)..(241): n is a, c, g, or t
  modified_base (248)..(248): a, c, t, g, unknown or other
  misc_feature (248)..(248): n is a, c, g, or t
  modified_base (253)..(253): a, c, t, g, unknown or other
  misc_feature (253)..(253): n is a, c, g, or t
  modified_base (323)..(323): a, c, t, g, unknown or other
  misc_feature (323)..(323): n is a, c, g, or t
  modified_base (490)..(490): a, c, t, g, unknown or other
  misc_feature (490)..(490): n is a, c, g, or t
  modified_base (545)..(545): a, c, t, g, unknown or other
  misc_feature (545)..(545): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagccgtgggcctnagtgagtctctgtagcctnagtcnctcacgntatgntcactggctcgacacggccctggacaaggtcttggaggtgggtggatggactcaactctcacactaggancagagtctagtcggcggtagagacgtcccgaaggggctaaggacgtccacccctaggaacccaacgagacgactacgtacccaacgaccacgacgtactacgtaagtcgggagtcgtaggtgacgccgtagccggacctacgaccgacctacccggtcccttacgtnttacggtcgtcgacggaacggtcccttagtcccttaaagacgtacgcccttaccncccgaacggtccttcgggtccaccgttcggtaaccggggttaacgaaccggg

SEQ ID NO: 300271 - DNA, 625 bp, Homo sapiens
  misc_feature: GZ8MTXP01EBQQI.11.72.G06.1.454.CMB.2.raw
  modified_base (216)..(216): a, c, t, g, unknown or other
  misc_feature (216)..(216): n is a, c, g, or t
  modified_base (239)..(239): a, c, t, g, unknown or other
  misc_feature (239)..(239): n is a, c, g, or t
tcagcgagagataccacgaccggtgctcgatttagctacgactgcaagggaaaggggacccaaaaaccacacccctccttgggagaatcccctagatcatagctcctcaccatggactggacatggagcatccttttcttggtggcagcagcaacaggtgcccactcacagggtcaactggtgcagtctggacctgaggtgaagaagctgggcctnagtgaaggtctctgtaaggcctnagtacacttcaccgctaatggtatcactggctcgacacggcccctaggacaaggacttggagtgggtggatggatcaactcgtcacatggaagcagagtctagtggacggagagacgttacccgagggtccgaagacgtaccacccgtgaccacagacgacacgtaccacgaccaacgacgtactacagtggacgtcgtagtggacgcccgttagaaccgaccgtacggaacgtacccgacggtaccctcttaacgtttaccgtcggttcggaacgtaccgggttcccctaacttcccgtaactacgggttaccgacccgttaccctccccaaccggtcgttcccgggttaccgaccccgtttccgggttccgggggtaaccccgg

SEQ ID NO: 300272 - DNA, 657 bp, Homo sapiens
  misc_feature: GZ8MTXP01AX6EQ.11.72.G06.1.454.CMB.2.raw
  modified_base (301)..(301): a, c, t, g, unknown or other
  misc_feature (301)..(301): n is a, c, g, or t
  modified_base (323)..(323): a, c, t, g, unknown or other
  misc_feature (323)..(323): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagccgtgggcctcagtgaaggtctcctgtaaggcctcgagttaccaccttcacgctaatgtatcactgctcgacagccctgacagctgagtggtggntggatcaactcacccataggancgagtagtcatggaccgagagacttccgaggacagcgtaccaccgtagacccagacgtaacgaccactaccgaaccgaaccaacgtacttactaaccgtagtacgggaccgtagtcgtacgggacgtaccgttacgggggaacgtaaccggttaccggaacccgaaccggtaaccccgggtccccgtttaactttaacgttacccggttggtaccggacccggtaacgggccccttaacgttacccgtaacggttactaccgtaacccttaccgttcccacggtcgttaccggtccaccgtcgggttcgggaacccggttaacgggtaaccccg

SEQ ID NO: 300273 - DNA, 596 bp, Homo sapiens
  misc_feature: GZ8MTXP01AV4P2.11.72.G06.1.454.CMB.2.raw
  modified_base (245)..(245): a, c, t, g, unknown or other
  misc_feature (245)..(245): n is a, c, g, or t
  modified_base (452)..(452): a, c, t, g, unknown or other
  misc_feature (452)..(452): n is a, c, g, or t
  modified_base (464)..(464): a, c, t, g, unknown or other
  misc_feature (464)..(464): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcattccttttcttggtggcagcagcaacaggtgcccactcacagggtcaactggtgcagtctggacctgaggtgaagaagccgtggggcctcgagtgaaggtctcctgtaaggcctnagttacacttcaccgctaatggtatcacgtggcttcgacaggcccctggacaaggacttggagtgggtgggatggattcgaactctcacacgtggaagcagagtctagtcggcggagagtacttcccgaaaggggtcaaggtacgtccaacccgtcgaacccgagacgacgacactacccgacgaaccgacagtactacagtgggancgtgtacggganccgtgacgtccaggacgccgacggcccttatacttaccgtgtcggccgtaacggtaccccttagtcccttacgacgtcgacccacgttcccaacgtcgtcggttccgacgttccgtcgggcccgtaacgggg

SEQ ID NO: 300274 - DNA, 722 bp, Homo sapiens
  misc_feature: GZ8MTXP01B01CW.11.72.G06.1.454.CMB.2.raw
  modified_base (309)..(309): a, c, t, g, unknown or other
  misc_feature (309)..(309): n is a, c, g, or t
  modified_base (335)..(335): a, c, t, g, unknown or other
  misc_feature (335)..(335): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagcctgggcctcagtgaaggtctcctgtaaggcctcaggttaccaccttcaccgctaatggtatcacctggcttcgacaggcccctggacaaggtctgagtgggnggatggatcaactctcacactggaancgagagtctagtccgacgggagagtacttaccgaaaggaccaaggacgtcccaccccgtacgaacccaacggacgaacgacaacgtccccaacggacccaacgacgtaccctaacgtacgttacgggagtaccgtaggttacgggaccggtacccggttacgggaaaccgtaccccgttaggaacccggaaccgtaccccggggtccccttacgtaacgtttacccgtggttaccgacgggtaaccgggtccccgttataccccgttaaacgtcggtaacccgttacccggttacccttaccccgtaacccgggttccgtttcccgggggttaacccgtcccgttcccggggttaacccgggggaaccccgttaaacccccgggggg

SEQ ID NO: 300275 - DNA, 600 bp, Homo sapiens
  misc_feature: GZ8MTXP01A4JBH.11.72.G06.1.454.CMB.2.raw
  modified_base (282)..(282): a, c, t, g, unknown or other
  misc_feature (282)..(282): n is a, c, g, or t
  modified_base (288)..(288): a, c, t, g, unknown or other
  misc_feature (288)..(288): n is a, c, g, or t
  modified_base (315)..(315): a, c, t, g, unknown or other
  misc_feature (315)..(315): n is a, c, g, or t
  modified_base (335)..(335): a, c, t, g, unknown or other
  misc_feature (335)..(335): n is a, c, g, or t
  modified_base (428)..(428): a, c, t, g, unknown or other
  misc_feature (428)..(428): n is a, c, g, or t
  modified_base (546)..(546): a, c, t, g, unknown or other
  misc_feature (546)..(546): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagccgtggggcctcagtgaaggtctcctgtaaggcctcaggttacaccttcaccgctaatggtatcactgctcgacnggcccnggacaaggcttgaggtgggtggatggntcaactctcacactaggaancgagagtctagtggacggagagacgttcccgaaggggccaagacgtccacccgtcgaccacgagacgactacgccaacgaccaacagtaccanagtggagcgtggtagacgcggtagacgaccctaggaaccgaccgaccggtacccttacgttacgttaccgtaggtcgaccggtaacggtcccttacgtacccttagacgtcgaacccncgttcccgaacgtcgttcggttcccgacgttcggtcgggaaccgtaacccgggg

SEQ ID NO: 300276 - DNA, 603 bp, Homo sapiens
  misc_feature: GZ8MTXP01EM9ZV.11.72.G06.1.454.CMB.2.raw
  modified_base (218)..(218): a, c, t, g, unknown or other
  misc_feature (218)..(218): n is a, c, g, or t
  modified_base (237)..(237): a, c, t, g, unknown or other
  misc_feature (237)..(237): n is a, c, g, or t
  modified_base (252)..(252): a, c, t, g, unknown or other
  misc_feature (252)..(252): n is a, c, g, or t
  modified_base (272)..(272): a, c, t, g, unknown or other
  misc_feature (272)..(272): n is a, c, g, or t
  modified_base (287)..(287): a, c, t, g, unknown or other
  misc_feature (287)..(287): n is a, c, g, or t
tcagcgagagataccacgaccggtgctcgatttagctacgactgcaagggaaaggggacccaaaaaccacacccctccttgggagaatcccctagatcacagctcctcaccatggactggacctggagcattccttttcttggtggcagcagcaacaggtgcccactcacgagggtcaactggtgcagtctggacctgaggtgaagagcgtgggcctnagtgagtctctgtacgctnagtacaccttcacgntatgtatcactggctcgacncgccctgacagctgnggtggtggatggatcgaactctcactacgtaggaacgcgagtagtctagtcggacggagagtacttccggaaagggtcaaggacgtaccaacccgtagaacccacgagacgacactaccacgacacagtacacagtggagtcgtaggacgacgccggtaagaccgtacctacggaaccgaccgaccggtcccttagttacgttcgtcgacggcgtaacgtcccttgtaccgttacgacggtaccttacccgccttaccggaacgttccgtaacggttcccgtacccggttcgggtccgggaacccgtaacccgggg

SEQ ID NO: 300277 - DNA, 673 bp, Homo sapiens
  misc_feature: GZ8MTXP01ANEBV.11.72.G06.1.454.CMB.2.raw
tcagcgagagataccacgaccggtgctcgatttagctacgactgcaagggaaaggggacccaaaaaccacacccctccttgggagaatcccctagatcatagctcctcaccatggactggacctggagcatccttttctggtggcagcagcaacaggtgcccactcacagggtcaactggtgcagtctggacctgaggtgaagagccgtgggcctcagtgaagtctcctgtaaggcctgagttacaccttcacgctaatggtatctacgtggcttcgacacggccctggaacaggtctggaggtgggtggatggatcgaactctacgacgtacgtaggaacgcgaagtacgtctaagtcggacggagaggtacttccggaaagggacaaggtacgtaccctacccgtacggaacccaacggagaaaccgacaactacccgaaccgtaaccaacgtacgtactaaccgagtacgggacgtcgttagggtacggacgcggtacggaacgaccgtacggaaccgtaccgaccggtcccgtaactacgttaccgtcgtcggacctaacgggtcccttatacccgttaacgacgttaccgacccttacgttccccgtaacccggttcgttaaccgggtttacccgaccgttccgggttcggggcccggtaacccgggg

SEQ ID NO: 300278 - DNA, 635 bp, Homo sapiens
  misc_feature: GZ8MTXP01AOTOR.11.72.G06.1.454.CMB.2.raw
  modified_base (342)..(342): a, c, t, g, unknown or other
  misc_feature (342)..(342): n is a, c, g, or t
  modified_base (377)..(377): a, c, t, g, unknown or other
  misc_feature (377)..(377): n is a, c, g, or t
  modified_base (556)..(556): a, c, t, g, unknown or other
  misc_feature (556)..(556): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttctggtggcagcagcaacaggtgcccactcacagggtcaactggtgcagtctggacctgaggtgaagaagcctggggcctcagtgaaggtctccgtgtaaggcctcaggttacaccttcaccgactaatggtatcactggcttcgacacggcccctggacaaggcttggacgtgggtggactggatcaactctcacacgtggaacncagatctagtcggcggaagcgtactccgaagggcngtacgtccaacccgtcgaaccacgagacgacgataccaacggacctacgagttaccacgtagtgggacgcgttggacggagtcccggtaggaccgtaccgtaggaccgaccgaccggtcccttacgtaacttccgtgtcgccggaacgtcccttagtccccacgtaacggtccaacccnccgttacccgaaccggttccgttaaccgggttccccaacccggtttccgggaaccgggggttccccgtaaacccggggg

SEQ ID NO: 300279 - DNA, 704 bp, Homo sapiens
  misc_feature: GZ8MTXP01BJKXW.11.72.G06.1.454.CMB.2.raw
  modified_base (217)..(217): a, c, t, g, unknown or other
  misc_feature (217)..(217): n is a, c, g, or t
  modified_base (237)..(237): a, c, t, g, unknown or other
  misc_feature (237)..(237): n is a, c, g, or t
  modified_base (244)..(244): a, c, t, g, unknown or other
  misc_feature (244)..(244): n is a, c, g, or t
  modified_base (594)..(594): a, c, t, g, unknown or other
  misc_feature (594)..(594): n is a, c, g, or t
tcagcgagagataccacgaccggtgctcgatttagctacgactgcaagggaaaggggacccaaaaaccacaccctccttgggagaatccctagatcatagctcctcaccatggactggacctggagcattccttttcttggtggcagcagcaacaggtgcccactcacagggtcaactggtgcagtctggacctgaggtgaagagccgtggggcctnagtgaagtctctgtagcctnagttacnctcacgctatgatcactgcttcgacacggccctggacaggacttggaggtgggtggatggatcaactctcaactacgtaggaacgcaggtacgttacgtagtcggacggagtagtaccgttacccggaagggggtaccaaggtacgtaccccgaaacccgttcggaacccgaaacgacgggaaaccgttaaccaactaaccccgaaaccggaacccaaccgtaacggttacccaacgtaaggtcggggaacggtccgttaagggtcgggaacggccggttaacggaaccggtacccgttaacgggacccgaacccgtaccccgggttacccttaactacgttttaaccgnggttaccggcggtaacccgtaccccttacgtaccccttaagcggtccaacccttccgttccgaacgtcgttcggttaccgccggttcggtcggggaacccgtaaccgggg

SEQ ID NO: 300280 - DNA, 673 bp, Homo sapiens
  misc_feature: GZ8MTXP01BGHN5.11.72.G06.1.454.CMB.2.raw
  modified_base (217)..(217): a, c, t, g, unknown or other
  misc_feature (217)..(217): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagccgtgggcctnagtgaagtctccgtgtaacggcctcgtagttactaccttcaccgtataatggtatccacctggcttacgacacggcccctggacaaggtctggagtgggtggatggatcaactctacactacgtggaacgcaggtagtcgtagtcggacggagagtacgttccggaaagggcaaggtcgtacccaacccgtgaacccagaacgacgaactacacccgaaccgacccaacgtacgtaccgtacgagtcgggactcgtaggtagggaccgtccggttaacggaacgtaccccgtacgggaaacccgacccgtaacccggtcccttaacgttaacgttccgcggttaaccggccgaaacggttcccttaagtacccttaacgaccgttacgaaccccttcttcccgaaccgtcggttccgtacccgtccgttccgggtcgggaacccggtaaccccggg

SEQ ID NO: 300281 - DNA, 620 bp, Homo sapiens
  misc_feature: GZ8MTXP01BU5B5.11.72.G06.1.454.CMB.2.raw
  modified_base (241)..(241): a, c, t, g, unknown or other
  misc_feature (241)..(241): n is a, c, g, or t
  modified_base (306)..(306): a, c, t, g, unknown or other
  misc_feature (306)..(306): n is a, c, g, or t
  modified_base (334)..(334): a, c, t, g, unknown or other
  misc_feature (334)..(334): n is a, c, g, or t
  modified_base (338)..(338): a, c, t, g, unknown or other
  misc_feature (338)..(338): n is a, c, g, or t
  modified_base (437)..(437): a, c, t, g, unknown or other
  misc_feature (437)..(437): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccatcacagggtcaactggtgcagtctggacctgaggtgaagaagcctggggcctcagtgaaggtctcctgtaaggcctnaggttacaccttcaccgctatggtatcactggcttcgacagccctggacaggtcttggagtgggnggatggatcaactctacacactggaacngagngtctagtcggacggagagtattccgaaagggcaagtactcccgacctcgaccacgagacgacacgtccaacgaccacgtagtacctacagttagggacncgtaggtacggacgtccggtagaaccggtaccgtacggaacccgaacccgacccgggtcccctttaactacgttaaccgtggttaccgcggtaaccggtccccttagtccccttagacggttacacccttccttcgaaccgtcgtaacggttcccacgttcggtccgggaaccgtaaccgggg

SEQ ID NO: 300282 - DNA, 646 bp, Homo sapiens
  misc_feature: GZ8MTXP01CW80L.11.72.G06.1.454.CMB.2.raw
  modified_base (242)..(242): a, c, t, g, unknown or other
  misc_feature (242)..(242): n is a, c, g, or t
  modified_base (332)..(332): a, c, t, g, unknown or other
  misc_feature (332)..(332): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagccgtggggcctcgagtgaaggtctctgtaaggcctnagttacaccttcaccgtctatgtatcactggctcgacacggccctggacaggactggagtggtggatggatcaactcacacacgtaggancagtagtctagtcggacgggaagagtacttaccgaaagggtaacgaaggtacgtacccaacccgttacggaacccaaacgacgaacgactactacccgaaccgacaacgtaacgtactacgagtggacgtcgtaggtacggacgtacggtaggaaccgtaccgtacggaaccgaccgtacccggtaccttacgttacgttaccgtgtccggacgtcgtacccttagtacccgttagtacgtccgaacccttccgttccgaaccgttccgttcggtcccgtaccgttaccggtccggggaacccgtaacccgggg

SEQ ID NO: 300283 - DNA, 711 bp, Homo sapiens
  misc_feature: GZ8MTXP01BHPOK.11.72.G06.1.454.CMB.2.raw
  modified_base (218)..(218): a, c, t, g, unknown or other
  misc_feature (218)..(218): n is a, c, g, or t
  modified_base (238)..(238): a, c, t, g, unknown or other
  misc_feature (238)..(238): n is a, c, g, or t
  modified_base (254)..(254): a, c, t, g, unknown or other
  misc_feature (254)..(254): n is a, c, g, or t
  modified_base (262)..(262): a, c, t, g, unknown or other
  misc_feature (262)..(262): n is a, c, g, or t
  modified_base (274)..(274): a, c, t, g, unknown or other
  misc_feature (274)..(274): n is a, c, g, or t
tcagcgagagataccacgaccggtgctcgatttagctacgactgcaagggaaaggggacccaaaaaccacacccctccttgggagaatcccctagatcatagctcctcaccatggactggacctggagtaatccttttcttggtggcagcagcaacaggtcgcccactcacgagggtcaactggtgcagtctggacctgaggtgaagagcgtgggctnagtgagtctcgtgtagcctnagttacacttcacgtntatgtacncactgctcgacncggccctggacaagcttggaggtgggtggagtggatcaactctacacgtgtaggaagcgaggacgttactagtcggaccggtaaggtacggtacgttcccggaaggggtaaccaacgggtcgtacccgaaaccccgttacgggaaaccccaaacgaacgggtaaacgaacctacccgtacccgaaacccggaacccaacgtacgttacccgtaaacgtaggtcgggtaacgtcggttacggtacgggaacgtccgttaagggggaccgttaacgaccggaacgtaccgacccggtaccttcttaaacgttcgtgtccggaccggaccgtcccgttacgacctacgacggtacaccccgttaaccgttccgaacggtccgtcccgggttaacccgtccgttacggggaccgggtaaccgttaaccggggtaaccccgg

SEQ ID NO: 300284 - DNA, 645 bp, Homo sapiens
  misc_feature: GZ8MTXP01EYIEO.11.72.G06.1.454.CMB.2.raw
  modified_base (241)..(241): a, c, t, g, unknown or other
  misc_feature (241)..(241): n is a, c, g, or t
  modified_base (308)..(308): a, c, t, g, unknown or other
  misc_feature (308)..(308): n is a, c, g, or t
  modified_base (311)..(311): a, c, t, g, unknown or other
  misc_feature (311)..(311): n is a, c, g, or t
  modified_base (317)..(317): a, c, t, g, unknown or other
  misc_feature (317)..(317): n is a, c, g, or t
  modified_base (326)..(326): a, c, t, g, unknown or other
  misc_feature (326)..(326): n is a, c, g, or t
  modified_base (335)..(335): a, c, t, g, unknown or other
  misc_feature (335)..(335): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctggaggtgaagagcctggggcctcagtgaagtctcctgtaaggcctnaggttacaccttcaccgctaatggtatcacgtggcttgacgacggccctggacaggctggagtgggnggntggatnacgtctcanacgtggaancaagtgtctagtcgacggagagtacttaccggaagggtcaacggagtacccaacccgtggaaaccccagaacggaaacgaccgtactaccaaccggaaccacgacgtactaacgagtacgggatcgtagtagacgcccgtaggacgccgtaggaccctacgacccggtcccttaagttacttaccgtggtacgccgggtaacgtccccttacgtacccttacgacgtacccgaccacccgttacccgaacgttccggttaacggttcccggaccggttccggtaacccggggttaacccggtaacccggg

SEQ ID NO: 300285 - DNA, 680 bp, Homo sapiens
  misc_feature: GZ8MTXP01A1BHJ.11.72.G06.1.454.CMB.2.raw
  modified_base (265)..(265): a, c, t, g, unknown or other
  misc_feature (265)..(265): n is a, c, g, or t
  modified_base (289)..(289): a, c, t, g, unknown or other
  misc_feature (289)..(289): n is a, c, g, or t
  modified_base (317)..(317): a, c, t, g, unknown or other
  misc_feature (317)..(317): n is a, c, g, or t
  modified_base (348)..(348): a, c, t, g, unknown or other
  misc_feature (348)..(348): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcattcctttttcttggtggcagcagcaacaggtgcccactcacagggtcaactggtgcagtctggacctgaggtgaagagccgtggggcctcagtgaaggtctcctgtaacggcctacaggttacaccttcaccgtntaatggtatcaccgtggctcgacncggcccctggacaggcttggaggtgggnggatggatcaactctacactacgtaggaacncgagtgtctagtcggacggagacgtacgtccgaaggggtacaagtacgtacccaacccgtcgaacccacgacggaacaccactaccccgaacgacccaacgtacgtacctaacgtagtcgggacgtccgtaggtacggcgtaccggtggaacgtccgtacggaccaaccggacccggtcccttactaagttccgtggtacgcccggtaacggtcccttactaccccgttaacgtaacggtcccgttaaccccttacgttccccgtaaccggtcgtttcccgggttacccgcccgggttaccggttaaccgggggaaccccgtaacccggggg

SEQ ID NO: 300286 - DNA, 683 bp, Homo sapiens
  misc_feature: GZ8MTXP01B6L2R.11.72.G06.1.454.CMB.2.raw
  modified_base (218)..(218): a, c, t, g, unknown or other
  misc_feature (218)..(218): n is a, c, g, or t
  modified_base (262)..(262): a, c, t, g, unknown or other
  misc_feature (262)..(262): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcattccttttcttggtggcagcagcaacaggtgcccactcacagggtcaactggtgcagtctggacctgaggtgaagagccgtgggcctnagtgaggtctccgtgtaacggcctgaggttaccaccttcaccgntaatgtatcacgtgctcgacacgccctggacaggcttggaggtggggtggagtggactacgaactctacacagtggaagcgagagtctagtcggacggagtagtacgttaccggaaagggcaaggacgtacccgaaccccgtacgaacccaacgaacggaacaccacgtaacccgaaccgaaccaaccgtaacgtaactaacccgtaagttacgggacgtcgtacggtacgggtacgaccggtaggaaccggtacccgtacggaaacccggaccgtacccggtcccttaacgttacgttacgtcgttaccggacggtaaccggtaccccttaacgtcccttacgtaacgtccgaacccttccttacccgaacgtccgttcggtacccgcgttccgggaaccgggttaacccgtaacccggg

SEQ ID NO: 300287 - DNA, 728 bp, Homo sapiens
  misc_feature: GZ8MTXP01EGY5N.11.72.G06.1.454.CMB.2.raw
  modified_base (218)..(218): a, c, t, g, unknown or other
  misc_feature (218)..(218): n is a, c, g, or t
  modified_base (305)..(305): a, c, t, g, unknown or other
  misc_feature (305)..(305): n is a, c, g, or t
  modified_base (309)..(309): a, c, t, g, unknown or other
  misc_feature (309)..(309): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccatcacagggtcaactggtgcagtctgggacctgaggtgaagagccgtggggcctnagtgaggtctcctgtaacggcctcagttacaccttcacgtctaatggatccactggcttcgacaggccctggacaggctgagtgggngganggatcgaactcgtacacacgtggaaacgctagagtcctagtcgaccgggtaagagtattcccggaaagggggaccaaggggtaacttacccaccccgtaggaaacccaacggtacgaaacgacctaacgtaccccaaaccggtaacccgtaacacgggttaaaccccttaaagacggtttagggaacgtccgttgggagggtaccggtacccgttaggggaaccgttacccggacggaacccgggaccctaaccgggtcccctttaacttaaacgtttcccgttgggtaccgtcccgggaaccggttccccttaaggtacccccttagtaaaccgggttccaacccttccgttacccgcgtaccggttccggggtcctaaccccgttccgggttaacgggttcccggtaaaccccgggg

SEQ ID NO: 300288 - DNA, 657 bp, Homo sapiens
  misc_feature: GZ8MTXP01DRJMG.11.72.G06.1.454.CMB.2.raw
  modified_base (261)..(261): a, c, t, g, unknown or other
  misc_feature (261)..(261): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagccgtggggcctcagtgaaggtctcctgtaacggcctcaggttacaccttcacgtntaatggtatcacgtggcttcgacacggccctggaacaaggtcttggagtgggtggatggatcaactctcacgacgtaggaagcaagtacgtctagtcggacggagagtacgttcccgaaaggggacaaggacgtacccaacccgtagaaccccagacggaacgaccacgtacccaacgaccacgacgtactacgagtaggacgtcgtggtacggacgtccgtaggacgtaacccgtggaacccgaccgtacccggtcccttaacgttacttaccgtggtcgtccggaacggtccccttactacccttacgtacggttccgaacccttaccgttcccgtaacgtccgtttcgggttacccgacccgttcgggtccgggggaacccgtaacccggggg

SEQ ID NO: 300289 - DNA, 648 bp, Homo sapiens
  misc_feature: GZ8MTXP01C4WFB.11.72.G06.1.454.CMB.2.raw
  modified_base (244)..(244): a, c, t, g, unknown or other
  misc_feature (244)..(244): n is a, c, g, or t
  modified_base (312)..(312): a, c, t, g, unknown or other
  misc_feature (312)..(312): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctggaggtgaagagccgtggggcctcagtgaaggtctccgtgtaaggcctnaggttaccaccttcaccgctaatggtatcactgctcgacacggccctggacaaggcttggagtggggnggatggatcgaactctacactacgtaggaacgcagagtctagtcggacggagagtacgtccggaaagggcaaggacgtacccacccgtaggaccccaacacggaacgacccaacgtacccgaaaccgaccaacgtaacgtactaacgagtacgggacgcgttaggtacgggaccggtccgtaggaaccgtaaccgtcggaaccgtacccgacccgtacccgttacttacgttaccgtcggtcgaccggtaacggtccccttagttacccaacgtacgtccgacccgcttacccgcgtcgtcggttccaccgttcgggtccgggaacccgtaacggg

SEQ ID NO: 300290 - DNA, 637 bp, Homo sapiens
  misc_feature: GZ8MTXP01AZ9IU.11.72.G06.1.454.CMB.2.raw
  modified_base (218)..(218): a, c, t, g, unknown or other
  misc_feature (218)..(218): n is a, c, g, or t
  modified_base (349)..(349): a, c, t, g, unknown or other
  misc_feature (349)..(349): n is a, c, g, or t
  modified_base (390)..(390): a, c, t, g, unknown or other
  misc_feature (390)..(390): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagccgtggggcctnagtgaaggtctcctgtaaggcctcaggttacaccttcaccgctaatgtactcacctggtcttcgacacggcccctaggaacaggcttggaggtggggtggataggatctaactctacacacgtggaagtcngtaagtctagtcggcggagacgtacgtcccgaaaggggtcngacggtaccctaccgacgacccaacgagaacgaccctacacccaacgaccactacgtactaccgagtcgggagtccgtggtacgcgtaccgggtgaaccggtccgtaacggacccgaccgcccggttaccttacgttaacgtacgtcgacggccggaaccgtcccttacgtacccttacgaacgtcccgaaccgccttccgaacggtcgttcgtacccgccggttcggtcggggcccgtaaccgggg

SEQ ID NO: 300291 - DNA, 699 bp, Homo sapiens
  misc_feature: GZ8MTXP01AOKLH.11.72.G06.1.454.CMB.2.raw
  modified_base (259)..(259): a, c, t, g, unknown or other
  misc_feature (259)..(259): n is a, c, g, or t
  modified_base (330)..(330): a, c, t, g, unknown or other
  misc_feature (330)..(330): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagcctggggcctcagtgaaggtctccgtgtaaggcctcaggttacaccttcacgntaatgtatcactggcttcgactaggccctggacagctgagtggtggatggatcaactctcacactaggaancagacgtctatcggacggagagacgttcccgaaggggtcaaggtacggtcccacccgtacgacccaacgtagaacgactactacccgaacgaccacgacgtacctaacgagtcgggacgtcgttagggtacggtacgtacccgggttagggaacgtaaccccgttacgggaaacccgtaacccggaacccgggtacccctttacgttaaccgtttaaccggttcggttaccggacccgggtaaccggtccccttaaacgttaccccgttaacgtaccgggtaccgaccccttacgttcccgtaacccgggtcggttaacccggttaccggtacccggttccgggcccgggttaaccggtaaccccgggg

SEQ ID NO: 300292 - DNA, 527 bp, Homo sapiens
  misc_feature: GZ8MTXP01AJM52.11.72.G06.1.454.CMB.2.raw
  modified_base (217)..(217): a, c, t, g, unknown or other
  misc_feature (217)..(217): n is a, c, g, or t
  modified_base (254)..(254): a, c, t, g, unknown or other
  misc_feature (254)..(254): n is a, c, g, or t
  modified_base (259)..(259): a, c, t, g, unknown or other
  misc_feature (259)..(259): n is a, c, g, or t
  modified_base (306)..(306): a, c, t, g, unknown or other
  misc_feature (306)..(306): n is a, c, g, or t
  modified_base (315)..(315): a, c, t, g, unknown or other
  misc_feature (315)..(315): n is a, c, g, or t
  modified_base (319)..(319): a, c, t, g, unknown or other
  misc_feature (319)..(319): n is a, c, g, or t
  modified_base (327)..(327): a, c, t, g, unknown or other
  misc_feature (327)..(327): n is a, c, g, or t
  modified_base (338)..(338): a, c, t, g, unknown or other
  misc_feature (338)..(338): n is a, c, g, or t
  modified_base (340)..(340): a, c, t, g, unknown or other
  misc_feature (340)..(340): n is a, c, g, or t
  modified_base (343)..(343): a, c, t, g, unknown or other
  misc_feature (343)..(343): n is a, c, g, or t
  modified_base (360)..(360): a, c, t, g, unknown or other
  misc_feature (360)..(360): n is a, c, g, or t
  modified_base (368)..(368): a, c, t, g, unknown or other
  misc_feature (368)..(368): n is a, c, g, or t
  modified_base (393)..(393): a, c, t, g, unknown or other
  misc_feature (393)..(393): n is a, c, g, or t
  modified_base (397)..(397): a, c, t, g, unknown or other
  misc_feature (397)..(397): n is a, c, g, or t
  modified_base (399)..(399): a, c, t, g, unknown or other
  misc_feature (399)..(399): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagcctggggcctnagtgaaggtctcctgtaaggcctcaggttacaccttnaccgntaatggatcacctggcttcgacaggccctggacaaggcttgagtggnggatggatnaacnctcacacngaagcagagtnancgngagagactcgaacgcgngagcaccncgacacagagacacacacgacacanacanangagcgtgtgacgcgtagagaccgacgacgacgaccgacctactactactgtcgcgaacgaccttactacttacgtacgtacgaccgccaccgaacgcgtcggtcgtaccgttcgtcgggccggaacgg

SEQ ID NO: 300293 - DNA, 643 bp, Homo sapiens
  misc_feature: GZ8MTXP01BPUZC.11.72.G06.1.454.CMB.2.raw
  modified_base (216)..(216): a, c, t, g, unknown or other
  misc_feature (216)..(216): n is a, c, g, or t
  modified_base (250)..(250): a, c, t, g, unknown or other
  misc_feature (250)..(250): n is a, c, g, or t
  modified_base (271)..(271): a, c, t, g, unknown or other
  misc_feature (271)..(271): n is a, c, g, or t
  modified_base (297)..(297): a, c, t, g, unknown or other
  misc_feature (297)..(297): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagcctgggcctnagtgaagtctctgtagctcagtacaccttcacgntaatgtatcactgcttcgacncgccctggacaaggtctggagtgggnggatggatcaactctacacacgtaggaagcgaagtacgtactagtcggacgggagtacgtacgttcccggaaaggggaccaagggtaccgtacccgtaccccgtacgaaccccaacgaaagaaccgaccacgtacccgaaccgaaccacacgtacctacgagtggacgcgtagacggacgtccgtaggacgtaccgacgaccgaccgaccggtcccttacttaagtcctggtacccgcggtaaccggtcccttacgtcccttacgacgttaccaacccgttcgttacccgtaacgtccgtttcggtccccgaccggttccggtaacggggaacccgtaacccgggg

SEQ ID NO: 300294 - DNA, 680 bp, Homo sapiens
  misc_feature: GZ8MTXP01AP431.11.72.G06.1.454.CMB.2.raw
  modified_base (372)..(372): a, c, t, g, unknown or other
  misc_feature (372)..(372): n is a, c, g, or t
  modified_base (594)..(594): a, c, t, g, unknown or other
  misc_feature (594)..(594): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcattccttttcttggtggcagcagcaacaggtgcccactcacgagggtcaactggtgcagtctggacctggaggtgaagaagccgtggggcctcgagtgaaggtctccgtagtaacggcctcgtaggttaccaccttcgaccgactaagtggtatccaccgtggtcttcgacgacggcccctggaacgaaggtcttggacggtgggtaggagtggatcgaactctcgacacgtaggacgcgagngtactagtcggacggagtacgacgttacgaacgggcaaggacgtacccgaccctacggaacccacgaagacgtacacgtaccccaaacgacccaacgtacgtacctaacgtagtacgggacgtcgtaggtacggaacgtccggtacggaaccgaccgtcggaaccgacccggaccggtaccctagttaacgttccgtagtccggaaccgaacggtacccttntaccccgttagaccggtacacccgttcttacccgtaacgtcgttcggtacccgtaccgttcgggtaaccgggcccggtaacccggg

SEQ ID NO: 300295 - DNA, 694 bp, Homo sapiens
  misc_feature: GZ8MTXP01EFP0G.11.72.G06.1.454.CMB.2.raw
  modified_base (235)..(235): a, c, t, g, unknown or other
  misc_feature (235)..(235): n is a, c, g, or t
  modified_base (269)..(269): a, c, t, g, unknown or other
  misc_feature (269)..(269): n is a, c, g, or t
  modified_base (292)..(292): a, c, t, g, unknown or other
  misc_feature (292)..(292): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagcgtgggcctcagtgagtctctgtacgctnagttacacctcacgctatgtatcactgctcgacncgccctgacaggtctgagtgggnggatggatcaactctacacgacgtaggaagcgaagtagtacgtagtaccgggaccgggtaaggagtacggttacccggaaaggggtaccaagggtaccgtacccgaaccccgtacgaacccaacggagacgaacacgtacccaaccggaaccaccgaacgttaccgactagtcgggacgtccgtagggtacggaccgtaccgtacggaacgacctacgggaacccgtaaccgcccgttcccttaacgttaacgtttaccggtgttacgggacccgtaaccggtacccctttagtaccccgttaacgtaccgttaaccgaccccgttcgttaccccgtaacggtccgtaaccgggtttacccgccgttaccggggtcccggggttaaccccggtaacccgggg

SEQ ID NO: 300296 - DNA, 615 bp, Homo sapiens
  misc_feature: GZ8MTXP01CM7XF.11.72.G06.1.454.CMB.2.raw
  modified_base (218)..(218): a, c, t, g, unknown or other
  misc_feature (218)..(218): n is a, c, g, or t
  modified_base (241)..(241): a, c, t, g, unknown or other
  misc_feature (241)..(241): n is a, c, g, or t
  modified_base (254)..(254): a, c, t, g, unknown or other
  misc_feature (254)..(254): n is a, c, g, or t
  modified_base (279)..(279): a, c, t, g, unknown or other
  misc_feature (279)..(279): n is a, c, g, or t
  modified_base (353)..(353): a, c, t, g, unknown or other
  misc_feature (353)..(353): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagccgtggggcctnagtgaaggtctcctgtaagcctnaggttacaccttnacgctaatgtatcactggctcgacnggcccctgacaggctgagtgggtggatggatcaactcacacacgtaggaacgctagagtctagtcggacggagngtacgttcccgaaaggggcaaggtacgtaccgaccctaggacccacgtagacgactacgacccacggaccacgacgtactacgagtcggagcgtaggtggacgcggtagaacggtacctggaaccgaccgacccggtccttacgtacttacgtcggtacgccgggtaaccgtcccttaggtccccttagaccgttcgacccgttcttacccgaacggtcgttccggtaccgtccttaccgggccgggttccggtaacccggg

SEQ ID NO: 300297 - DNA, 661 bp, Homo sapiens
  misc_feature: GZ8MTXP01EIHXA.11.72.G06.1.454.CMB.2.raw
  modified_base (218)..(218): a, c, t, g, unknown or other
  misc_feature (218)..(218): n is a, c, g, or t
  modified_base (259)..(259): a, c, t, g, unknown or other
  misc_feature (259)..(259): n is a, c, g, or t
  modified_base (343)..(343): a, c, t, g, unknown or other
  misc_feature (343)..(343): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcattccttttcttggtggcagcagcaacaggtgcccactcacagggtcaactggtgcagtctggacctgaggtgaagagccgtgggcctnagtgaaggtctcctgtaaggcctcagttacaccttcaccgntaatggtatcacgtggcttcgacacggcccctggaacaggacttgaggtgggtggatggatcaacgtctacacacgtagggaancaagagtctaagtcggcggaagagtacttacccggaaggggacaaggaccgttaccaaccccgtagaacccacgagacgaccagtacccaaccgaccacagttactaacgagtcggagcgtgtacggacgccgggttagacgtacccgtacggaaacgtacccgaccggtacccttacttaacgttaccgtgtacgccggtaacgtcccttagtcccgttaagaccggtaccgttaaccccgcttaccccggtaacggtccgttaaccgggttcccgacccgttacgggttaacccgggggaacccgtaacccggggg

SEQ ID NO: 300298 - DNA, 646 bp, Homo sapiens
  misc_feature: GZ8MTXP01CI913.11.72.G06.1.454.CMB.2.raw
  modified_base (240)..(240): a, c, t, g, unknown or other
  misc_feature (240)..(240): n is a, c, g, or t
  modified_base (278)..(278): a, c, t, g, unknown or other
  misc_feature (278)..(278): n is a, c, g, or t
  modified_base (303)..(303): a, c, t, g, unknown or other
  misc_feature (303)..(303): n is a, c, g, or t
  modified_base (422)..(422): a, c, t, g, unknown or other
  misc_feature (422)..(422): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaagtctctgtaaggcctnagttacaccttcacgtctaatgtatcacgtgctcgacncggccctggacaggctggagtgggnggatggatcaactctcactacgtaggaagcagagtctagtcggacggagagtacttcccggaaaggggcaaggaccgtaccacccgtagaccccagagacgacactacccacgaccacncgtactacgagtggagtcgtaggtcgacggtccgtaggaacgacccgtggaacccgacccgtccggtccccttagttacgtttaccgtcggtcgcccgaacggttccccttaacggtccccttaagaacccggttcaaccccgttcccgttacccggtaacccggtcgttccgggttacccgaacccgtttcggggaacccgggggttcccgtaaaccccgggg

SEQ ID NO: 300299 - DNA, 803 bp, Homo sapiens
  misc_feature: GZ8MTXP01AESJJ.11.72.G06.1.454.CMB.2.raw
  modified_base (254)..(254): a, c, t, g, unknown or other
  misc_feature (254)..(254): n is a, c, g, or t
  modified_base (326)..(326): a, c, t, g, unknown or other
  misc_feature (326)..(326): n is a, c, g, or t
  modified_base (359)..(359): a, c, t, g, unknown or other
  misc_feature (359)..(359): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacgagggtcaactggtgcagtcgtggacctgaggtgaagagcgtgggcctgagtgaaggtctcgtagtaacggcctacgaggttacnccttcgaccgtcttaagtggtatccacgtggcttcgacacggtccctaggaacaggtacttggacggtgggngggatggtacacaactctacgacagtaggaacncgagtagtctagcggtacggaagtagtacgttcccggaaagggacaacggtcgtaccccgtaaacccgtacgaaccaacgaacgggaacaacccgtactacccccgaacgaaaccccaacgttaacgggtttacccaaacgtaaccggttaggggaaccgtccgggttaggtaaaccgggtccgtaaccgggttcggggaaacccggtacccgttcgggaaaccccggtacccggtacccggttaccccttaaacggtttacgttacccgggtaaggttcccgggaccgggtaacccggttccccttaacgggtaacccctttaaacggaccgttaacccggttaaccccaccgttccccggtaaacccgggttccgtttaaccggggttaccccaccgggtttccgggggaacccgggggttaacccgtttaaccccgggggg

SEQ ID NO: 300300 - DNA, 639 bp, Homo sapiens
  misc_feature: GZ8MTXP01DO170.11.72.G06.1.454.CMB.2.raw
  modified_base (218)..(218): a, c, t, g, unknown or other
  misc_feature (218)..(218): n is a, c, g, or t
  modified_base (236)..(236): a, c, t, g, unknown or other
  misc_feature (236)..(236): n is a, c, g, or t
  modified_base (253)..(253): a, c, t, g, unknown or other
  misc_feature (253)..(253): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcattcctttttcttggtggcagcagcaacaggtgcccactcacagggtcaactggtgcagtctggacctgaggtgaagagccgtgggctnagtgagtctctgtagctnagttacaccttcaccgntaatgtatcacgtggcttcgacacggcccctggaacaaggacttggaggtggggtgggatggatacgaactctcacgacgtaggaagcagtagtctagtcggacggagacgtacttcccggaaagggcaaggacgtcccgaaaccccgtcggaacccacgaacggaacgaccactaccccaacgacccaactacgtactaacagtagggacgcgtggtggacgccgtagacgtaccgtagaccgaccgacccggtccctacgttaacttacgtggtcgccggtaacggtcccttacgtcccttacgtaacggtccaacccgttccgttacccgaacgtccgttcggttcccgacgttccggtccggggttaacccggtaacccggg

SEQ ID NO: 300301 - DNA, 675 bp, Homo sapiens
  misc_feature: GZ8MTXP01ASDS1.11.72.G06.1.454.CMB.2.raw
  modified_base (232)..(232): a, c, t, g, unknown or other
  misc_feature (232)..(232): n is a, c, g, or t
  modified_base (250)..(250): a, c, t, g, unknown or other
  misc_feature (250)..(250): n is a, c, g, or t
  modified_base (638)..(638): a, c, t, g, unknown or other
  misc_feature (638)..(638): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatcctttctggtggcagcagcaacaggtgcccatcacagggtcaactggtgcagtctggacctgagtgaagagcctgggcctcagtgaggtctctgtaagctnaggttacaccttcaccgntaatggtatcactgcttcgacaggcccctggacaaggcttggagtgggtggatggatacaactctacactacgtaggagcagtacgtctagtcggcggagacgtacgttacccgaaggggtccaaggacttcccgaacccctaggaacccgaagacggaacgaacctactaccccgaaccggtacccaacgtacgtaccttaacgaacgttcgggaagtccgtgggtacgggacgtaccgggtagtaaccggtaacccgtacggaacccgaaccgtacccgggtacccttacggttattaccgtcgtcggacgtaacggacccttctacccgttagaccgtcgttaccccttacgttccccgtaaccggtcgtttaacgggttacccncccggttaccggttccggggcccgttaaaccccgggg

SEQ ID NO: 300302 - DNA, 605 bp, Homo sapiens
  misc_feature: GZ8MTXP01AOL5L.11.72.G06.1.454.CMB.2.raw
  modified_base (240)..(240): a, c, t, g, unknown or other
  misc_feature (240)..(240): n is a, c, g, or t
  modified_base (256)..(256): a, c, t, g, unknown or other
  misc_feature (256)..(256): n is a, c, g, or t
  modified_base (275)..(275): a, c, t, g, unknown or other
  misc_feature (275)..(275): n is a, c, g, or t
  modified_base (281)..(281): a, c, t, g, unknown or other
  misc_feature (281)..(281): n is a, c, g, or t
  modified_base (290)..(290): a, c, t, g, unknown or other
  misc_feature (290)..(290): n is a, c, g, or t
  modified_base (295)..(295): a, c, t, g, unknown or other
  misc_feature (295)..(295): n is a, c, g, or t
  modified_base (297)..(297): a, c, t, g, unknown or other
  misc_feature (297)..(297): n is a, c, g, or t
  modified_base (308)..(308): a, c, t, g, unknown or other
  misc_feature (308)..(308): n is a, c, g, or t
  modified_base (312)..(312): a, c, t, g, unknown or other
  misc_feature (312)..(312): n is a, c, g, or t
  modified_base (318)..(318): a, c, t, g, unknown or other
  misc_feature (318)..(318): n is a, c, g, or t
  modified_base (330)..(330): a, c, t, g, unknown or other
  misc_feature (330)..(330): n is a, c, g, or t
  modified_base (347)..(347): a, c, t, g, unknown or other
  misc_feature (347)..(347): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcattccttttcttggtggcagcagcaacaggtgcccactcacagggtcaactggtgcagtctggacctgaggtgaagagccgtggggcctcagtgagtctctgtaacgcctnagttacaccttcacgntatgtatcactgctcgacncgcccngacagctgngtggngntggatcactcncacnctggancagtgtctgcgnggagagatcgaagggcncgagtccgaccctagacccagagacgacataccgacaccacgtagtacacgtgtcggagtcgtggtacgggacgtaccggtaggaaccggtaccgtacggaccgtacccgaccgggttacccttacttacgttaccgtggtccgtccggaacgttcccttacgtacccttaacgacggtccttaacccgcgttcccgaacggtcccgttcgggttcccggaccgtttcccgggaacggggttccccgtaacccggggg

SEQ ID NO: 300303 - DNA, 579 bp, Homo sapiens
  misc_feature: GZ8MTXP01ACCGE.11.72.G06.1.454.CMB.2.raw
  modified_base (213)..(213): a, c, t, g, unknown or other
  misc_feature (213)..(213): n is a, c, g, or t
  modified_base (230)..(230): a, c, t, g, unknown or other
  misc_feature (230)..(230): n is a, c, g, or t
  modified_base (235)..(235): a, c, t, g, unknown or other
  misc_feature (235)..(235): n is a, c, g, or t
  modified_base (239)..(239): a, c, t, g, unknown or other
  misc_feature (239)..(239): n is a, c, g, or t
  modified_base (241)..(241): a, c, t, g, unknown or other
  misc_feature (241)..(241): n is a, c, g, or t
  modified_base (248)..(248): a, c, t, g, unknown or other
  misc_feature (248)..(248): n is a, c, g, or t
  modified_base (409)..(409): a, c, t, g, unknown or other
  misc_feature (409)..(409): n is a, c, g, or t
  modified_base (436)..(436): a, c, t, g, unknown or other
  misc_feature (436)..(436): n is a, c, g, or t
tcagcgagagataccacgaccggtgctcgatttagctacgactgcaagggaaaggggacccaaaaaccacacccctacttgggagaatcccctagatcatagctcctcaccatggactggacctggagcatccttttcttggtggcagcagcaacaggtgcccactcacagggtcaactggtgcagtctggacctgagtgaagagctgggctnagtgagtctctgagctnagtcncctncntatgtancactggtcttcgacacgccctggacaaggtctggaggtcggggtggattcggatcgtaactcgtcacacgttggaacgcagagtactagtcggcggagacgtgtcccaaggggcaaggagtcccaccgtacggacaacgagactacacaccgacacccganacgtctacatggactcgttggaggacncgtagacgacctagaccgacgaccggtcctagttacttcggagtcgtcggaacgtcccttacgtccgttaccgaggttaccaccgttccacgtaacccgtgttaaccgggttcaccggttcgtaacggggcctaaccccgggg

SEQ ID NO: 300304 - DNA, 585 bp, Homo sapiens
  misc_feature: GZ8MTXP01BSBVC.11.72.G06.1.454.CMB.2.raw
  modified_base (265)..(265): a, c, t, g, unknown or other
  misc_feature (265)..(265): n is a, c, g, or t
  modified_base (311)..(311): a, c, t, g, unknown or other
  misc_feature (311)..(311): n is a, c, g, or t
  modified_base (362)..(362): a, c, t, g, unknown or other
  misc_feature (362)..(362): n is a, c, g, or t
  modified_base (395)..(395): a, c, t, g, unknown or other
  misc_feature (395)..(395): n is a, c, g, or t
  modified_base (401)..(401): a, c, t, g, unknown or other
  misc_feature (401)..(401): n is a, c, g, or t
  modified_base (411)..(411): a, c, t, g, unknown or other
  misc_feature (411)..(411): n is a, c, g, or t
  modified_base (448)..(448): a, c, t, g, unknown or other
  misc_feature (448)..(448): n is a, c, g, or t
  modified_base (536)..(536): a, c, t, g, unknown or other
  misc_feature (536)..(536): n is a, c, g, or t
  modified_base (545)..(545): a, c, t, g, unknown or other
  misc_feature (545)..(545): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcattccttttcttggtggcagcagcaacaggtgcccactcacagggtcaactggtgcagtctggacctggaggtgaagagccgtggggcctcagtgaaggtctcgtgtaaggcctacgagttaccaccttcaccgtntaatggtatccactggctcgacaggtcccctggacaaggcttaggnggtgggtggatggatactactctcgacacgtaggagcagtatcagtccggnggagagtactcgaaagggcaaggctccaccgtnaaccanagacgactanacccaacgaccacagtctaacgagtggagtcgtaggnggatcccgggtgaacgacctcgggaccaccgaccggtccttataacgttctagtcgacgtaaccgtccttatcccgagtacgtaaccncgttacccncgtaacgtcgtcgtcgacgttcggtaaccgggcgtaacgg

SEQ ID NO: 300305 - DNA, 696 bp, Homo sapiens
  misc_feature: GZ8MTXP01E0MBK.11.72.G06.1.454.CMB.2.raw
  modified_base (216)..(216): a, c, t, g, unknown or other
  misc_feature (216)..(216): n is a, c, g, or t
  modified_base (239)..(239): a, c, t, g, unknown or other
  misc_feature (239)..(239): n is a, c, g, or t
  modified_base (256)..(256): a, c, t, g, unknown or other
  misc_feature (256)..(256): n is a, c, g, or t
  modified_base (306)..(306): a, c, t, g, unknown or other
  misc_feature (306)..(306): n is a, c, g, or t
  modified_base (338)..(338): a, c, t, g, unknown or other
  misc_feature (338)..(338): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagcctgggcctnagtgaaggtctctgtaaggcctnagttacaccttcaccgntaatggtatcacgtgcttcgacacggcccctggacaaggcttgaggtggnggatggatacaactctcaacgacgtaggaacncgagtagtctagtcggacggagagtatccgaagggtacaaggacgtccacccgtagaacccagaacgagaacctactaccccgaacgaacccacgtaagtacccttaagacgtgggagtccgttgggacggacgacccggttagggaaccggtacccgtaggaaccgaaccccgtccggtaccccttacggttaactttaccgtgggtaccggccgtaacggtaccccttaactaccccgttaacgtaaccggttcccgaaacccttaccccgttcccgtaacccggtcgtttcccggggtttaccccgaacccggttccggggtaacccgggggttaaccccggttaaaccccgggg

SEQ ID NO: 300306 - DNA, 586 bp, Homo sapiens
  misc_feature: GZ8MTXP01BU2JJ.11.72.G06.1.454.CMB.2.raw
  modified_base (235)..(235): a, c, t, g, unknown or other
  misc_feature (235)..(235): n is a, c, g, or t
  modified_base (241)..(241): a, c, t, g, unknown or other
  misc_feature (241)..(241): n is a, c, g, or t
  modified_base (248)..(248): a, c, t, g, unknown or other
  misc_feature (248)..(248): n is a, c, g, or t
  modified_base (266)..(266): a, c, t, g, unknown or other
  misc_feature (266)..(266): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagccgtgggcctcagtgagtctctgtagctnagtacnctcacgntatgatcactgctcgacncgccctgacaggctggagtgggtggatggatcaactctacacgagtaggaacgcgagtagtctagtcggacgggatacggtacttcccggaaaggggctaaggactacccgacccgtacggaaccacgagaacgactacaccgaaccgaccgacagtacctacgagtggaacgtctagggtgacggccgtaggacgtaccgtaggaccgtccgacgtcccctatacgtacgtgtacgcgaaccgtcccttatccccttaagtacgccacccgccttccgaacggttctaacggtccacgttcggtcgggcccgtaacggg

SEQ ID NO: 300307 - DNA, 718 bp, Homo sapiens
  misc_feature: GZ8MTXP01ENM35.11.72.G06.1.454.CMB.2.raw
  modified_base (223)..(223): a, c, t, g, unknown or other
  misc_feature (223)..(223): n is a, c, g, or t
  modified_base (244)..(244): a, c, t, g, unknown or other
  misc_feature (244)..(244): n is a, c, g, or t
  modified_base (256)..(256): a, c, t, g, unknown or other
  misc_feature (256)..(256): n is a, c, g, or t
  modified_base (332)..(332): a, c, t, g, unknown or other
  misc_feature (332)..(332): n is a, c, g, or t
tcagcgagagataccacgaccggtgctcgatttagctacgactgcaagggaaagggacccaaaaaccacacccctccttgggagaatcccctagatcatagctcctcaccatggactggacctggagcattcctttttcttggtggcagcagcaacaggtcgcccactcacgagggtcaacgtggtgcagtcgtggacctggaggtgaagagccgtgggcctnagtgagtctcgtagtacgctnagtcacttcacntatgatcacgtgctgcacggccctggacaggctggaggtgggtggatgatcaacgtctacacgtaccgtggaacgngtagtagttctaggtcgacgggtagagtactacggaacgggtactggacttacccgacccgtacgaaccaacggacggaacacctaaccgaccccgacgtaaccacgaaccgtttacgaaccgtaggtacgggaacgtcggttagggacggaacccggttcgtaggaaaccggttaccggaacgggacccgtaaccgggcccgttacccgtttacgtaacgtttaccggttcggaccgggttaccgggtaaccgttaccccgtttacgtaacccggtttaacgacgggttaacccgacccttaccgttaaccggtccccggttagtttaacccgggttcccgtacccgggtttcgggaacccgggggttaaccccgtaacccgggg

SEQ ID NO: 300308 - DNA, 584 bp, Homo sapiens
  misc_feature: GZ8MTXP01DLP5P.11.72.G06.1.454.CMB.2.raw
  modified_base (217)..(217): a, c, t, g, unknown or other
  misc_feature (217)..(217): n is a, c, g, or t
  modified_base (236)..(236): a, c, t, g, unknown or other
  misc_feature (236)..(236): n is a, c, g, or t
  modified_base (252)..(252): a, c, t, g, unknown or other
  misc_feature (252)..(252): n is a, c, g, or t
  modified_base (298)..(298): a, c, t, g, unknown or other
  misc_feature (298)..(298): n is a, c, g, or t
  modified_base (426)..(426): a, c, t, g, unknown or other
  misc_feature (426)..(426): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagccgtgggcctnagtgagtctctgtagcctnagtacaccttcacgtntatgtatcactggctcgacacggccctgacaggcttggaggtgggnggatggatcaactctcaactacgtaggaagcagagtctagtcggacggagagacgttaccgaagggcaaggacgtcccacccgtagacccagagacgacactcccaacgaccacagtacacagtggancgtgacgcgcgtagacgaccgtacgaccgaccgaccggtcctagtacttcgtgtcgcggtaaccgtcccttacgtcccgttagtcgtaccgacccttccgttcccgaacggtcgttcggtacccgaccggttccggaaccggggcccgtaacccgggg

SEQ ID NO: 300309 - DNA, 672 bp, Homo sapiens
  misc_feature: GZ8MTXP01A6YHM.11.72.G06.1.454.CMB.2.raw
  modified_base (218)..(218): a, c, t, g, unknown or other
  misc_feature (218)..(218): n is a, c, g, or t
  modified_base (237)..(237): a, c, t, g, unknown or other
  misc_feature (237)..(237): n is a, c, g, or t
  modified_base (602)..(602): a, c, t, g, unknown or other
  misc_feature (602)..(602): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaacgtggtgcagtctggacctgaggtgaagagccgtgggcctnagtgagtctctgtagcctnagtacactcacgctatgtatcactggctcgacacggcccctggacaaggcttggaggtggggtggatggatccgaactcgtacacgacgtgggaacgcgaagagtctagtcggacgggaagagtactaccggaagggacaacggacgtacccacccgtacgaaccaacgacgaacgactacacccgaaacgaccacgtacgttaacctacgagtgggaacgtccgtgggtaacggacgtccggtaaggtaccggtaaccacgggaacccgacccgacccggttcccctttaaagttacgtttaccggtcgttaccgggccgtaaccggtaccccttataccccgttacgacgtaccggttacccncgttaccccgtaaggtccggttaaccgggtccctccggttacggggcccgggttaacccgtaacccgggg

SEQ ID NO: 300310 - DNA, 683 bp, Homo sapiens
  misc_feature: GZ8MTXP01AR6I5.11.72.G06.1.454.CMB.2.raw
  modified_base (214)..(214): a, c, t, g, unknown or other
  misc_feature (214)..(214): n is a, c, g, or t
  modified_base (232)..(232): a, c, t, g, unknown or other
  misc_feature (232)..(232): n is a, c, g, or t
  modified_base (243)..(243): a, c, t, g, unknown or other
  misc_feature (243)..(243): n is a, c, g, or t
  modified_base (288)..(288): a, c, t, g, unknown or other
  misc_feature (288)..(288): n is a, c, g, or t
  modified_base (314)..(314): a, c, t, g, unknown or other
  misc_feature (314)..(314): n is a, c, g, or t
  modified_base (318)..(318): a, c, t, g, unknown or other
  misc_feature (318)..(318): n is a, c, g, or t
  modified_base (334)..(334): a, c, t, g, unknown or other
  misc_feature (334)..(334): n is a, c, g, or t
tcagcgagagataccacgaccggtgctcgatttagctacgactgcaagggaaaggggacccaaaaaccacaccctcttgggagaatccctagatcatagctcctcaccatggactggacctggagcattccttttcttggtggcagcagcaacaggtgcccactcacagggtcaactggtgcagtctggacctgaggtgaagagcctgggcctnagtgagtctctgtagctnagtcactcacntaatgtatcactggctcgacacggccctggacaggctggagtggnggatggatcactctcacacgtggaancagngtactagcggacgganacgtattccgaaggggcaaggcgtccaacccgtgaacccgacgagtaacgacctacacccgaacgaacccacgtacggtacctaaccgaagttgggaacgtccgttgggtacgggaaccgtcccggttaagggaaccggaaccccgttacgggaaacccggttaacccgacccgggttacccctttaacggttacgttaaccggttcggttaccgggaccggtaaccgggtcccctttaaaggaccccttacggtaacggttacccgaaccccttacgaccccgtaaccggtcgttaaccgggttcccggacccgtttcgggtaaccgggggaacccgtaacccggggg

SEQ ID NO: 300311 - DNA, 676 bp, Homo sapiens
  misc_feature: GZ8MTXP01C3NE1.11.72.G06.1.454.CMB.2.raw
  modified_base (217)..(217): a, c, t, g, unknown or other
  misc_feature (217)..(217): n is a, c, g, or t
  modified_base (492)..(492): a, c, t, g, unknown or other
  misc_feature (492)..(492): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagccgtgggcctnagtgaggtctccgtgtaacggcctcagttacaccttcaccgctatggtatcactggctcgacacggccctggaacaaggtctggaggtgggtggagtggatcaactctacgactacgtaggaagcgagtagtctacgtcgacgggagacggtactacccggaaaggggcaacgggtactaacccgacccgtaccgaacccgaacgacgggaaccaacctaccgtaccccgaaaccgaacccaacgtaacgtacctaaacgacggttggaaccgtntaggggtacgaccggttacggcggtaacggaacccgtagggaacccgacccgtaccggttacccttagtacttcggtcgcggaccgtaaccgtcccttatcccttaaccgagtcccgacccttacttcccgaaccggttcgtccgggttaccgcccggttaggccgggggcccgtaacccgggg

SEQ ID NO: 300312 - DNA, 719 bp, Homo sapiens
  misc_feature: GZ8MTXP01DHZEZ.11.72.G06.1.454.CMB.2.raw
  modified_base (241)..(241): a, c, t, g, unknown or other
  misc_feature (241)..(241): n is a, c, g, or t
  modified_base (249)..(249): a, c, t, g, unknown or other
  misc_feature (249)..(249): n is a, c, g, or t
  modified_base (305)..(305): a, c, t, g, unknown or other
  misc_feature (305)..(305): n is a, c, g, or t
  modified_base (334)..(334): a, c, t, g, unknown or other
  misc_feature (334)..(334): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagccgtgggcctcgagtgaagtctcctgtaacgcctntagttacnccttcacgtctatgtatcactggctcgacgcgccctggacagcttgaggtggtggntggatcgaactctacacgtacgtaggacncgtagacgtctagtcggacggtagagtactccggaagggcaaggacgtcccgacccgtcgaacccaacgtacggaaacaccctaacgtaccccgaaaccggaaccctaacgtaacgttaacccgtaacgtaggttaacggggaacgtccgttagggacggtaccggtacggttacggaaccgtaacccgttacggaaccccgaacccgtacccgggttacccctttacgtttaaacgtttccgtacggtaccggtccgggtaacccgttccccttacgtacccttaaccggttacgtaccccgaacccttacccgttcccgtaaccggttcgtttaaccgggttcccgaccgggttccgggtccggggaaccccgttaaccgggg

SEQ ID NO: 300313 - DNA, 668 bp, Homo sapiens
  misc_feature: GZ8MTXP01AS256.11.72.G06.1.454.CMB.2.raw
  modified_base (237)..(237): a, c, t, g, unknown or other
  misc_feature (237)..(237): n is a, c, g, or t
  modified_base (274)..(274): a, c, t, g, unknown or other
  misc_feature (274)..(274): n is a, c, g, or t
  modified_base (303)..(303): a, c, t, g, unknown or other
  misc_feature (303)..(303): n is a, c, g, or t
  modified_base (376)..(376): a, c, t, g, unknown or other
  misc_feature (376)..(376): n is a, c, g, or t
  modified_base (384)..(384): a, c, t, g, unknown or other
  misc_feature (384)..(384): n is a, c, g, or t
  modified_base (393)..(393): a, c, t, g, unknown or other
  misc_feature (393)..(393): n is a, c, g, or t
tcagcgagagataccacgaccggtgctcgatttagctacgactgcaagggaaggggacccaaaaccacacccctccttgggagaatcccctagatcatagctcctcaccatggactggacctggagcatccttttcttggtggcagcagcaacaggtgcccactcacagggtcaactggtgcagtctggacctgaggtgaagagcctggggcctcagtgaggtctctgtaaggcctnaggttcacttcacgctaatggtatcactggcttgacnggcccctggacaggactgtcgtgtgctgntcgacgcgcacgactaggcgcagtagtcgtatcgcgagacgtatccggaagggcaaggtacaccgaccggtanaccccganacgggtaanaccttacgtaccgacgaacccaacgtaggtttaacccaacgtagtacggtacgtacgtacggtacggtacggtacgggtacggtaccggtaccgtaaccggtaccgtaccggtaccggtacccgttaccgttacgttaccgttacggtacggtacggtaaccggtaccgttaaccgtaccgttaccgtaacgtaaccgttaccgttaccgttaccgtaaccgtccggttccggttaccgtaccggttaccggtaaccgggttaaccggtaaccgg

SEQ ID NO: 300314 - DNA, 595 bp, Homo sapiens
  misc_feature: GZ8MTXP01CTCY8.11.72.G06.1.454.CMB.2.raw
  modified_base (217)..(217): a, c, t, g, unknown or other
  misc_feature (217)..(217): n is a, c, g, or t
  modified_base (235)..(235): a, c, t, g, unknown or other
  misc_feature (235)..(235): n is a, c, g, or t
  modified_base (250)..(250): a, c, t, g, unknown or other
  misc_feature (250)..(250): n is a, c, g, or t
  modified_base (271)..(271): a, c, t, g, unknown or other
  misc_feature (271)..(271): n is a, c, g, or t
  modified_base (497)..(497): a, c, t, g, unknown or other
  misc_feature (497)..(497): n is a, c, g, or t
  modified_base (503)..(503): a, c, t, g, unknown or other
  misc_feature (503)..(503): n is a, c, g, or t
  modified_base (515)..(515): a, c, t, g, unknown or other
  misc_feature (515)..(515): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacgagggtcaactggtgcagtctggactgaggtgaagagccgtgggcctnagtgagtctctagagctnagtacacttcacgtntatgtatcgactggctcgacncggccctggacaaggtcttggaggtgggtggatcggatcaactctacgactacgtgggaaatcaagtacgtctagtcggacggaagagtacgtccgaaagggcaagacgtaccaaccgtagaaccagagacgacactacccaacgaccacgaacgtactaacgagtggagcttggacggtacgccgtagacgtaccgtacgacgaccgtacggtcctactatacgngtacgngtaacgcccttntaccgagtacgtccaccgttcttacccgaacgtccgtcgggttacccgaccgttcgggtccggggaaccgtaacccgggg

SEQ ID NO: 300315 - DNA, 595 bp, Homo sapiens
  misc_feature: GZ8MTXP01EZF2I.11.72.G06.1.454.CMB.2.raw
  modified_base (243)..(243): a, c, t, g, unknown or other
  misc_feature (243)..(243): n is a, c, g, or t
  modified_base (261)..(261): a, c, t, g, unknown or other
  misc_feature (261)..(261): n is a, c, g, or t
  modified_base (335)..(335): a, c, t, g, unknown or other
  misc_feature (335)..(335): n is a, c, g, or t
  modified_base (367)..(367): a, c, t, g, unknown or other
  misc_feature (367)..(367): n is a, c, g, or t
  modified_base (410)..(410): a, c, t, g, unknown or other
  misc_feature (410)..(410): n is a, c, g, or t
  modified_base (418)..(418): a, c, t, g, unknown or other
  misc_feature (418)..(418): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaacggcctnaggttacaccttcaccgntaatggtatcactgcttcgacaggcccctggacaggacttgagtgggtggatggatcaactctcacactggaancagagtctagtcgcggagagatccgaagggcngacgtccaccctagaccacgagacgacactcccaacgaccacngtacctanagtggagcgtggacggagccgtgacgacctggaaccgacgacccggtcccttagttacttacgtcgtcggtcccgaacggtccccttatcccgttacgacgttccgaaccccttcttaccccgtaacggcgtttcgggtcccgtacccgttcgggtccggggcccgtaacccggggg

SEQ ID NO: 300316 - DNA, 695 bp, Homo sapiens
  misc_feature: GZ8MTXP01D2BEK.11.72.G06.1.454.CMB.2.raw
  modified_base (218)..(218): a, c, t, g, unknown or other
  misc_feature (218)..(218): n is a, c, g, or t
  modified_base (235)..(235): a, c, t, g, unknown or other
  misc_feature (235)..(235): n is a, c, g, or t
  modified_base (241)..(241): a, c, t, g, unknown or other
  misc_feature (241)..(241): n is a, c, g, or t
  modified_base (245)..(245): a, c, t, g, unknown or other
  misc_feature (245)..(245): n is a, c, g, or t
  modified_base (248)..(248): a, c, t, g, unknown or other
  misc_feature (248)..(248): n is a, c, g, or t
  modified_base (254)..(254): a, c, t, g, unknown or other
  misc_feature (254)..(254): n is a, c, g, or t
  modified_base (257)..(257): a, c, t, g, unknown or other
  misc_feature (257)..(257): n is a, c, g, or t
  modified_base (267)..(267): a, c, t, g, unknown or other
  misc_feature (267)..(267): n is a, c, g, or t
  modified_base (291)..(291): a, c, t, g, unknown or other
  misc_feature (291)..(291): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcattccttttcttggtggcagcagcaacaggtgcccactcacagggtcaactggtgcagtctggacctgaggtgaagagccgtgggcctnagtgagtctctgagctnagtacnctcncgntatgtntcnctgctcgacncgccctaggacagtctggagtggnggagtgatcaacgtcacgacacgtaggacgacgagtagtctagtcggtacggagagtacgttacggaaggggtccaagggtacctacccgaaacccgtcggtaaccccgaacggagaaacccgtacctaaccgtacccccggaaaccggaccccaacgttaaccggttaacctacggtacgtacgggacgttaccgtaggttacgggacggtaccgggtacgaacggtacccgttagggaacccgtaccggacccggttacccgttaacgttacgttaccggtgtacccgtaacggggtaaccttccccgttaggtacccttaaacggaccgtaacgaccccttcgttacccgtaacggtccgttccggtccgaccgttcgggtccgggaacccgtaaccgggg

SEQ ID NO: 300317 - DNA, 602 bp, Homo sapiens
  misc_feature: GZ8MTXP01EFZHX.11.72.G06.1.454.CMB.2.raw
  modified_base (236)..(236): a, c, t, g, unknown or other
  misc_feature (236)..(236): n is a, c, g, or t
  modified_base (242)..(242): a, c, t, g, unknown or other
  misc_feature (242)..(242): n is a, c, g, or t
  modified_base (250)..(250): a, c, t, g, unknown or other
  misc_feature (250)..(250): n is a, c, g, or t
  modified_base (268)..(268): a, c, t, g, unknown or other
  misc_feature (268)..(268): n is a, c, g, or t
  modified_base (295)..(295): a, c, t, g, unknown or other
  misc_feature (295)..(295): n is a, c, g, or t
  modified_base (540)..(540): a, c, t, g, unknown or other
  misc_feature (540)..(540): n is a, c, g, or t
  modified_base (556)..(556): a, c, t, g, unknown or other
  misc_feature (556)..(556): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagccgtgggcctgagtgagtctctgtagcctnagtacncttcacgntatgatcactgctcgacncggccctggacaaggtctgaggtgggnggatggatcaactctacgactacgtaggaacgcaggtacgtctagtcggacggaagagtacttaccggaagggacgaagacgtacccgacgaccgaacacgaggaccatacccgaccaacgacaacgttcgtaacgtacaggtacgaacgttcgtaggacggaccgtcgggtaagaccggttacacgggaccaacggtccctactacttacgtgttcggcgccgtaaccgtacccttcgtaaccngtaccgacttccgacnccgtaagccgttaacgtaccgcgttagggcccggttaacggtcccg

SEQ ID NO: 300318 - DNA, 521 bp, Homo sapiens
  misc_feature: GZ8MTXP02FP2KF.11.72.G06.1.454.CMB.2.raw
  modified_base (362)..(362): a, c, t, g, unknown or other
  misc_feature (362)..(362): n is a, c, g, or t
  modified_base (450)..(450): a, c, t, g, unknown or other
  misc_feature (450)..(450): n is a, c, g, or t
  modified_base (470)..(470): a, c, t, g, unknown or other
  misc_feature (470)..(470): n is a, c, g, or t
tcagcgagagataccacgaccggtgctcgatttagctacgactgcaagggaaagggacccaaaaccacacccctccttgggagaatcccctagatcatagctcctcaccatggactggacctggagcatccttttcttggtggcagcagcaacaggtgcccactcacagggtcaactggtgcagtctggacctgaggtgaagagcctggggcctcagtgaaggtctcctgtaaggcctcaggttacaccttcaccgctaatggtatcacctggcttcgacaggcccctggacaaggacttgagtgggtggatggatcaactctcacactggaagcagagtctatgcgagagattccaggacngatcaccctgaccacagagacatccacgaccacagtctacatggagctgtggacgcctgacgacctgacgacacggccctctattacngtgcgacggccctatcctanacgtcgaccactccaacgtctacggttcgacctcgtcggggccaaccgggg

SEQ ID NO: 300319 - DNA, 518 bp, Homo sapiens
  misc_feature: GZ8MTXP02F7PGT.11.72.G06.1.454.CMB.2.raw
  modified_base (364)..(364): a, c, t, g, unknown or other
  misc_feature (364)..(364): n is a, c, g, or t
  modified_base (409)..(409): a, c, t, g, unknown or other
  misc_feature (409)..(409): n is a, c, g, or t
  modified_base (443)..(443): a, c, t, g, unknown or other
  misc_feature (443)..(443): n is a, c, g, or t
  modified_base (449)..(449): a, c, t, g, unknown or other
  misc_feature (449)..(449): n is a, c, g, or t
  modified_base (469)..(469): a, c, t, g, unknown or other
  misc_feature (469)..(469): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctctgtaaggcctcaggttacaccttcaccgctaatggtatcacctggcttcgacaggcccctggacaaggactgagtgggtggatggatcaactctcacactggaagcagagtctatgcggagagattccagggcngagtcacctgaccacagagacatccacgaccacagtcacatgganactgtggagcctgagacctgacgacacggccctntatacngtgcgacggccctatcctanacgtcgaccacgtccaacgctcggttccacctcgtcggggccaacgggg

SEQ ID NO: 300320 - DNA, 525 bp, Homo sapiens
  misc_feature: GZ8MTXP02I59Z0.11.72.G06.1.454.CMB.2.raw
  modified_base (336)..(336): a, c, t, g, unknown or other
  misc_feature (336)..(336): n is a, c, g, or t
  modified_base (383)..(383): a, c, t, g, unknown or other
  misc_feature (383)..(383): n is a, c, g, or t
  modified_base (413)..(413): a, c, t, g, unknown or other
  misc_feature (413)..(413): n is a, c, g, or t
tcagcgagagataccacgaccggtgctcgatttagctacgactgcaagggaaagggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggacttgagtgggtggatggatcaactctcacactggaancagagtctatcgcggagagattccgaggacagagtcaccctgaccanagagacatccacgacacagtctacatgganctgtggagcctgagcctgacgacacggccctacgtattactgtcgcgacggccctatccgacacgtcgacccactccaacgctacggttcaccgtcgtcggggccaacgggg

SEQ ID NO: 300321 - DNA, 535 bp, Homo sapiens
  misc_feature: GZ8MTXP02J1P5H.11.72.G06.1.454.CMB.2.raw
  modified_base (365)..(365): a, c, t, g, unknown or other
  misc_feature (365)..(365): n is a, c, g, or t
  modified_base (413)..(413): a, c, t, g, unknown or other
  misc_feature (413)..(413): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggacttgagtgggtggatggatcaactctcacactggaagcagagtctatgcgagagattccagggcngagtcaccctgaccacagagacatcccacgaccacagtctacatggancgtgtggagcctgacgacctgacgacaccggccctctacttactgtcgcgacgggccctaatccctaacacgtcgacccactcccaacgcctcggttccgacctcgtcggggccaaccgggg

SEQ ID NO: 300322 - DNA, 585 bp, Homo sapiens
  misc_feature: GZ8MTXP02IUZDS.11.72.G06.1.454.CMB.2.raw
  modified_base (421)..(421): a, c, t, g, unknown or other
  misc_feature (421)..(421): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggacttgagtgggtggatggatcaactctcacactggaagcagagtctatgcggagagattccgaggggcaggacgtcaaccctgacccacagagacatcccacgaccacagtactacatggancgtgtggagcctgacgacctcggaccgaccgaccggccctacttaacttaccgtgtcgcggaacggtccccttatccccttaacacgttaccgaacccaccttacccgaaccgtccgttacgggttcccgacccgttccggtacgggggacccctaaccggggg

SEQ ID NO: 300323 - DNA, 543 bp, Homo sapiens
  misc_feature: GZ8MTXP02HZBFS.11.72.G06.1.454.CMB.2.raw
  modified_base (365)..(365): a, c, t, g, unknown or other
  misc_feature (365)..(365): n is a, c, g, or t
  modified_base (381)..(381): a, c, t, g, unknown or other
  misc_feature (381)..(381): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcactggcttcgacaggcccctggacaaggacttgagtgggtggatggatcaactctcacactggaagcagagtctatgcggagagattccagggcngagtcaccctgaccanagagacatccacgaccacacgtctacatggagctgtgagctgagacctagacgacgacggccctactattaccgtgtcgtcgacggcccttagtccctacgacgtcgacccactccaaccgtcgttcggttaccgaccctcggtcggggacccgaaccgggg

SEQ ID NO: 300324 - DNA, 524 bp, Homo sapiens
  misc_feature: GZ8MTXP02GWFWF.11.72.G06.1.454.CMB.2.raw
  modified_base (413)..(413): a, c, t, g, unknown or other
  misc_feature (413)..(413): n is a, c, g, or t
  modified_base (422)..(422): a, c, t, g, unknown or other
  misc_feature (422)..(422): n is a, c, g, or t
  modified_base (450)..(450): a, c, t, g, unknown or other
  misc_feature (450)..(450): n is a, c, g, or t
tcagcgagagataccacgaccggtgctcgatttagctacgactgcaagggaaaggggacccaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggcttgagtgggtggatggatcaactctcacactggaagcagagtctatgcggagagattccgagggcagacgtcaccctgaccacagagacatccacgaccacagtctacatgganactgtggancctgacgacctggacgaccacggccctntagttactgtgcgacgccctatcctacacgtcgaccactccaacgctcgttcgacctcgtcggggacctacggg

SEQ ID NO: 300325 - DNA, 540 bp, Homo sapiens
  misc_feature: GZ8MTXP02HAEVG.11.72.G06.1.454.CMB.2.raw
  modified_base (422)..(422): a, c, t, g, unknown or other
  misc_feature (422)..(422): n is a, c, g, or t
  modified_base (458)..(458): a, c, t, g, unknown or other
  misc_feature (458)..(458): n is a, c, g, or t
  modified_base (516)..(516): a, c, t, g, unknown or other
  misc_feature (516)..(516): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggcttgagtgggtggatggatcaactctcacacgtggaagcagagtctatcgcggagagattccgaggggcaggagtcaccctgacccacagagacatacccaacgaccacagtacacagtgganctgtggagcctgacgacctgacgaccgacggccctntacttactgtcgcgaacggccctatcctacacgtcaccactaccaacgctacggttcnccgttcgcggggacctaaccgggg

SEQ ID NO: 300326 - DNA, 544 bp, Homo sapiens
  misc_feature: GZ8MTXP02JZJSH.11.72.G06.1.454.CMB.2.raw
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggacttgagtgggtggatggatcaactctcacactggaagcagagtctatgcggagagattccgagggcagacgtcaccctgaccacagagacatccacgaccacagtctacatggagctggtggagccgtgacgacctggaccgacgaccgggccctctacttaccgtgtcgcgtacggcccctatccctacacgtcgacccactcccaacgcgtcggttcgaccttcgtacggggccaaccgggg

SEQ ID NO: 300327 - DNA, 536 bp, Homo sapiens
  misc_feature: GZ8MTXP02H38I0.11.72.G06.1.454.CMB.2.raw
  modified_base (367)..(367): a, c, t, g, unknown or other
  misc_feature (367)..(367): n is a, c, g, or t
  modified_base (385)..(385): a, c, t, g, unknown or other
  misc_feature (385)..(385): n is a, c, g, or t
  modified_base (418)..(418): a, c, t, g, unknown or other
  misc_feature (418)..(418): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggcttgagtgggtggatggatcaactctcacactggaagcagagtctatcgcggagagattccgagggcnggacgtcaccctgaccanagacgacatccacgaccacagtactacatgganctgtggagcctgacgacctgaccgacaccggcccttctattactgtgccggacggcccctatcctacacgtcgaccctactccaacgcttcggtccaccgtcgtcggggaccaacggg

SEQ ID NO: 300328 - DNA, 527 bp, Homo sapiens
  misc_feature: GZ8MTXP02FNHK4.11.72.G06.1.454.CMB.2.raw
  modified_base (366)..(366): a, c, t, g, unknown or other
  misc_feature (366)..(366): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggacttgagtgggtggatggatcaactctcacactggaagcagagtctatgcggagagattccagggcngagtcacctgaccacagagacatccacgaccacagtctacatggagctgtggagcctgagacctgacgacgacggccctgtactactgtgcgacggtccctagtcctacacgtcgaccactccaacgctcggttccgaccgtcgtcggggcctaaccgggg

SEQ ID NO: 300329 - DNA, 528 bp, Homo sapiens
  misc_feature: GZ8MTXP02F9M2N.11.72.G06.1.454.CMB.2.raw
  modified_base (366)..(366): a, c, t, g, unknown or other
  misc_feature (366)..(366): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggcttgagtgggtggatggatcaactctcacactggaagcagagtctatgcggagagattccgagggcngagtcacctgaccacagagacatccacgaccacagtctacatggagctgtggagcctagagacctgacgacacgcctctatctagtgcgacggtccctatcctacacgtcgacctactccaacgtcgtcggttaccgacctcgtcggggccctaaaccgggg

SEQ ID NO: 300330 - DNA, 559 bp, Homo sapiens
  misc_feature: GZ8MTXP02F046S.11.72.G06.1.454.CMB.2.raw
  modified_base (369)..(369): a, c, t, g, unknown or other
  misc_feature (369)..(369): n is a, c, g, or t
  modified_base (469)..(469): a, c, t, g, unknown or other
  misc_feature (469)..(469): n is a, c, g, or t
tcagcgagagataccacgaccggtgctcgatttagctacgactgcaagggaaaggggacccaaaaaccacacccctccttgggagaatcccctagatcatagctcctcaccatggactggacctggagaatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggacttggagtgggtggatgggatcaactctcacactggaagcagagtctatgccggagagatccaggcagngtcaccctgaccacagagacatacccacgaccacagtactacagtggagtcgtggtaggacgccgtgacgacctgaaccgacaaccggccctctattacngtgcgaggccctagtcctacgacgtacgaccctactcccacgccgtcggttaccgacccgtcggtcgggggtacccacggggtaaccccg

SEQ ID NO: 300331 - DNA, 534 bp, Homo sapiens
  misc_feature: GZ8MTXP02JIO3B.11.72.G06.1.454.CMB.2.raw
  modified_base (414)..(414): a, c, t, g, unknown or other
  misc_feature (414)..(414): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaggacttgagtgggtggatggatcaactctcacactggaagcagagtctatgcggagagattccgaggggcagagtcaccctgaccacagagacatccacgaccacagtctacatgganctgtggagccgtgacgacctggaccgacgacggccctctacttactgtcgcgacggccctagtccctacacgtcgaccactccaacgtctcggttccaccgtcgtacggggcctaacggg

SEQ ID NO: 300332 - DNA, 618 bp, Homo sapiens
  misc_feature: GZ8MTXP02GVBT5.11.72.G06.1.454.CMB.2.raw
  modified_base (240)..(240): a, c, t, g, unknown or other
  misc_feature (240)..(240): n is a, c, g, or t
  modified_base (320)..(320): a, c, t, g, unknown or other
  misc_feature (320)..(320): n is a, c, g, or t
  modified_base (407)..(407): a, c, t, g, unknown or other
  misc_feature (407)..(407): n is a, c, g, or t
  modified_base (414)..(414): a, c, t, g, unknown or other
  misc_feature (414)..(414): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctgggcctcagtgaaggtctctgtaaggcctnaggttacaccttcacgctaatggtatcactggctcgacaggccctgacaaggctgagtgggtggatggatcaactctcanactggaagcaagagtctagtgacggagagattccgagggcagacgtcacctgaccacagagacacaccacgaaccacagttacacanggaacgngtagagacgacgtagaacgaccgtacggaaccgaacccgtaaccggtcccttaacgtaacgttacgtcggtacggacggtaaccggtaccccttaacgtaccctaaaccgtaacgtaccgtaaccccgtaaccgtacccgaaccggttccgttaccggttacccgtacccggttccgggtaccgggggaacccggtaaaccggg

SEQ ID NO: 300333 - DNA, 588 bp, Homo sapiens
  misc_feature: GZ8MTXP02JR9PQ.11.72.G06.1.454.CMB.2.raw
  modified_base (367)..(367): a, c, t, g, unknown or other
  misc_feature (367)..(367): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggctcgacaggcccctggacaaggacttgagtgggtggatggatcaactctcacactggaagcagagtctatggcggagagattccgagggcngagtcacccgtgaccacagagacatcccacgaccacagtactacatggagctggtggacgtcctggacgacctaggaaccgaccgaccgggtaccctacgtacttaccgtgtacgccggacggtcccctacgtccctaacgacgtaccgaccctaccgtaccccgaaccgtccgttcgggttacccgtacccgtccggtacgggggacccctaaccggggg

SEQ ID NO: 300334 - DNA, 535 bp, Homo sapiens
  misc_feature: GZ8MTXP02GEOXE.11.72.G06.1.454.CMB.2.raw
  modified_base (501)..(501): a, c, t, g, unknown or other
  misc_feature (501)..(501): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggacttgagtgggtggatggatcaactctcacactggaagcagagtctagtcgcggagagattccgaggggcaggacgtcacccgtgacccacagacgacatcccacgaccacagtctacatggagcgtgtggagcctgacgacctgacgaccaccggccctactacttcgtgtcgcgacggtccctatcctacacgtcgaccnctccaacgcgtcgtcgacctcgcgggcgtaccgg

SEQ ID NO: 300335 - DNA, 620 bp, Homo sapiens
  misc_feature: GZ8MTXP02J258N.11.72.G06.1.454.CMB.2.raw
  modified_base (373)..(373): a, c, t, g, unknown or other
  misc_feature (373)..(373): n is a, c, g, or t
  modified_base (400)..(400): a, c, t, g, unknown or other
  misc_feature (400)..(400): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacacggcccctggacaaggacttgagtgggtggatggatcaactctcacactggaacgcagagtctatcggacggagagattccgaggggcngagtcaccctgaccacgagacgacacncccaacgaccacagtctacagtggacgctggtaggagccgtaggacgacctggaaccgaccgacccgggtacccctacttaacttacgtggtcgacggtaccggccccttaaatccccgttaaacacgggttaccgaacccctaaccgttcccgaaccggtccgttaccggggtttcccgtaacccgttccggttaccggggggacccctaaaccggggg

SEQ ID NO: 300336 - DNA, 521 bp, Homo sapiens
  misc_feature: GZ8MTXP02I8EQG.11.72.G06.1.454.CMB.2.raw
  modified_base (367)..(367): a, c, t, g, unknown or other
  misc_feature (367)..(367): n is a, c, g, or t
  modified_base (406)..(406): a, c, t, g, unknown or other
  misc_feature (406)..(406): n is a, c, g, or t
  modified_base (485)..(485): a, c, t, g, unknown or other
  misc_feature (485)..(485): n is a, c, g, or t
tcagcgagagataccacgaccggtgctcgatttagctacgactgcaagggaaaggggacccaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggacttgagtgggtggatgggatcaactctcacactggaagcagagtctatgcggagagattccgaggacngatcaccctgaccacagagacatccacgaccacagtacncatggagctgtaggagcctgagacctgacgacgacggcctctactaccgtgtcgcgacggcctatcctacagtcgaccnctccaacgcgtacgtcacctcgtcgggactaccggg

SEQ ID NO: 300337 - DNA, 524 bp, Homo sapiens
  misc_feature: GZ8MTXP02I05LP.11.72.G06.1.454.CMB.2.raw
  modified_base (382)..(382): a, c, t, g, unknown or other
  misc_feature (382)..(382): n is a, c, g, or t
  modified_base (412)..(412): a, c, t, g, unknown or other
  misc_feature (412)..(412): n is a, c, g, or t
  modified_base (436)..(436): a, c, t, g, unknown or other
  misc_feature (436)..(436): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagcctggggcctcagtgaaggtctcctgtaaggcctcaggttacaccttcaccgctaatggtatcacctgtcttcgacaggcccctggacaaggcttgagtgggtggatggatcaactctcacactggaagcagagtctatcgcggagagattcgagggcagagtcaccctgacccanagagacatccacgaccacagtctacatganctgtggagcctgagcctgacgacncggcctcgtattactgtcgcgacggcctatcctacacgtcgacctactccaacgctacggttccgacgttcgacggggtccaaccggg

SEQ ID NO: 300338 - DNA, 581 bp, Homo sapiens
  misc_feature: GZ8MTXP02HMHSC.11.72.G06.1.454.CMB.2.raw
  modified_base (242)..(242): a, c, t, g, unknown or other
  misc_feature (242)..(242): n is a, c, g, or t
  modified_base (338)..(338): a, c, t, g, unknown or other
  misc_feature (338)..(338): n is a, c, g, or t
  modified_base (370)..(370): a, c, t, g, unknown or other
  misc_feature (370)..(370): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctnaggttacaccttcaccgctaatggtatcactggcttcgacaggcccctggacaaggacttgagtgggtggatggatcgaactctcacacgtggaancgagagtctatgacggagagacttcgagggcngacgtcacccgtgaaccacagacgacatacccacgaccacagtactacatcggagctgtggacgcctgacgacctggaccgaccgaccggtccctcgtaacttacgtgtcgccggacggtcccctagtacccgtacgacgtcgaaccctacctcccgtaaccgcgtcgggttaccgacccgttcggtccgggggtacccgtaaacccgggg

SEQ ID NO: 300339 - DNA, 566 bp, Homo sapiens
  misc_feature: GZ8MTXP02F03LA.11.72.G06.1.454.CMB.2.raw
  modified_base (367)..(367): a, c, t, g, unknown or other
  misc_feature (367)..(367): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggcttgagtgggtggatggatcaactctcacactggaagcagagtctagtgcggagagattccgagggcngacgtcacctgaccacagagacatacccacgaccacagtactacatggagctgtggagcctggacgacctggaaccgaccgaccgggtccctacgttacttaccgtgtacgcggacggtcccctagtccctacacgttcgacccactacccgaacgtcttacggttccgaccctcggtacgggggacctaacccggggg

SEQ ID NO: 300340 - DNA, 572 bp, Homo sapiens
  misc_feature: GZ8MTXP02G6BY1.11.72.G06.1.454.CMB.2.raw
  modified_base (286)..(286): a, c, t, g, unknown or other
  misc_feature (286)..(286): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagccgtggggcctcagtgaaggtctcctgtaaggcctcgaggttacaccttcaccgctaatggtatcacctggcttcgacncggcccctggacaaggcttgaggtgggtggatggatcaactctcacactggaagcagagtctagtcgacggagagacttccgagggcaggacgtcacccgtgacccacgagacgacactacccacgaccacagtcacagtaggagcgtggaggacgccgtaggacgaccgtggaaccgacgacccggccctacgtacttaccgtgtcgacgtaccgccctatcccacacgtccgaccctctacccaacgtcgtcggtaccgaccgtcggcggggtacccgaccggg

SEQ ID NO: 300341 - DNA, 548 bp, Homo sapiens
  misc_feature: GZ8MTXP02J2GFS.11.72.G06.1.454.CMB.2.raw
  modified_base (416)..(416): a, c, t, g, unknown or other
  misc_feature (416)..(416): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggcttgagtgggtggatggatcaactctcacactggaagcagagtctatgacggagagattccgagggcagacgtacacctgaccacagagacataccacgacacagtctacagtggancgtgtggagcctagacgacctaggacacaccggaccctcgtacttacgtgtacgcgtacggaccctatccctacagtcgacccacgtcccgaacgcgtcggttaccgaccttcggacggggcctaaccgggg

SEQ ID NO: 300342 - DNA, 580 bp, Homo sapiens
  misc_feature: GZ8MTXP02JAYL4.11.72.G06.1.454.CMB.2.raw
  modified_base (368)..(368): a, c, t, g, unknown or other
  misc_feature (368)..(368): n is a, c, g, or t
  modified_base (389)..(389): a, c, t, g, unknown or other
  misc_feature (389)..(389): n is a, c, g, or t
  modified_base (405)..(405): a, c, t, g, unknown or other
  misc_feature (405)..(405): n is a, c, g, or t
  modified_base (481)..(481): a, c, t, g, unknown or other
  misc_feature (481)..(481): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggacttgagtgggtgggatggatcgaactctcacactggaagcagagtctatggcgagagacttcagggcngagtcaccctgacccacaganacatcccaacgaccanacgtcaccagtggagcgtcgtggacgccgtgacgacctaggacccgaacgcccgggtacccctctaacgttaccgngttcgaccggtacgcccgttactcccgtacacggtacgacccacctccgaaccgtcgtacggtaccaccgtccggttcggggacccgtaaacccggggg

SEQ ID NO: 300343 - DNA, 574 bp, Homo sapiens
  misc_feature: GZ8MTXP02G5JZZ.11.72.G06.1.454.CMB.2.raw
  modified_base (284)..(284): a, c, t, g, unknown or other
  misc_feature (284)..(284): n is a, c, g, or t
  modified_base (370)..(370): a, c, t, g, unknown or other
  misc_feature (370)..(370): n is a, c, g, or t
  modified_base (427)..(427): a, c, t, g, unknown or other
  misc_feature (427)..(427): n is a, c, g, or t
  modified_base (437)..(437): a, c, t, g, unknown or other
  misc_feature (437)..(437): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacnggcccctggacaaggcttgagtgggtggatggatcaactctcacacgtggaagcagagtctagtcgcggagagattccgaggggcnggacgtcacccgtgacccacagacgacactcccacgaccacacgtactacatggacncgtgtggacnccgtgacgtacctacggacgaccgaccggtccctactacgttactgtcgccggtacggtcccctagtcccttacgacgtcgaccctacgtcccaacgtcgtacggttccacccgtcgtcgggggaccctaaccgggg

SEQ ID NO: 300344 - DNA, 551 bp, Homo sapiens
  misc_feature: GZ8MTXP02GMZ25.11.72.G06.1.454.CMB.2.raw
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggacttgagtgggtgggatgggatcgaactctcacactggaagcagagtctatcgcggagagattccagggcagagtcaccctgacccacagagacatccacgaccacagtctacatggagctggtggagcctgagacctgaccgacacggccctactacttactgtcgcgaacggcccccagtccctaacacgtacgaccaacctcccgaacgccgtcggttccgacccgttcgtacggggcctaaaccgggg

SEQ ID NO: 300345 - DNA, 533 bp, Homo sapiens
  misc_feature: GZ8MTXP02JZN80.11.72.G06.1.454.CMB.2.raw
  modified_base (367)..(367): a, c, t, g, unknown or other
  misc_feature (367)..(367): n is a, c, g, or t
  modified_base (387)..(387): a, c, t, g, unknown or other
  misc_feature (387)..(387): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggacttgagtgggtggatggatcaactctcacactggaagcagagtctatgcggagagattccaggggcngagtcaccctgaccacaganacatccacgaccacagtctacatggagctgtggagcctgagacctgacgacacggccctctagttactgtacgcgtacggcccccatccctaacacgtcgacccactcccaacgctcggttccgacctcgtcggggaccaccgggg

SEQ ID NO: 300346 - DNA, 582 bp, Homo sapiens
  misc_feature: GZ8MTXP02JL0AG.11.72.G06.1.454.CMB.2.raw
  modified_base (283)..(283): a, c, t, g, unknown or other
  misc_feature (283)..(283): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagcctggggcctcagtgaaggtctcctgtaaggcctcaggttacaccttcaccgctaatggtatcacctggcttcgacnggccctggacaaggcttgagtgggtggatggatcaactctcacactggaagcagagtctatcgcggagagacttccgaggggcagggacgtccacccgtgaaccacagacgacatcccaccgaccacacgtctacagtggaagtcgtggtaggacgcccgtaggaacgacccgtgggaaccgacgaccggccccttacgtaacgttaccgtgtgccgacggtccctatccgacacgtcgacccactcccgaacgtccgtacggttccgaaccgtcggttacgggggaccctaaccgggg

SEQ ID NO: 300347 - DNA, 574 bp, Homo sapiens
  misc_feature: GZ8MTXP02H2DWR.11.72.G06.1.454.CMB.2.raw
  modified_base (390)..(390): a, c, t, g, unknown or other
  misc_feature (390)..(390): n is a, c, g, or t
  modified_base (413)..(413): a, c, t, g, unknown or other
  misc_feature (413)..(413): n is a, c, g, or t
  modified_base (423)..(423): a, c, t, g, unknown or other
  misc_feature (423)..(423): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctgggcctcagtgaaggtctcctgtaaggcctcaggttacaccttcaccgctaatggtatcacctggcttcgacaggcccctggacaaggctgagtgggtggatggatcaactctcacacgtggaagcagagtctatgcggagagattccgagggcagagtcaccctgaccacgagagacanccacgaccacagtctacatggancgtgtggacnccgtagacgaccgtggaaccgacgaccggcccttactacttacgtgtacgccgtacggcccttacgtaccctaacgacgttacgaccctaactcccgtaaccgcgttacggttccgtacccgtccggttacgggggaccccgtaaccgggg

SEQ ID NO: 300348 - DNA, 728 bp, Homo sapiens
  misc_feature: GZ8MTXP02GPNVP.11.72.G06.1.454.CMB.2.raw
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagccgtgggcctcagtgaaggtctcctgtaaggcctcaggttacaccttcaccgctaatggtatcacctggcttcgacacggcccctggacaggacttgaggtgggtggatggatcaactctacacacgtggaagcaagagtctagtcggacggagacgtacgttccgaggggtacagggacgttacccgaacccgtacgaacccacgaacggaacggaaccaacgtaccccgaaacccgaacccgaaccgtaaccggttacctaaaccgtaaggttacggggaacgtaccgttaggggtacggaccggtacccggttaggaaccggtacccgtacgggaacccgaacccgtaccgggtaccccttacgttaaacgtttaccgtacgggtacgacccggtaaccggtaccccttacgtaccccgttacgacggttacccgaacccctacccgtacccgtaaccggttccgttacggttaccccgtacccgtaccggggttaccgggggacccgtaaacccgggg

SEQ ID NO: 300349 - DNA, 630 bp, Homo sapiens
  misc_feature: GZ8MTXP02I8MZE.11.72.G06.1.454.CMB.2.raw
  modified_base (338)..(338): a, c, t, g, unknown or other
  misc_feature (338)..(338): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggacttgagtgggtggatggatcaactctcacacgtggaancagagtctatcgcggagagtacttccgaggggccaggacgtccgaccctgaacccacgagagacatacccacgaccacagtacctacatgggacgcgtgtgggacgtccgtaggacgacccgtaggacccgaacgacccgggtcccttacgttaacttccgtaggtcgccggtaaccgggtccccttaacgtcccctaaacgacggttacgaaccccaccgttacccgaaccggtcccgttcgggtttacccgacccgtttccggttaccgggggacccgtaaacccggggg

SEQ ID NO: 300350 - DNA, 529 bp, Homo sapiens
  misc_feature: GZ8MTXP02I5W7V.11.72.G06.1.454.CMB.2.raw
  modified_base (364)..(364): a, c, t, g, unknown or other
  misc_feature (364)..(364): n is a, c, g, or t
  modified_base (380)..(380): a, c, t, g, unknown or other
  misc_feature (380)..(380): n is a, c, g, or t
  modified_base (413)..(413): a, c, t, g, unknown or other
  misc_feature (413)..(413): n is a, c, g, or t
  modified_base (441)..(441): a, c, t, g, unknown or other
  misc_feature (441)..(441): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggcttgagtgggtggatggatcaactctcacactggaagcagagtctatgcgagagattccagggcngagtcaccctgaccanagagacatcccaacgaccacagtctacatggancgtgtggagcctgagaccctgaccgacncggcctctatctgtcgcgacggccctatcctacacgtcgacccactccaacgtcctacggtccgaccgtcgtcggggcctaaccgggg

SEQ ID NO: 300351 - DNA, 630 bp, Homo sapiens
  misc_feature: GZ8MTXP02GYDLF.11.72.G06.1.454.CMB.2.raw
  modified_base (338)..(338): a, c, t, g, unknown or other
  misc_feature (338)..(338): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacacggcccctggacaaggtctgagtgggtggatggatcaactctcacacgtggaancagagtctatcggcggagagtacgttccgaggggaccaggtacgtccacccgtacgaacccagacgagaaccactacccgaaccgaccacagtacctacagtggacgctaggtggacgccgtaggacgaccgtaggaaccgaccgaccggtccctacttaacttacgtgtacggcggtaacggtacccctacgtaccctaacgtacgttaccgaaccctaccgtcccgaaccgtccgttaccgggtttcccgaacccgtttcggggaccggggttaccggtaaccccggggg

SEQ ID NO: 300352 - DNA, 537 bp, Homo sapiens
  misc_feature: GZ8MTXP02F4F7Z.11.72.G06.1.454.CMB.2.raw
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggcttgagtgggtgggatggatcgaactctcacactggaagcagagtctatcgcggagagattccgaggggcagacgtcaccctgaccacagagacatccacgaccacagtctacatcggagctggtggagcctggacgacctgacgacacggccctctactactgtgcgacggcccctagtcctacacgtcgaccactccaacgcgttcggtccaccgtcgtcgggggcctaaccgggg

SEQ ID NO: 300353 - DNA, 629 bp, Homo sapiens
  misc_feature: GZ8MTXP02H2ADQ.11.72.G06.1.454.CMB.2.raw
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacacggcccctggacaaggcttggagtgggtggatggatcgaactctacacacgtggaagcaagagtctagtcggacggagagacttaccgaggggacaggacgtccaccccgtgaaccacgagacgacacacccacgaccacacgtactaacgagtagggacgcgtaggtcggacgccgtaggacgacccgtaggaaccgaccgaccggtccccttacgtactttaccgtggtacgaccggtaccggtaccccttactacccttaacgacggttaccgaccctaccgtacccgccgtcgttccggttacccgacccgtttccgggacggggtacccgaacccggggg

SEQ ID NO: 300354 - DNA, 640 bp, Homo sapiens
  misc_feature: GZ8MTXP02JQ494.11.72.G06.1.454.CMB.2.raw
  modified_base (345)..(345): a, c, t, g, unknown or other
  misc_feature (345)..(345): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcactggcttcgacacggcccctggacaaggacttggaggtgggtcggatggatcaactctcacactggaacgcagngtctagtgacgagagtatccgagggcaggacgtcacccgtgaccacgagacgacagtacccaacgaccacaagttacacgagtcggagccgttggaggacgtcgtacggaacgtaccctaggaaccgaacgaacccgggtccccttactaacgtttaacctggtacgcccggtaaaccggtccccttaataccccgttaacgacggttaccgaaacccccgtaccttacccgaaccggttccgttaccgggttcccgtaacccgtcggttacccgggggaccctaaacccggggg

SEQ ID NO: 300355 - DNA, 535 bp, Homo sapiens
  misc_feature: GZ8MTXP02H0UGW.11.72.G06.1.454.CMB.2.raw
  modified_base (367)..(367): a, c, t, g, unknown or other
  misc_feature (367)..(367): n is a, c, g, or t
  modified_base (382)..(382): a, c, t, g, unknown or other
  misc_feature (382)..(382): n is a, c, g, or t
  modified_base (441)..(441): a, c, t, g, unknown or other
  misc_feature (441)..(441): n is a, c, g, or t
  modified_base (458)..(458): a, c, t, g, unknown or other
  misc_feature (458)..(458): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctgcttcgacaggcccctggacaaggcttgagtgggtgggatggatcaactctcacactggaagcacagtctatcgcggagagattccaggggcngatcaccctgaccanagagacatcccacgaccacagtctacatggagctggtgacgcctgagaccctgacgacncggaccctcgacttacngtgcgaggcccctatccctacacgttcgacccactccaacgcttcgggttccaccgtcgtacggggcctaaccgggg

SEQ ID NO: 300356 - DNA, 590 bp, Homo sapiens
  misc_feature: GZ8MTXP02J3CC7.11.72.G06.1.454.CMB.2.raw
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttaccaccttcaccgctaatggtatcacctggcttcgacacggcccctggacaggactgagtgggtggatggatcaactctcacacgtggaagcagagtctatcgcggagacgtattccgaggggcagagtccacctgaccacagagactacgccacgaccacacgctacatggacgtcgtgtggagccgtaggacgaaccgtggaaccgacaccgggtccctacgtacgttacgtgtcggccgacggtccctatcccgtaacacggtcgaacccctaccgttacccgaacggtccgtcgggtttacccgacccgttccggtacgggggacccgtaacccggggg

SEQ ID NO: 300357 - DNA, 592 bp, Homo sapiens
  misc_feature: GZ8MTXP02GXWWI.11.72.G06.1.454.CMB.2.raw
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggacttgagtgggtggatggatcaactctcacacgtggaagcagagtctagtcgcggagagattccgagggcaggacgtcacccgtgacccacagacgacatcccacgaccacagtactacagtggacgctggtaggacgccgtagacgaccgtaggaccgaccgaccggccctacttaacttacgtcggtcgaccggacggtccccttagtccctaacgacggtaccgacccaccgttcccaacggtccgttacgggttccgacccgtcggtaccgggggacctaacccggggg

SEQ ID NO: 300358 - DNA, 528 bp, Homo sapiens
  misc_feature: GZ8MTXP02GCHOS.11.72.G06.1.454.CMB.2.raw
  modified_base (417)..(417): a, c, t, g, unknown or other
  misc_feature (417)..(417): n is a, c, g, or t
  modified_base (450)..(450): a, c, t, g, unknown or other
  misc_feature (450)..(450): n is a, c, g, or t
  modified_base (457)..(457): a, c, t, g, unknown or other
  misc_feature (457)..(457): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaaatggtatcacctggcttcgacaggcccctggacaaggacttgagtgggtgggatggatcaactctcacactggaagcagagtctatgcggagagattccaggggcagatcaccctgaccacagagacatcccacgaccacagtctacatcgganctgtggagcctgagacctgacgacacggccctntattacngtgcgacggccctatcctacacgtcgaccactccaacgtctcggttcaccgttcgcggggaccaaccgggg

SEQ ID NO: 300359 - DNA, 536 bp, Homo sapiens
  misc_feature: GZ8MTXP02IH1OW.11.72.G06.1.454.CMB.2.raw
  modified_base (384)..(384): a, c, t, g, unknown or other
  misc_feature (384)..(384): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggacttgagtgggtggatggatcaactctcacactggaagcagagtctatgcggagagattccgagggcagagtcacccgtgaccanagagacatccacgaccacagtctacatggagcgtgtaggacgcctgacgacctgacgtacgaccggccctcgtacttactgtgcgacggccctatcctacacgtcgaccactccaacgcgtcggtccgacgtccgtcgggaccgtaaccggg

SEQ ID NO: 300360 - DNA, 519 bp, Homo sapiens
  misc_feature: GZ8MTXP02I36YH.11.72.G06.1.454.CMB.2.raw
  modified_base (415)..(415): a, c, t, g, unknown or other
  misc_feature (415)..(415): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggacttgagtgggtggatggatcaactctcacactggaagcagagtctatgcgagagattccagggcaggatcaccctgaccacagagacatccacgaccacagtacacatggaagcngtggagcctgagacctgacgacgacggccctctatactgtgcgacggccctatcctacacgtcgaccactccaacgctcgtcgacctcgcgggtccaaccgggg

SEQ ID NO: 300361 - DNA, 617 bp, Homo sapiens
  misc_feature: GZ8MTXP02HFZJI.11.72.G06.1.454.CMB.2.raw
  modified_base (433)..(433): a, c, t, g, unknown or other
  misc_feature (433)..(433): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacacccttcaccgctaatggtatcacctggcttcgacaggcccctggacaaggacttgagtgggtggatggatcgaactctcacacgtggaagcagagtctagtcgacggagagattccgagggcaggacgtaccaccctgacccacgagacgacactcccgaacgaccacagtactacgatggancgtgtaggacgtcctggacgacccgtaggaaccgaccgacccgggtccctacgttaacttacgtggtacgaccgtacggaccccttatcccgttaacgacggttaccgaccctacccgttacccgaaccgtccgttaccgggtttcccgacccgtcggtaccgggggaccccgtaaacccgggg

SEQ ID NO: 300362 - DNA, 577 bp, Homo sapiens
  misc_feature: GZ8MTXP02H0TH2.11.72.G06.1.454.CMB.2.raw
  modified_base (386)..(386): a, c, t, g, unknown or other
  misc_feature (386)..(386): n is a, c, g, or t
  modified_base (412)..(412): a, c, t, g, unknown or other
  misc_feature (412)..(412): n is a, c, g, or t
  modified_base (417)..(417): a, c, t, g, unknown or other
  misc_feature (417)..(417): n is a, c, g, or t
  modified_base (426)..(426): a, c, t, g, unknown or other
  misc_feature (426)..(426): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggacttgagtgggtgggatggatcaactctcacactggaagcagagtctatgcggagagattcaggggcaggacgtcaccctgacccanagagacatccacgaccacagtctacntgganctgtaggancgtgacgaccgtagaccgacgaccggccctacgtacttaccgtgtcgcgacgggcccttaactcccttaacgacgttccgaaccctaccctacccgaaccggtccgttcggttacccggtaccctccggttcggggacccgtaacccgggg

SEQ ID NO: 300363 - DNA, 616 bp, Homo sapiens
  misc_feature: GZ8MTXP02I48KE.11.72.G06.1.454.CMB.2.raw
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggcttgaggtgggtgggatggatcaactctacacactggaagcgagagtctatgacggagagattccgagggcagacgtccaacccgtgacccacgagacgaacactcccaacgaccacgagtctaacagtacggagccgtaggtacggacgccgtaggacgaccctggaaccgaaccgacgggtaccccctattacgttacctggtcgaccggtacggtcccctaaacgtcctaacgacgttccgaccctaccctacccgaacgtcccgttacgggttcccgacccgtttccggtacgggggacccctaaaccggggg

SEQ ID NO: 300364 - DNA, 576 bp, Homo sapiens
  misc_feature: GZ8MTXP02GW2SH.11.72.G06.1.454.CMB.2.raw
  modified_base (242)..(242): a, c, t, g, unknown or other
  misc_feature (242)..(242): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctnaggttacaccttcaccgctaatggtatcacctggcttcgacaggcccctggacaaggcttgagtggggtggatgggatcaactctcacacgtggaagcagagtctatcgcggagagtattccgaggggcagacgtccacccgtgacccacgaagacgaacatacccacgaaccacagtctacagtacggagctggtaggacgccgtagacgaccctggaaccgacgaccggccctacgtacttacgtgtacggcgacggtcccctaatcctacgacgttcgaacccactaccgaacgtccgtcggttccaccgttcgcgggggtccaaccgggg

SEQ ID NO: 300365 - DNA, 544 bp, Homo sapiens
  misc_feature: GZ8MTXP02JAJY4.11.72.G06.1.454.CMB.2.raw
  modified_base (336)..(336): a, c, t, g, unknown or other
  misc_feature (336)..(336): n is a, c, g, or t
  modified_base (421)..(421): a, c, t, g, unknown or other
  misc_feature (421)..(421): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggcttgagtgggtggatggatcaactctcacactggaancagagtctatcgcggagagattccgaggggcaggacgtcaaccctgaaccacagacgacatcccacgaccacagtctacatgganctgtaggagcctgacgacctggaccgacgacggccctagtattactgtcgcgacggccctatcctacgacgtcgacccactaccaacgctacggttccaccgttcgtcggggaccaaccgggg

SEQ ID NO: 300366 - DNA, 528 bp, Homo sapiens
  misc_feature: GZ8MTXP02H5TZR.11.72.G06.1.454.CMB.2.raw
  modified_base (368)..(368): a, c, t, g, unknown or other
  misc_feature (368)..(368): n is a, c, g, or t
  modified_base (459)..(459): a, c, t, g, unknown or other
  misc_feature (459)..(459): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggacttgagtgggtggatggatcaactctcacactggaagcagagtctatgcggagagattccgaggggcngagtcacccgtgaccacagagacatccacgaccacagtactacatggagctgtggagcctgacgactgacgacgacggccctcgacttacngtcgcgacggcctatcctacacgtcgaccacgtccaacgctacggttccgacctcgtcgggacaacggg

SEQ ID NO: 300367 - DNA, 647 bp, Homo sapiens
  misc_feature: GZ8MTXP02HK191.11.72.G06.1.454.CMB.2.raw
  modified_base (217)..(217): a, c, t, g, unknown or other
  misc_feature (217)..(217): n is a, c, g, or t
  modified_base (311)..(311): a, c, t, g, unknown or other
  misc_feature (311)..(311): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagccgtgggcctnagtgaaggtctccgtgtaaggcctcgaggttacaccttcaccgctaatgtatcactggcttcgacacggcccctggacaaggcttgaggtgggnggatggatcaactctacacacgtggaagcagagtctagtcggacggagagtacgttccggaaggggcaggtacgtacccaacccgtacgaacccaacgaacggaacgaaccaacggggggtacccaaccgaaccaacaacgtactaacaagtacggacgtacgtaggtacggacgtccgtacggtacgaccgtacggaaccgaccgacccggtacccgtacgttacgttacgtcgtacgacggtaccggtacccgttactacctacgtacgtacgtaccctacctaccgaaccgtcgtacggtccgtaccgtccggtcgggtaccggtaacccggg

SEQ ID NO: 300368 - DNA, 612 bp, Homo sapiens
  misc_feature: GZ8MTXP02I6902.11.72.G06.1.454.CMB.2.raw
  modified_base (283)..(283): a, c, t, g, unknown or other
  misc_feature (283)..(283): n is a, c, g, or t
tcagcgagagataccacgaccggtgctcgatttagctacgactgcaagggaaagggggcccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggctcgacnggcccctgacaggcttgagtgggtggatggatcgaactctcacacgtggaacgcagagtctagtcggcggagagattccgaggggcaggacgtccaccctgaacccaacgagaacgacactacccacgaaccaacacgtactacagtacggagcgtagtaggacgcccgtaggacgacccgtaggaaccgaccgacccggtcccttacgttaacttacgtagtacggccgtacggtcccctactaccctacgacgtaccgaccctacctacccgaaccgtccgttacggttacccgacccgttcggtaccgggggacccgtaaccgggg

SEQ ID NO: 300369 - DNA, 578 bp, Homo sapiens
  misc_feature: GZ8MTXP02GTZIY.11.72.G06.1.454.CMB.2.raw
  modified_base (403)..(403): a, c, t, g, unknown or other
  misc_feature (403)..(403): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggacttgagtgggtggatggatcaactctcacactggaagcagagtctatcgcggagagattccgagggcagacgtcaccctgaccacagagacatccacgacacngtactacatggagctggtaggacgcctggacgaccgtggacgaccgaccggccctactacttactggtcgacggacggccccttatccctacgacgttaccgaaccctaccttcccgaacgtcccgttacggttacccgacccgttccggtacgggggacccgtaaacccggggg

SEQ ID NO: 300370 - DNA, 665 bp, Homo sapiens
  misc_feature: GZ8MTXP02H271M.11.72.G06.1.454.CMB.2.raw
  modified_base (241)..(241): a, c, t, g, unknown or other
  misc_feature (241)..(241): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctgggcctcagtgaaggtctcctgtaaggcctnaggttacaccttcaccgctaatggtatcacctggcttcgacacggcccctggacaaggcttgaggtgggtggagtggatcaaacgtctacacacgtaggaagcaagagtctagtcggacggagagtagttccgaggggccagacgtaccacccgtagaaccacgagacgacacgaccaacgacccacgacgtacctaacagtggaacgtcgttaggaggacgccgtaggaacgacctcggaaccgacgacccggacccttacgtaacgtttaacgtcggtacggaccggtaaccggtacccccttaactaccccttaaacgaccggttaacccgaaccctaacccgtccccgaaccggttccgttacgggtttaccccgaaacccgtttcccgggtacgggggtaccccgtaaaaccccggggg

SEQ ID NO: 300371 - DNA, 714 bp, Homo sapiens
  misc_feature: GZ8MTXP02ITAN4.11.72.G06.1.454.CMB.2.raw
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagcctgggcctcagtgaggtctctgtaaggcctcaggttacaccttcaccgctaatggtatcacctggcttcgacacggcccctggacaaggacttgaggtgggtggatggatcaactctcacacgtggaagcaagagtctagtcggacggagagtacttccgaaggggctaggacgtccacccgtagaacccaacgaagaacgaaccatacccaaccgaacccaacgaagttacctaacaagtacgggaacgccgttggtacgggaacggtcccgttaggaaccggacccgttacgggaacccgaaaccgacccggtacccccttacgtttaaacgtttaacccgttagggttccggacccgggtaaccggtaccccctttaacgttacccccttaaacggtaccggttacccggaacccctaacccgttacccgaaacccggtccgtttccggggtttacccggaccccgtttacccgggtccggggggtaacccctaaacccggggg

SEQ ID NO: 300372 - DNA, 603 bp, Homo sapiens
  misc_feature: GZ8MTXP02G06G8.11.72.G06.1.454.CMB.2.raw
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggcttgagtgggtggatggatcaactctcacactggaagcagagtctagtcggcggagagacttccgaggggcaggacgtccaccctgaccacagacgacactacccacgaccacacgtacctacagtcgggatcgtgtaggacgtccgtaggacgaccgtaggacgaccgaccggccccttacgtacgttactggtcgacccggacggtccccttatccccgtaacgtacgtaccgaacccaccgttaccccgaacgtcccgttacggttcccgacccgttcggtccggggacccgtaaccgggg

SEQ ID NO: 300373 - DNA, 640 bp, Homo sapiens
  misc_feature: GZ8MTXP02GNXRN.11.72.G06.1.454.CMB.2.raw
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacacggcccctggacaaggacttggagtggggtggatggatcgaactctcacacgtggaagcaagagtctatcggacggagagacttccgaggggcaggacgtccacccgtgaacccacgagacgacactacccaacgacccacacgtctaacagtacgggagccgtaggtcgggacgcccgttaggaacgtacccgttaggaaccgaaccgaacccgggtcccttacgttaacttacgtcggtcgaccggtacggaccccttatcccgttaaacgcgtaccgaaccccaacgttccccgaacggttccgttacggggttccgacccgtcgggtaccgggggacccgtaaacccggggg

SEQ ID NO: 300374 - DNA, 685 bp, Homo sapiens
  misc_feature: GZ8MTXP02HD5YU.11.72.G06.1.454.CMB.2.raw
  modified_base (399)..(399): a, c, t, g, unknown or other
  misc_feature (399)..(399): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggcttgagtgggtggatggatcaactctcacacgtggaagcaagagtctaagtcggacggagagtacttccgaggggcaggacgtccaccccgtgaacccanaggacgaacactcccgaacgaaccacaacgtactaacgagttagggacgtcgtggtacgggaacgtcccgtaggaccgacccgtgggaaaccgaccggaaccggccccttacgttaacgtttaccgtcggttacgacccggttaaacgggtcccccttaacttaccccgttaaacgaaccggttaccggaaacccccgtacccttaccccgaaccggtaccgtttaccggggttaccccgtaacccgtttcccggggaccgggggttaacccctaaacccgggggg

SEQ ID NO: 300375 - DNA, 627 bp, Homo sapiens
  misc_feature: GZ8MTXP02GSWL0.11.72.G06.1.454.CMB.2.raw
  modified_base (370)..(370): a, c, t, g, unknown or other
  misc_feature (370)..(370): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaggacttgagtgggtggatggatcaactctcacactggaagcagagtctagtcgcggagagacttccgaggggcnggacgtcaccctgacccagagacgacagtcccaacgaccacacgtactaccagtgggacgacgtggtggacgacccgtggaacgacccgtaggaacccgaccgacccgggcccttacgttacgtttaccgtcggtacggcccggaacggtaccccctttagtaccccctaacgtacggttaccgacccctacctacccgaaccgtccgttacgggttccgacccgtttccggtaccgggggacccgtaacccggggg

SEQ ID NO: 300376 - DNA, 600 bp, Homo sapiens
  misc_feature: GZ8MTXP02GPJSD.11.72.G06.1.454.CMB.2.raw
  modified_base (436)..(436): a, c, t, g, unknown or other
  misc_feature (436)..(436): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcactggcttcgacaggccctggacaaggcttgagtgggtggatggatcaactctcacactggaagcaagagtctatcggacggagagacttccgagggcaggacgtcacccgtgaacccaacgagacgaccactacccaacgaacccacacgtactaacatagggancgtggtaggacgtcctaggacgacccgtaggaccgaccgaccggcccttactacgttaccgtgtacgcggacggtaccctagtccctaacgacggtacaccctaccgtacccgaacgtccgtacgggttacccgaccgtcggtaccgggggacctaacccgggg

SEQ ID NO: 300377 - DNA, 543 bp, Homo sapiens
  misc_feature: GZ8MTXP02I1FFR.11.72.G06.1.454.CMB.2.raw
  modified_base (228)..(228): a, c, t, g, unknown or other
  misc_feature (228)..(228): n is a, c, g, or t
  modified_base (241)..(241): a, c, t, g, unknown or other
  misc_feature (241)..(241): n is a, c, g, or t
  modified_base (250)..(250): a, c, t, g, unknown or other
  misc_feature (250)..(250): n is a, c, g, or t
  modified_base (325)..(325): a, c, t, g, unknown or other
  misc_feature (325)..(325): n is a, c, g, or t
  modified_base (356)..(356): a, c, t, g, unknown or other
  misc_feature (356)..(356): n is a, c, g, or t
  modified_base (403)..(403): a, c, t, g, unknown or other
  misc_feature (403)..(403): n is a, c, g, or t
  modified_base (414)..(414): a, c, t, g, unknown or other
  misc_feature (414)..(414): n is a, c, g, or t
  modified_base (451)..(451): a, c, t, g, unknown or other
  misc_feature (451)..(451): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagcctgggcctcagtgaggtctcngtagctcagtacnccttcacgntaatgtatcacctggcttcgacaggcccctggacaaggcttgagtgggtggatggatcaactctcacactggaancagagtctagtgcggagagattccgagggcngacgtcaccgtgaccacagagacatccacgaccacagtcacatggancgtgtaggacnccgtagacgtaccctaggacccgacgaccggcccctntaacgttactggtcgcggacggcccttagtccctacacgtcgaacccacctccaacgccttcggttccgaccgttcgcggggactaccgggg

SEQ ID NO: 300378 - DNA, 626 bp, Homo sapiens
  misc_feature: GZ8MTXP02IZ2OW.11.72.G06.1.454.CMB.2.raw
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagcctgggcctcagtgaaggtctcctgtaaggcctcaggttacaccttcaccgctaatggtatcacctggcttcgacaggcccctggacaagcttgagtgggtggatggacacactcacacacgtaggacgacgagtacgtactagccggaggagagtacgtacggaggcgaggtctaccaccgtacgaaccagagacgactaccaccgaccgaaccacgtacgtactaacgagtaggactcgtggacggacgttcgaggaccgtacgacggaaccgaaccggccgtaccttacgttaacttcgtcgtacggacggtacccgtaccgtaccttccgtaacgtaccgtaccgaaacccttccgacccgtaaccgtcggttaccggtacccgtccgtacggggtccggtaaccggtaacccggg

SEQ ID NO: 300379 - DNA, 628 bp, Homo sapiens
  misc_feature: GZ8MTXP02H70V1.11.72.G06.1.454.CMB.2.raw
  modified_base (335)..(335): a, c, t, g, unknown or other
  misc_feature (335)..(335): n is a, c, g, or t
  modified_base (419)..(419): a, c, t, g, unknown or other
  misc_feature (419)..(419): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcactggcttcgacaggcccctggacaaggcttgagtgggtggatggatcaactctcacactggaancagagtctatcgcggagagagttccgagggcaggatcaccctgacccacagacgacatccacgaccacacgtacacatggacgntaggtggacgtcctaggacgtacccgtggaaccgaccgacccgggaccccttacgtacgtttaaccgtggtaccggtacccggtacgggtacccccttaaacgttcccttaaaccgtacggttaccgaaacccctaccgttaccccgaaccgtcccgttacgggttacccgtaacccgttccggtacgggggacccctaaacccggggg

SEQ ID NO: 300380 - DNA, 528 bp, Homo sapiens
  misc_feature: GZ8MTXP02JW1TY.11.72.G06.1.454.CMB.2.raw
  modified_base (366)..(366): a, c, t, g, unknown or other
  misc_feature (366)..(366): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggacttgagtgggtggatggatcaactctcacactggaagcagagtctatgcggagagattccaggacngagtcaccctgaccacagagacatccacgaccacagtctacatcggagctgtggagcctgacgacctgacgacacggccctctacttactgtcgcgacggccctagccctacacgtcgacccactcccaacgctcggtcgacctcgtcggggaccaacgggg

SEQ ID NO: 300381 - DNA, 696 bp, Homo sapiens
  misc_feature: GZ8MTXP02G3PPN.11.72.G06.1.454.CMB.2.raw
  modified_base (311)..(311): a, c, t, g, unknown or other
  misc_feature (311)..(311): n is a, c, g, or t
  modified_base (331)..(331): a, c, t, g, unknown or other
  misc_feature (331)..(331): n is a, c, g, or t
  modified_base (339)..(339): a, c, t, g, unknown or other
  misc_feature (339)..(339): n is a, c, g, or t
  modified_base (428)..(428): a, c, t, g, unknown or other
  misc_feature (428)..(428): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcgaggttacacctttcaccgctaatggtatcactggcttcgacaggcccctggacaaggcttgagtgggnggatggatcaactctcaacncgtggaancagagtctagtcggacggagagtacttccgaggggccaggacgtccacccgtagacccaagagacgaaccacgtacccaacgacccaanacgtactaccgagtacggacgtcgtaggtacggacgtacccgtaggacgtaacccgtggaaaccgtacccgaccgggtaccccttacgttaacgttacgtcggtacggacccggtaaaccgggtcccctttaaatcccccggttaaacgacggtttacccggaaacccctaccccgttacccgaacccgggttacccgttccgggggtttaccccgacccggtttacccggggttacccgggggaaccccggtttaaacccccggggg

SEQ ID NO: 300382 - DNA, 594 bp, Homo sapiens
  misc_feature: GZ8MTXP02J3W6G.11.72.G06.1.454.CMB.2.raw
  modified_base (255)..(255): a, c, t, g, unknown or other
  misc_feature (255)..(255): n is a, c, g, or t
  modified_base (367)..(367): a, c, t, g, unknown or other
  misc_feature (367)..(367): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctgacctgagtgagaagcctgggcctcagtgaaggtctcctgtaaggcctcaggttcaccttcaccgntaatggtatcacctggctcgacacggcccctggacaggcttgaggtgggtgggatggatcaactctacacactggagcagtagtctatcgcggagacgatttccgaggggcngacgtcacccctgaccacagacgacactcccacgaccacagtctacatggagcgtgtggactcccgtgacgtaccctggaccgacgacccggtcccttctaacgtttacctggtcgaccggacggccccttatacccttacgacgttaccgacccctaccttccccgaacgtccgttcggttttacccggacccttccggttacgggggaccccgtaaacccggggg

SEQ ID NO: 300383 - DNA, 572 bp, Homo sapiens
  misc_feature: GZ8MTXP02I2CHE.11.72.G06.1.454.CMB.2.raw
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagcctgggcctcagtgaaggtctcctgtaaggcctcaggttacaccttcaccgctaatggtatcacctggcttcgacaggcccctggacaaggacttgagtgggtggatggatcaactctcacactggaagcagagtctatgcggagagattccgaggcaggatcaccctgaccacgagagacatccacgaaccacagtctacagtgaagctgtaggacgtcctagagacccgtggaccgaccgacggcccctactattaccgtgtcgccgaacggtccctatcccgtaactacgtcgaacccaccttcccgaaccgtccgttacgggttcccgaccgttccggtacgggggtccctaaacccggggg

SEQ ID NO: 300384 - DNA, 655 bp, Homo sapiens
  misc_feature: GZ8MTXP02H44MY.11.72.G06.1.454.CMB.2.raw
  modified_base (243)..(243): a, c, t, g, unknown or other
  misc_feature (243)..(243): n is a, c, g, or t
  modified_base (284)..(284): a, c, t, g, unknown or other
  misc_feature (284)..(284): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagccgtggggcctcagtgaaggtctcctgtaaggcctnaggttacaccttcaccgctaatggtatcacctggctcgacncggcccctggacaaggcttggagtgggtggatggatcgaactctacacacgtggaagcagagtctatcggcggagagacttccgagggcagacgtccaccctgaaccacgagacgacactacccacgaccacacgtactacgagtggacgtcgtggtaggacgtccgtagaacgtaccgtaggaccgaacccgaccggtacccttacgtaagtttaccgtggtacggacccggtaacgggtccccttaaccgtaccctaaaccgtacggttaccgaaacccctaccgttacccgaaccggttacccgttacgggttaccccggtaaccccgtttccggggttacccgggggtaaccccggtaaacccgggg

SEQ ID NO: 300385 - DNA, 605 bp, Homo sapiens
  misc_feature: GZ8MTXP02HHJDJ.11.72.G06.1.454.CMB.2.raw
  modified_base (241)..(241): a, c, t, g, unknown or other
  misc_feature (241)..(241): n is a, c, g, or t
  modified_base (283)..(283): a, c, t, g, unknown or other
  misc_feature (283)..(283): n is a, c, g, or t
  modified_base (385)..(385): a, c, t, g, unknown or other
  misc_feature (385)..(385): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctgggcctcagtgaaggtctcctgtaaggcctnaggttacaccttcaccgctaatggtatcacctggcttcgacnggcccctggacaaggacttgagtgggtggatggatcaactctcacacgtaggaagcagagtctagtcgacggagagattcgagggcagatcacctgaaccanaagacgacactaccacgaccacagtctacagtcggacgcgtagtacggacgccgtggaacgaccgtaggaaccgaccgaccggtacccctacgttaacgttacccgtggtaccggccgtaccggtaccccttacgtaccctaacgaacgtcccgaacctaccgtacccgaacggtcgtacggttaccgacccgttccggtacggggaccgtaacccgggg

SEQ ID NO: 300386 - DNA, 628 bp, Homo sapiens
  misc_feature: GZ8MTXP02JOQ88.11.72.G06.1.454.CMB.2.raw
  modified_base (374)..(374): a, c, t, g, unknown or other
  misc_feature (374)..(374): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggacttgagtgggtggatggatcaactctcaacacgtaggaagcagagtactagtcgcggagagtattccgagggcnggacgtccacccgtgaacccacgagacgacactccaacgacacgagtactaccagtacggagcgtggtaggacgccgtaggacgaccgtcggaaccgaccgaccggaccccttacgtacttaccgtcgttacgaccggtacgggtaccccttacgtacccttacgacggttccgaacccttaccgtacccgtaaccgtaccggtttcggtttcccgaacccgtttccggtaccgggggtaccccgaaaccgggg

SEQ ID NO: 300387 - DNA, 610 bp, Homo sapiens
  misc_feature: GZ8MTXP02GLIW0.11.72.G06.1.454.CMB.2.raw
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgagtgaagaagcctgggcctcagtgaaggtctcctgtaaggcctcaggttacaccttcaccgctaatggtatcacctggcttcgacaggcccctggacaaggcttgagtgggtggatggatcaactctcacacgtggaagcagagtctagtcgcggagagtacttccgaggggcaggtacgtccaccccgtagaacccagacgaagaccaatcccaacgaacccacaagtactaaccagtcgggacgccgtgtacgggaacgccgttaggacgtaccctggaaccgaccgaccggcccttactacgttactggtcgacggtacggtcccctagtccctaacgacggtacgaccctaccttcccgaaccgtcgttacggttaccgaccgtccggttacggggaccgtaacccgggg

SEQ ID NO: 300388 - DNA, 630 bp, Homo sapiens
  misc_feature: GZ8MTXP02HE6YF.11.72.G06.1.454.CMB.2.raw
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacacggcccctggacaaggctggaggtgggtggatggatcgaactctacacgacgtaggaagcagtagtctagtcggacggagagtacgttccggaggggctagggacgtccaaccccgtcgaacccacgaaggaacgaacactacccgaacgaccacacgtactacgaagtggaacgtcgtgtacggactccgtaggacgacctggaaccgaaccgccggtaccctagttaacgtttacgcggtcgaccgtaccggtcccttacgtaccctaacgtacgtcccgaaccctaccgtcccgaacgttcgtacggttcccgaccgtccggtaccggggacctaacccgggg

SEQ ID NO: 300389 - DNA, 673 bp, Homo sapiens
  misc_feature: GZ8MTXP02FV4OS.11.72.G06.1.454.CMB.2.raw
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggcttgagtgggtggatggatcaactctcacactggaagcaagagtctatgcgagagtattccgagggcaggacgtcacccgtagacccaacgaagacgacactccaaccgaaccaacacgtactaaccataggagacgtgtagggacgccgtaggacgtacccgtaggaaccgaaccgaaccgggccccttacgttaacgtttacgtacgttcgggcccggtaacggggtacccccttaaacttaccccgttaaacgtaacggtttaccggaaaccccgtaacccttacccccgaaacccggttacccgtttaccggggtttacccgtaaccccgtttccgggttaccggggggaccccctaaaaccccgggggg

SEQ ID NO: 300390 - DNA, 679 bp, Homo sapiens
  misc_feature: GZ8MTXP02FYRLB.11.72.G06.1.454.CMB.2.raw
  modified_base (242)..(242): a, c, t, g, unknown or other
  misc_feature (242)..(242): n is a, c, g, or t
  modified_base (284)..(284): a, c, t, g, unknown or other
  misc_feature (284)..(284): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctnaggttacaccttcaccgctaatggtatcacctggcttcgacnggcccctggacaaggacttgaggtgggtggatggatcaactctcacactggaagcagagtctagtgcggagagacttccgagggcaggacgtccacccgtacgaacccaacaggaacgaaccactacccgaaccgaacccaacgacgtacctaacagtacgggagtaccgtgtacgggacgtccgtaggacgacccgtaggaaccgaacccgaccgggtaccccttacgttaacgttaccgtacggttcggaccggtaaccgggtcccccttaaacgtaccccgttaaacgtacgtacccggtaaacccctaccgttaccccgaaccggttaccgttaccggggtttacccggacccgtttaccgggacccgggggtacccgtaaaccccggggg

SEQ ID NO: 300391 - DNA, 567 bp, Homo sapiens
  misc_feature: GZ8MTXP02IQ5VW.11.72.G06.1.454.CMB.2.raw
  modified_base (340)..(340): a, c, t, g, unknown or other
  misc_feature (340)..(340): n is a, c, g, or t
  modified_base (344)..(344): a, c, t, g, unknown or other
  misc_feature (344)..(344): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacacccttcaccgctaatggtatcacctggcttcgacaggcccctggacaaggacttggagtgggtggagtggatcaactctcacactggaancagngtctatgcggagagattcccgagggcaggacgtccaccctgacccaagagacgacatccacgaccacagtctacagtggagctgtggacgccgtagacgacctggaaccgacgaccggtccctcgtaattccgtagtgacgtacggtccccttagtcccttacacgtccgaacccactcccaacgtctcggttccgaccgtcgtcgggggacctaaccggggg

SEQ ID NO: 300392 - DNA, 576 bp, Homo sapiens
  misc_feature: GZ8MTXP02IMYSH.11.72.G06.1.454.CMB.2.raw
  modified_base (437)..(437): a, c, t, g, unknown or other
  misc_feature (437)..(437): n is a, c, g, or t
  modified_base (533)..(533): a, c, t, g, unknown or other
  misc_feature (533)..(533): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacacggcccctggacaaggcttggagtgggtggatggatcaactctcacacgtggaagcagagtctatcggcggagagtacttccgaggggcaggcgtccacccgtgaacccagagagaacactacccgaacgaaccacacgtactacagtggacncgtgtggacgccgtagacgtaccgtggaaccgaccaccgggcccttatacgttactggtcgccgaacggtcccctatccctaacacgtcgaacccncctccaacgtcttcggtccaccgtcgtcggggacctaacgggg

SEQ ID NO: 300393 - DNA, 652 bp, Homo sapiens
  misc_feature: GZ8MTXP02F2RO4.11.72.G06.1.454.CMB.2.raw
  modified_base (398)..(398): a, c, t, g, unknown or other
  misc_feature (398)..(398): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggcttggagtggggtggatggatcaactctcacactggaagcaagagtctatggacggagagtacttccgaaggggcaggacgtccaacccgtgaacccanagagaacactacccacgaaccacagtacctaacagtggagtcgtaggtaggagtccgtaggacgtacccgtaggaaccgaacccgaaccgggtcccccttagttaaactttaccgtaggttcggaccggaaacgggtccccccgttaagttaccccctaaagtacggttaccgaaccccaccgtttaccccgaaccggtccgttacgggtttcccgaacccgttccggtacgggggaccccgtaaacccggggg

SEQ ID NO: 300394 - DNA, 558 bp, Homo sapiens
  misc_feature: GZ8MTXP02I0VOA.11.72.G06.1.454.CMB.2.raw
  modified_base (280)..(280): a, c, t, g, unknown or other
  misc_feature (280)..(280): n is a, c, g, or t
  modified_base (397)..(397): a, c, t, g, unknown or other
  misc_feature (397)..(397): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctgggcctcagtgaaggtctcctgtaaggcctcaggttacaccttcaccgctaatggtatcactgctcgacngccctgacagctgagtgggtggatggatcaactctcacactggaagcaagagtctatgcggagagattccgagggcaggagtaccacccgtgaccacagagacatcccacgaccacngtactacatgagctggtggacgccgtaggacgacctaggaaccgaccgaccgggaccctcgttattaccgtgtcggcgtacggtcccttacgtccctacaacggtcgaccctacctccaaccgtcgtacggttccgacccgtcgtcgggacccgtaacggg

SEQ ID NO: 300395 - DNA, 625 bp, Homo sapiens
  misc_feature: GZ8MTXP02FXPWJ.11.72.G06.1.454.CMB.2.raw
  modified_base (242)..(242): a, c, t, g, unknown or other
  misc_feature (242)..(242): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctnaggttacaccttcaccgctaatggtatcactggcttcgacaggcccctggacaaggacttgagtgggtggatggatcaactctcacacgtggaagcagagtctatgacggagagattccgagggcaggacgtccaccctagaccagagacgacactacccacgaccacacgtactacgatggagcgtggtagggacgccgtaggacgtacccgtacgggaccgtaaccgaccgggaccccttacgttaacttaccgtggtacgccggtaacggtcccctaacgttacccgtaacgtaacgtaccgaaccctacccgttacccgaaccggtccgttcgggtttacccgacccgtttcggccgggggtacccgtaaacccggggg

SEQ ID NO: 300396 - DNA, 672 bp, Homo sapiens
  misc_feature: GZ8MTXP02IAMF8.11.72.G06.1.454.CMB.2.raw
  modified_base (240)..(240): a, c, t, g, unknown or other
  misc_feature (240)..(240): n is a, c, g, or t
  modified_base (309)..(309): a, c, t, g, unknown or other
  misc_feature (309)..(309): n is a, c, g, or t
  modified_base (354)..(354): a, c, t, g, unknown or other
  misc_feature (354)..(354): n is a, c, g, or t
  modified_base (387)..(387): a, c, t, g, unknown or other
  misc_feature (387)..(387): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgagtgaagaagcctgggcctcagtgaaggtctcctgtaaggcctnaggttacaccttcaccgctaatggtatcacctggcttcgacacggcccctggacaggacttgagtgggnggatggatcaactctcacactggaagcagagtctatcgcggaganagttcgagggcagacgtcacccgtgaccacganacgaccatacccacgaccacagtactaacagtaggacgcgttggacggggacgtcccgttggaacgtacccgtagggaaacccgaccgaaacccggggccccttactaacgtttaaccgtcggttacggacccggtaaccgggtaccccctttacgtacccctttaaaccggaacggttacccgaacccccgtaacctttaccccgaaacccgggttccctttaccggggtttcccgaaccccgttttccgggtaccgggggtaaccccgtaaaaccccgggggg

SEQ ID NO: 300397 - DNA, 582 bp, Homo sapiens
  misc_feature: GZ8MTXP02I658A.11.72.G06.1.454.CMB.2.raw
  modified_base (284)..(284): a, c, t, g, unknown or other
  misc_feature (284)..(284): n is a, c, g, or t
  modified_base (386)..(386): a, c, t, g, unknown or other
  misc_feature (386)..(386): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacnggcccctggacaaggacttgagtgggtggagtggatcaactctcacacgtggaagcagagtctatgcggagagattccgagggcagacgtcaccctgaccanagagacatcccacgaccacagtactaccagtggagcgtagtaggacgccgtgacgacctaggaccgaccgaccggccctactacttactcgtcgacggacggtccccttacgtaccctaacgacgtaccgaaccctacctcccgaaccgtccgttacggttccgacccgtcggtaccggggacccgtaacccgggg

SEQ ID NO: 300398 - DNA, 617 bp, Homo sapiens
  misc_feature: GZ8MTXP02GUPPL.11.72.G06.1.454.CMB.2.raw
  modified_base (241)..(241): a, c, t, g, unknown or other
  misc_feature (241)..(241): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctgggcctcagtgaaggtctcctgtaaggcctnaggttacaccttcaccgctaatggtatcacctggcttcgacagcccctgacaagcttgagtggtggatggatcgaactctcacacgtggaagcagagtctagtgacggagagacttccgaggggcaggacgtcaaccccgtagaacccaacgagacgaacgactacccgaaacgaaccctaacaacgttacaccagtaggagctaggtacggagccctaggacgacctaggaccgaaccgccggacccttcgtaaactttctaggtcgacggacgtacccgttactaccgtactacgtaccgaaccctaccgtcccgaacgtcccgttcggtttacccgacccgttccggtaccgggggacccgtaaacccggggg

SEQ ID NO: 300399 - DNA, 659 bp, Homo sapiens
  misc_feature: GZ8MTXP02G44OL.11.72.G06.1.454.CMB.2.raw
  modified_base (309)..(309): a, c, t, g, unknown or other
  misc_feature (309)..(309): n is a, c, g, or t
  modified_base (340)..(340): a, c, t, g, unknown or other
  misc_feature (340)..(340): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagcctggggcctcagtgaaggtctccgtgtaaggcctcaggttacaccttcaccgctaatggtatcactggcttcgacacggcccctggacaggcttgagtgggnggatggatcgaactctcacacgtggagcagngtctatcgacggagagtagttccgagggtcaggacgtccgacccgtgaccacgagacgaccactacccaacgaaccacgacgtactaaccgtagtacgggacgtcgtacggtaggggaactcccggttaacggacgtaacccgttacggaaccggaccgtacccgggtaccccttacgttacgttaccgtggttacgaccggtacggtaccccttagttaccctaaacgtcgttaccgaccctacccgttacccgaaccgttccggttacgggttacccggtacccgttccggtaccgggggtaccgtaaacccggggg

SEQ ID NO: 300400 - DNA, 618 bp, Homo sapiens
  misc_feature: GZ8MTXP02FQI59.11.72.G06.1.454.CMB.2.raw
  modified_base (241)..(241): a, c, t, g, unknown or other
  misc_feature (241)..(241): n is a, c, g, or t
  modified_base (370)..(370): a, c, t, g, unknown or other
  misc_feature (370)..(370): n is a, c, g, or t
  modified_base (390)..(390): a, c, t, g, unknown or other
  misc_feature (390)..(390): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagcctggggcctcagtgaaggtctcctgtaaggcctnaggttacaccttcaccgctaatggtatcactggcttcgacaggcccctggacaggcttgaggtgggtggatggatcaactctcacacgtggaagcagagtctatcggacggagagtacttcgaggggcngagtccacccgtgaacccanagaacgacatacccacgaccacagtacacagtcgggatacgtggtaggacgtccgtaggacgacctaggaccgaaccgaccggtacccttacgtacgttacgtcggtcgaccggtacggtccccttaactcccgtaacgtacggtccgtaaccctacccgttacccgaaccggtaccgtttcgggttacccgtaccggttcggtaccgggggtaccctaacccggggg

SEQ ID NO: 300401 - DNA, 665 bp, Homo sapiens
  misc_feature: GZ8MTXP02GWYY6.11.72.G06.1.454.CMB.2.raw
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacacggcccctggacaaggcttgaggtgggtggatggatcgaactctcacacgtggaagcagagtctagtggacggagagacttccgaggggcaggacgtccaccctgacccagagacgacactacccaacgacccaacgagtcctaacgagtgggacgtcgtaggtacgggacgtcccgtaggacgacccgttacgggaacccgaacccggacccgggtcccccttacgttaaacgtttaccgtcgggtacggaccggtaacgggtccccctttaagtaccccgttaacgacggttaccgaaacccctaccgttaccccgaacggtccgttacggggtttacccgacccggttccgggtaccgggggaccctaaacccggggg

SEQ ID NO: 300402 - DNA, 540 bp, Homo sapiens
  misc_feature: GZ8MTXP02I85R7.11.72.G06.1.454.CMB.2.raw
  modified_base (368)..(368): a, c, t, g, unknown or other
  misc_feature (368)..(368): n is a, c, g, or t
  modified_base (496)..(496): a, c, t, g, unknown or other
  misc_feature (496)..(496): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggacttgagtgggtggatggatcgaatctcacactggaagcagagtctatcgcggagagattccaggggcngagtcaccctgacccacagacgacataccacgaccacagtctacatggagctgtggagcctgagaccctggaccgacaccggcctcgtattaccgtgtcgcgacggccctatccctacacgtcgaccncgtaccaacgtctcggttaccgacctcgcgggtaccaaccgggg

SEQ ID NO: 300403 - DNA, 625 bp, Homo sapiens
  misc_feature: GZ8MTXP02HBOGB.11.72.G06.1.454.CMB.2.raw
  modified_base (243)..(243): a, c, t, g, unknown or other
  misc_feature (243)..(243): n is a, c, g, or t
  modified_base (284)..(284): a, c, t, g, unknown or other
  misc_feature (284)..(284): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcgagtgaaggtctcctgtaaggcctnaggttacaccttcaccgctaatggtatcactggcttcgacncggcccctggacaaggacttggagtgggtggatggatcaactctacacacgtaggaagcaagtagtactagtcggacggagagacttccgaggcaggacgtcaccctgacccacagacgaacacacccaacgaaccctacgaacgtactaaccgagtacggacgtactgggtacggaacgtccgtaggacgacccgtaggaacccgaaccgaccggtccctacgtaacgttacgtggtcgacggtacggaccccttataccccgtagacggttacaaccctccgtacccgaacgtccgttacggttacccgacgttccggtcggggacccgtaacccgggg

SEQ ID NO: 300404 - DNA, 596 bp, Homo sapiens
  misc_feature: GZ8MTXP02F1FFI.11.72.G06.1.454.CMB.2.raw
  modified_base (242)..(242): a, c, t, g, unknown or other
  misc_feature (242)..(242): n is a, c, g, or t
  modified_base (401)..(401): a, c, t, g, unknown or other
  misc_feature (401)..(401): n is a, c, g, or t
  modified_base (494)..(494): a, c, t, g, unknown or other
  misc_feature (494)..(494): n is a, c, g, or t
  modified_base (503)..(503): a, c, t, g, unknown or other
  misc_feature (503)..(503): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctnaggttacaccttcaccgctaatggtatcacctggcttcgacaggcccctggacaaggacttggaggtgggtggatgggatcaactctcacacgtggaagcaagagtctagtcggacggagagacttccgaggggcaggacgtccacccgtgaacccaanaggtacgaacactacccaaccgaaccacacgtacacagtcggagcgtaggtaggacgtccgtaggacacccgtagaccgaccgtccggccctntacgttacngtcgcgtaacggtccctagtccctaatacggtacaaccctcctaccaacgtccgtacggttccgacccttcggaccggggaccgtaacccggg

SEQ ID NO: 300405 - DNA, 595 bp, Homo sapiens
  misc_feature: GZ8MTXP02HR6JX.11.72.G06.1.454.CMB.2.raw
  modified_base (335)..(335): a, c, t, g, unknown or other
  misc_feature (335)..(335): n is a, c, g, or t
  modified_base (427)..(427): a, c, t, g, unknown or other
  misc_feature (427)..(427): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagcctgggcctcagtgaaggtctcctgtaaggcctcaggttacaccttcaccgctaatggtatcacctggcttcgacaggcccctggacaaggacttgagtgggtggatggatcaactctcacactggaancagagtctagtcgcggagagattccgaaggggcaggacgtcaccccgtgaacccacagaacgacactcccacgaccacacgtctacatggancgtgtggacgtcctaggacgaccctaggaaccgaccgaccgggtcccctacttaacttaccgtggtcggccgtacgggaccccttaagttccctacgacggtccaaccctacctaccaaccgtcgttacggttccgacccgttcggtccgggggtacccaaccggggg

SEQ ID NO: 300406 - DNA, 597 bp, Homo sapiens
  misc_feature: GZ8MTXP02GH3OH.11.72.G06.1.454.CMB.2.raw
  modified_base (419)..(419): a, c, t, g, unknown or other
  misc_feature (419)..(419): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcactggcttcgacaggcccctggacaaggacttgagtgggtggatggatcaactctcacacgtggaagtcgaagagtctatcggacggagagtattcccgaaggggcaggacgtcaacccgtgacccaagagagacactcccacgaccanagtactacatggagcgtgtaggagccgtaggacgaccctaggaccgaaccgtacccgggcccttacgttaacttaccgttgtacgccggtaacgggtcccctactcccgtacgacgtaccgacccacgtacccaacgtcgttacggttaccgaccgtcggtcggggaccgtaaccggg

SEQ ID NO: 300407 - DNA, 644 bp, Homo sapiens
  misc_feature: GZ8MTXP02GARJN.11.72.G06.1.454.CMB.2.raw
  modified_base (421)..(421): a, c, t, g, unknown or other
  misc_feature (421)..(421): n is a, c, g, or t
tcagcgagagataccacgaccggtgctcgatttagctacgactgcaagggaaaggggacccaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctcgtaaggacgtccaagtaactaccttacctaccgacctaatagtagttacacctacggtcgtcgtacaaggaccccgtcccggagaaacggaacgttacgttagggtaggggtggggtagtaggagtacaactactactacactacgaaggacgagagtagtatacgcggagagagtacgtacggacggngagtacgtaccaccgaccgaacaacgagaacgaactacctaacccgaaccgaaaccaacgtacgtactaactagagagtagtaggtagacgtcgagacgacgacgacgaccgacccgtcctacttactacgtgtcgacggaccgtacctacctacctaacgtacgtaccgaacctacccgtaaccgacgtacgttacggtaccgtaccgtcggtacggaccgg

SEQ ID NO: 300408 - DNA, 602 bp, Homo sapiens
  misc_feature: GZ8MTXP02JZUF8.11.72.G06.1.454.CMB.2.raw
  modified_base (242)..(242): a, c, t, g, unknown or other
  misc_feature (242)..(242): n is a, c, g, or t
  modified_base (283)..(283): a, c, t, g, unknown or other
  misc_feature (283)..(283): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctnaggttacaccttcaccgctaatggtatcacctggctcgacnggcccctggacaggcttggagtggggtggatggatcaactctcacatggaacgcagtagtctagtcggacggagaggtacttccgaaggggtcaggacgtccaaccccgtgaacccagaacgacgacactacccaaccgaccacacgtactacgagtagggacgtcgtggtggacgccgtaggacgaccgtaggaccgacaccggtcccttatacgttacgtgtcgccggtacggtccctatcccgtacgacgtaccgaccctaccgtccaacggtccgttacggtccgaccttcggtaccgggggaccctaaccgggg

SEQ ID NO: 300409 - DNA, 597 bp, Homo sapiens
  misc_feature: GZ8MTXP02G3BNT.11.72.G06.1.454.CMB.2.raw
  modified_base (242)..(242): a, c, t, g, unknown or other
  misc_feature (242)..(242): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctnaggttacaccttcaccgctaatggtatcacctggcttcgacaggcccctggacaaggcttgagtgggtggatggatcaactctcacactggaagcagagtctagtcgacggagagacttcgagggcagacgtcacccgtagaccaacgagacgacatacccaacgaccacacgtactacatggagctaggtggacgcctaggagaccgtgaccgaccgaccggccctactacttacgtgtacgaccggtacggtccctacgtaccctacgacgttaccgaaccctacctacccgaaccggtcgttaccgggttacccgaacccgttccggtaccgggggacccgaaacccggggg

SEQ ID NO: 300410 - DNA, 706 bp, Homo sapiens
  misc_feature: GZ8MTXP02HJBW3.11.72.G06.1.454.CMB.2.raw
  modified_base (216)..(216): a, c, t, g, unknown or other
  misc_feature (216)..(216): n is a, c, g, or t
  modified_base (255)..(255): a, c, t, g, unknown or other
  misc_feature (255)..(255): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagcctgggcctnagtgaggtctctgtaggcctcaggttacaccttcaccgntaatggtatcactgcttcgacacggcccctggacaggacttggaggtgggtggagtggatcaactctcacacgtaggaagcagagtctagtcggacggagacgtacttccggaaggggaacgcgtaccgtaccctacggacccaaccgtaacgaacgaaccaactacccgaaacccgaaccacgtaacgtacgtaaccagtacggaagtccgtagtcgggacgtccgttacggaacgtacccggtacgaaccgggaacccgtacccgggtacccttaccgttaacgtttaacgtcgggttacgggacccggtaacccgggtacccttaacccggttaccttaaccgtacggttaccgaaccccgtacccgttacccgtaaccggtcccgttacgggttaccggtaccccgtcggttacccgggggaacccgtaaccggggtaacccccggg

SEQ ID NO: 300411 - DNA, 597 bp, Homo sapiens
  misc_feature: GZ8MTXP02JHH9L.11.72.G06.1.454.CMB.2.raw
  modified_base (239)..(239): a, c, t, g, unknown or other
  misc_feature (239)..(239): n is a, c, g, or t
  modified_base (246)..(246): a, c, t, g, unknown or other
  misc_feature (246)..(246): n is a, c, g, or t
  modified_base (255)..(255): a, c, t, g, unknown or other
  misc_feature (255)..(255): n is a, c, g, or t
  modified_base (420)..(420): a, c, t, g, unknown or other
  misc_feature (420)..(420): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctctgtaagctnagttacnccttcacgntaatgtatcactggctcgacaggcccctggacaaggactgagtgggtggatggatcaactctcacactggaagcagagtctagtgcggagagacttccgaggggcaggacgtccaacccgtgaaccacagacgacatacccgacgaccacagtacacgataggancgtgtggacgccgtgacgacctaggaccgaccgaccggcccttagtacccttagtcgtcgaccggaaccggtccccttataccccgttaacgacgttaccgaaccctacctacccgtaaccgtccgttaccggtttcccgacccgttacggtccgggggacccgtaaaccccggggg

SEQ ID NO: 300412 - DNA, 585 bp, Homo sapiens
  misc_feature: GZ8MTXP02IOOIJ.11.72.G06.1.454.CMB.2.raw
  modified_base (458)..(458): a, c, t, g, unknown or other
  misc_feature (458)..(458): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcactggcttcgacaggcccctgacaggctgagtgggtggatggatcaactctcacactggaagcagagtctatgcggagagattccgaggggcaggagtcaccctgacccagagagacatcccacgaccacagtctacagtggacgcgtgtaggacgcctgacgacctggaaccgacgaccggcccttntacgttaccgtgtcggccggggtaccctacgttcccgtaacacggtacgaccctaccgttcccaccgtccgttacggggttacccgtaccccgttcggtacggggtacccgaacggggtaacccccg

SEQ ID NO: 300413 - DNA, 669 bp, Homo sapiens
  misc_feature: GZ8MTXP02HZR55.11.72.G06.1.454.CMB.2.raw
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctgggcctcagtgaaggtctctgtaaggcctcaggttacaccttcaccgctaatggtatcactggcttcgacacggcccctggacaaggacttggagtgggtggatggatcaactctacacactaggaagcagagtctagtcggacgggagagagttccgaggggacagggtacgtccaccccttaggaacccaacgaaggaacgaaccaacgtaccccaaccgaacccaaccgaacgttacctaaaccgagttacggggagtccgttagggtacgggaacgtcccgttaggaacgtacccgtacgggaacccgaaccgacccgggtaccctttacgtaactttaccgtggtacggacccggtacggtaccccttacgtaccctacgtacggttaccgaccctacctcccgaacgtcgttacggttcccgaccgtccggtcgggggtacccgtaaccgggg

SEQ ID NO: 300414 - DNA, 652 bp, Homo sapiens
  misc_feature: GZ8MTXP02GQD4U.11.72.G06.1.454.CMB.2.raw
  modified_base (243)..(243): a, c, t, g, unknown or other
  misc_feature (243)..(243): n is a, c, g, or t
  modified_base (261)..(261): a, c, t, g, unknown or other
  misc_feature (261)..(261): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagccgtggggcctcagtgaaggtctcctgtaaggcctnaggttacaccttcaccgntaatggtatcacctgcttcgacaggcccctggacaaggcttgaggtgggtggatggatcaactctcacacgtggaagcagagtctagtcggcggagagacgttccgagggcaggacgtccgaccctagaacccacgaggacgacactacccaacgacccacaacgtacctaacgagtaggacgtcgtggtacgggtacgccgtaggacgaccgtggaacccgaccgtaccgggccccttagttaacgttacgtagggtacgtcccggtacggtaccccgttacttacccgtaacgtaccggtaccgtacccctaccgtacccgtaacgtcccggttaaccggtttcccggtaacccgttccgggtaccgggggtacccgtaaacccggggg

SEQ ID NO: 300415 - DNA, 703 bp, Homo sapiens
  misc_feature: GZ8MTXP02IQKQ0.11.72.G06.1.454.CMB.2.raw
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacacggcccctggacaaggcttggagtgggtggatggatcaactctcacactggaagcagagtctagtcggacggagagtacgttccgaaggggcaggacgtccaaccctagaacccacgaagaacgaaccactacccgaaccgaacccaacgtaacgttaccctaacgaacgtacggggaacgtccgtagggttacggggacgtcccgttaggacggaacccgtacgggaacccgaacccgacccggggtaccccttacgttaacgtttaaccgtcggtacggacccggtaacgggtacccccttaacgttaccccgttaaaccgaacgttacccgaaaccctaccctaccccgtaaccggtcccgttacgggttaccccgaacccggttccggtaccgggggaccccgtaaacccggggg

SEQ ID NO: 300416 - DNA, 289 bp, Homo sapiens
  misc_feature: GZ8MTXP02I2OWM.11.72.G06.1.454.CMB.2.raw
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggctcgacagccccg

SEQ ID NO: 300417 - DNA, 610 bp, Homo sapiens
  misc_feature: GZ8MTXP02IQI6W.11.72.G06.1.454.CMB.2.raw
  modified_base (213)..(213): a, c, t, g, unknown or other
  misc_feature (213)..(213): n is a, c, g, or t
  modified_base (267)..(267): a, c, t, g, unknown or other
  misc_feature (267)..(267): n is a, c, g, or t
  modified_base (289)..(289): a, c, t, g, unknown or other
  misc_feature (289)..(289): n is a, c, g, or t
  modified_base (292)..(292): a, c, t, g, unknown or other
  misc_feature (292)..(292): n is a, c, g, or t
  modified_base (318)..(318): a, c, t, g, unknown or other
  misc_feature (318)..(318): n is a, c, g, or t
  modified_base (473)..(473): a, c, t, g, unknown or other
  misc_feature (473)..(473): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggactgaggtgaagagctgggctnagtgaggtctctgtaggctcagttacacctcacgctatgtatcactgctcgacncgccctgacaggctgagtgggnggntggatcaactcaccagtggaagcagngtctagtggaccggagagtacttccgagggcagcgtccaccctgaccagagacgacactccacgaccagacgtcaacagtaggacgcgtaggtcggacgtccgtaggacgtacccgtacggaccgacccgaccggtcccttacttacgtttacgnggtacggacgtaccggtacccttacgtccgtaacgtacggtaccgtaaccccctaccgtaccctaccggttcggttaccggttacccggtacccgttcggggtacccggggtacccgtaaaccgggggttacccccg

SEQ ID NO: 300418 - DNA, 600 bp, Homo sapiens
  misc_feature: GZ8MTXP02HE9AC.11.72.G06.1.454.CMB.2.raw
  modified_base (254)..(254): a, c, t, g, unknown or other
  misc_feature (254)..(254): n is a, c, g, or t
  modified_base (416)..(416): a, c, t, g, unknown or other
  misc_feature (416)..(416): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagcctgggcctcagtgaaggtctcctgtaaggcctcagggttacaccttnaccgctaatggtatcacctggcttcgacacggcccctggacaaggacttgagtgggtggatggatcaaactcgtacacactgggaaagcgaagacgtctaagtcggacgggaagaggtacttaccgaggggcagtacgtcaccccgtgaaccacagagacancccaacgaccacagtctaacatgggagactggtagagcctgacgactgaacgcaccggccctactatacctgtcgacggtacggacccctataccctaacgtaggtccaaccctacctacccgaaccggtccgttccgggtttaccgacccgtttccggaacgggggtaccccgaaaccggggg

SEQ ID NO: 300419 - DNA, 688 bp, Homo sapiens
  misc_feature: GZ8MTXP02GDJBB.11.72.G06.1.454.CMB.2.raw
  modified_base (285)..(285): a, c, t, g, unknown or other
  misc_feature (285)..(285): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagccgtggggcctcagtgaaggtctcctgtaaggcctcaggttacaccttcaccgctaatggtatcacctggcttcgacnggcccctggacaaggacttgagtgggtggatggatcaactctcacacgtggaagcagtagtctatggacggagagtacgttccgaaggggtacagggacgtacccaacccgtggaaccccacgaaagaacgaaccgactacccgaacgaacccaacacgttaccacaagtcgggaacgtcgtggtaggacgccgtaggacgtacccgtaggaaccgtaaccgaccggtaccccttacgttaactttaccgtacggtcggacccggacggtacccccgttaagttaccccgttaaacgtaccggttacccgaacccctacccgtaccccgtaacccggttcgttcccggggtttacccggaccccgtttccggggtaccgggggaccccggtaaccccgggggg

SEQ ID NO: 300420 - DNA, 638 bp, Homo sapiens
  misc_feature: GZ8MTXP02GIJVB.11.72.G06.1.454.CMB.2.raw
  modified_base (429)..(429): a, c, t, g, unknown or other
  misc_feature (429)..(429): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggcttgagtgggtggatggatcgaactctcacactggaagcagagtctagtcggacggagagacttccgaggggcaggacgtcacccgtgacccagagacgacatacccacgaccacagtctacagtggacnctgtggacgccgtaggacgaccgtacggaaccgaccgaacccgggtccccttacgtaaacgtttaccgtcggttacggcccggtaaccgggtcccccttaacgtaccccgttaaccgtacggttaccgaacccctaccgtaccccgtaaccgtccgttaccgggtttcccgacccgtttccggtccgggggtaccccgtaaaccggggg

SEQ ID NO: 300421 - DNA, 559 bp, Homo sapiens
  misc_feature: GZ8MTXP02IHN26.11.72.G06.1.454.CMB.2.raw
  modified_base (366)..(366): a, c, t, g, unknown or other
  misc_feature (366)..(366): n is a, c, g, or t
  modified_base (384)..(384): a, c, t, g, unknown or other
  misc_feature (384)..(384): n is a, c, g, or t
  modified_base (392)..(392): a, c, t, g, unknown or other
  misc_feature (392)..(392): n is a, c, g, or t
  modified_base (416)..(416): a, c, t, g, unknown or other
  misc_feature (416)..(416): n is a, c, g, or t
  modified_base (449)..(449): a, c, t, g, unknown or other
  misc_feature (449)..(449): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggcttgagtgggtgggatggatcaactctcacactggaagcagagtctatgcggagagattccagggcnggagtcaccctgacccanagagacanccaacgaccacagtctacatgganctgtggagcctgagacctgacgacacggccctntacttactgtcgcgacggtccctaagtcccttaacgacgtcgaacccctacttacccgaaccgtccttcgggttacccgaccgttccgtacgggggacccaaaccggggg

SEQ ID NO: 300422 - DNA, 665 bp, Homo sapiens
  misc_feature: GZ8MTXP02FLS5O.11.72.G06.1.454.CMB.2.raw
  modified_base (281)..(281): a, c, t, g, unknown or other
  misc_feature (281)..(281): n is a, c, g, or t
  modified_base (436)..(436): a, c, t, g, unknown or other
  misc_feature (436)..(436): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagcctgggcctcagtgaaggtctcctgtaaggcctcaggttacaccttcaccgctaatggtatcactggcttcgacnggcccctggacaggacttggagtggggtggatggatcaactctcacacgtggaagcagagtctagtcgacggagagacttcgaggcagacgtccaccgtacgacccaagacgacgtacactacccgaacgaacctaacacgtactacgatgggancgtggtaggacgccgtaggacgaaccgtcgggaaccgacccgtaccgggtaccccttacgttaaacgttacccggtgggttaccggaccgggtaacccgggtacccccttaacgttaccccgttaaaccggacggttacccggaaccccctaccgttacccgaaccggttccgttaccgggttacccggtaaccggttccggtaccgggggacccgtaaaccccggggg

SEQ ID NO: 300423 - DNA, 620 bp, Homo sapiens
  misc_feature: GZ8MTXP02HQ6F0.11.72.G06.1.454.CMB.2.raw
  modified_base (241)..(241): a, c, t, g, unknown or other
  misc_feature (241)..(241): n is a, c, g, or t
  modified_base (311)..(311): a, c, t, g, unknown or other
  misc_feature (311)..(311): n is a, c, g, or t
  modified_base (338)..(338): a, c, t, g, unknown or other
  misc_feature (338)..(338): n is a, c, g, or t
  modified_base (429)..(429): a, c, t, g, unknown or other
  misc_feature (429)..(429): n is a, c, g, or t
  modified_base (432)..(432): a, c, t, g, unknown or other
  misc_feature (432)..(432): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctgggcctcagtgaaggtctcctgtaaggcctnaggttacaccttcaccgctaatggtatcacctggcttcgacacggcccctggacaaggacttgagtgggnggatggatcaactctcacacgtggaancaagagtctagtcggcggaagagattccgaaggggcaggacgtcaccctgacccaacagacgactatacccaacgaaccacagtacctaanagnggacgtcgtagggtacggacgtccgtaggaccgaccgtacggacccgaaccgacccgtcccttagttacttacgtgtacgaccggtaccgtaccctacgtacccgtaacgtacgtaccgaaccctaccgtaccgtaaccgtcgttacggttacccgaccggtccgggtaccggggacccgtaaccggg

SEQ ID NO: 300424 - DNA, 637 bp, Homo sapiens
  misc_feature: GZ8MTXP02HQ66H.11.72.G06.1.454.CMB.2.raw
  modified_base (395)..(395): a, c, t, g, unknown or other
  misc_feature (395)..(395): n is a, c, g, or t
  modified_base (503)..(503): a, c, t, g, unknown or other
  misc_feature (503)..(503): n is a, c, g, or t
tcagcgagagataccacgaccggtgctcgatttagctacgactgcaagggaaaggggacccaaaaaccaccacccctccttgggagaatcccctagatcatagctcctcaccatggactggacctggagcatccttttcttggtggcagcagcaacaggtgcccactcacagggtcaactggtgcagtctggacctgagtgaagagcctgggcctcagtgaaggtctcctgtaacggcctcgaggttacaccttcaccgctaatggtatcacctgcttcgacacggcccctggacaggctgaggtgggtgggatggatcgaactctcacacgtggaaagcagacgtctagtgacggagagacgttccgagggccagacgtcacccgtcgaaccanagagacactacccacgaccatacgtactaccagtcggacgtcgtggtacggcgtacccgtagaccggacctagggaccgacgacccggttccctacgtaacgttaccncggttacgaccgggtaaccggtcccccgttactacccgttaccgacggttacgtaccccaaccgttcccaaccgggtccgttaacgggttcccgaaccggttacccggttccgggggaacccgtaacccggggg

SEQ ID NO: 300425 - DNA, 690 bp, Homo sapiens
  misc_feature: GZ8MTXP02IT9X9.11.72.G06.1.454.CMB.2.raw
  modified_base (242)..(242): a, c, t, g, unknown or other
  misc_feature (242)..(242): n is a, c, g, or t
  modified_base (354)..(354): a, c, t, g, unknown or other
  misc_feature (354)..(354): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctnaggttacaccttcaccgctaatggtatcactggcttcgacacggccctggacaggacttgagtgggtggatggatcaactctcacactggaagcagagtactagtgcggagngattccgaggggcaggcgtaccacccgtagacccaacgagaacgaccaactcccaaccgaaccaacaacgtacctaacgacgtagggaagccgtggtaggacgcccgtaggacgtaacccgtcggaaccggaacccgacccggggtacccccttacttaaccgtttaacccgtggtttacggcccgggtaacgggtcccccgttaacttacccccgtaaccggtaacgggtcccgttaaaccccaacccgttaccccgaaccggttacccggttaccgggtttacccggtaacccccgttccggttacccgggggaccccgttaaacccccggggg

SEQ ID NO: 300426 - DNA, 656 bp, Homo sapiens
  misc_feature: GZ8MTXP02IFY79.11.72.G06.1.454.CMB.2.raw
  modified_base (244)..(244): a, c, t, g, unknown or other
  misc_feature (244)..(244): n is a, c, g, or t
  modified_base (308)..(308): a, c, t, g, unknown or other
  misc_feature (308)..(308): n is a, c, g, or t
  modified_base (311)..(311): a, c, t, g, unknown or other
  misc_feature (311)..(311): n is a, c, g, or t
  modified_base (314)..(314): a, c, t, g, unknown or other
  misc_feature (314)..(314): n is a, c, g, or t
  modified_base (329)..(329): a, c, t, g, unknown or other
  misc_feature (329)..(329): n is a, c, g, or t
  modified_base (350)..(350): a, c, t, g, unknown or other
  misc_feature (350)..(350): n is a, c, g, or t
  modified_base (360)..(360): a, c, t, g, unknown or other
  misc_feature (360)..(360): n is a, c, g, or t
  modified_base (388)..(388): a, c, t, g, unknown or other
  misc_feature (388)..(388): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagccgtggggcctcgagtgaaggtctcctgtaaggcctnaggttacaccttcaccgctaatggtatcacctggctcgacaggcccctggacaggctgagtggngangancatctcacactggancaagagtctagtgcggagagnttccgaggcngacgtcacccctgaccacagacgacacncccaacgaccacgagtacaacagtacggacgacgttagggacgggtaccacccgttggaaccggtacccgttacgggaaacccgtaccggaacccgggttccccttaccgttaatttaacccgttggtaaccggccggttaccggacccctttaaccgacccttaaaccgacggtttacccgaaaccccttaccctacccgaacccggtccgtttcgggtttacccgacccggtttaccgggtccgggggacccctaaaccccggggg

SEQ ID NO: 300427 - DNA, 650 bp, Homo sapiens
  misc_feature: GZ8MTXP02GMGQS.11.72.G06.1.454.CMB.2.raw
  modified_base (281)..(281): a, c, t, g, unknown or other
  misc_feature (281)..(281): n is a, c, g, or t
  modified_base (330)..(330): a, c, t, g, unknown or other
  misc_feature (330)..(330): n is a, c, g, or t
  modified_base (335)..(335): a, c, t, g, unknown or other
  misc_feature (335)..(335): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagccgtgggcctcagtgaaggtctctgtaaggcctcaggttacaccttcacgctaatggtatcactggcttcgacnggccctgacaggctgagtgggtggatggatcaacgtctcacactggaancaagntctatggacgagagacttccgaggggacaggagtccaacccgtgaaccacgagagaacactccgaaccgacctaacacgttacaaccgtagtaggaacgtcgttaggtaggaccgaccgttacggacgaacccgttaggaacccgaaaccgaccccgggtacccttactaaacgttttaacccgtaggtaccggacggtaaccgtaccccttaatacccgtaacgtaccgtaccgtaaccctacccgtacccgtaaccgtccggttaccggttacccgtacccgttaccgggtacccggggacccgtaaccgggg

SEQ ID NO: 300428 - DNA, 636 bp, Homo sapiens
  misc_feature: GZ8MTXP02JE0O2.11.72.G06.1.454.CMB.2.raw
  modified_base (342)..(342): a, c, t, g, unknown or other
  misc_feature (342)..(342): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcactggctcgacaggccctggacaggcttgagtgggtggatggatcaactctcacacgtaggaagcagacgtntagtcgacggagacgtacgttccgaggggcaggacgtccacccgtacgaccagagacgacactacccacgacccactacgtaccacagtacggagcgtaggtcggacgtccgtagacgaccgtagaacccgacgacccggtaccctacgttacttacgtcggtacgaccggtaccgtacccgttacgtaccccgttaacgaacgttaccgaaccccaccttaccccgaaccggttcccgttacgggttacccgtacccccgttcggtacccgggggacccgtaaaccccggggg

SEQ ID NO: 300429 - DNA, 613 bp, Homo sapiens
  misc_feature: GZ8MTXP02HYA3I.11.72.G06.1.454.CMB.2.raw
  modified_base (242)..(242): a, c, t, g, unknown or other
  misc_feature (242)..(242): n is a, c, g, or t
  modified_base (260)..(260): a, c, t, g, unknown or other
  misc_feature (260)..(260): n is a, c, g, or t
  modified_base (312)..(312): a, c, t, g, unknown or other
  misc_feature (312)..(312): n is a, c, g, or t
  modified_base (338)..(338): a, c, t, g, unknown or other
  misc_feature (338)..(338): n is a, c, g, or t
  modified_base (391)..(391): a, c, t, g, unknown or other
  misc_feature (391)..(391): n is a, c, g, or t
  modified_base (401)..(401): a, c, t, g, unknown or other
  misc_feature (401)..(401): n is a, c, g, or t
  modified_base (413)..(413): a, c, t, g, unknown or other
  misc_feature (413)..(413): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctnaggttacaccttcaccgntaatggtatcacctggcttcgacacggcccctggacaaggcttgaggtgggnggatgggatcaatctcacactggaancaaggtagtcatggacgagagatccgaggggcagacgtcacccgtgaacccanagagactacnccaacgacccanagtacaacagtacgggaagtcgtgtggacgtccaggacgacctggaaccgacgacccgggtacccttacgttaacgttaccgtggtcgaccggtacggaccccttacgtaccctacgaacggtaccaaccccgtacgtccccgaaccggtccgtacggtttcccgaccgttccggtcgggggaccccgtaaaaccggggg

SEQ ID NO: 300430 - DNA, 674 bp, Homo sapiens
  misc_feature: GZ8MTXP02JRNIN.11.72.G06.1.454.CMB.2.raw
  modified_base (327)..(327): a, c, t, g, unknown or other
  misc_feature (327)..(327): n is a, c, g, or t
  modified_base (339)..(339): a, c, t, g, unknown or other
  misc_feature (339)..(339): n is a, c, g, or t
  modified_base (391)..(391): a, c, t, g, unknown or other
  misc_feature (391)..(391): n is a, c, g, or t
tcagcgagagataccacgaccggtgctcgatttagctacgactgcaagggaaaggggacccaaaaaccacacccctccttgggagaatcccctagatcatagctcctcaccatggactggacctggagaatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggacttggagtgggtggatggatcaactcncacacgtggaancagagtcagtggaccggagagtactccgagggcaggcgtccaccgtgaccanagacgacactccaacgaccaacacgtacctaacgagtagggacgccgtaggtacgggacgcccgttaggaaccggtaccgtacggaaccgaccgtacccggtccccttacgttaacgttaccgtcggtaacggaccggtaaccgggtaccccttaacgttacccgtaaaccgtacgggttaccgtaaccccacccgttacccgaaccggtccggtttccgggttaccccgtacccggttaccgggttacccgggggaccccgtaacgggggttaaaccccccg

SEQ ID NO: 300431 - DNA, 637 bp, Homo sapiens
  misc_feature: GZ8MTXP02G7FIL.11.72.G06.1.454.CMB.2.raw
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcactggcttcgacaggcccctggacaaggactgagtgggtgggatggatcaactctcacacgtggaagcagagtctagtgcggagagattccgagggcagacgtcaccctgaaccacgacgagacatacccacgaccacacgtactacatggacacgtggtaggacgtccctaggacgacccgtaggaaccgaaccgaaccgggtcccctacttaacgttaaccgtcgggttgacccgggaacgggtaccccgttaacgttacccctaaccgtaacggttaccggtaaccccaaccttaccccgaaccgtcccgttacggggtttacccggacccgttcggtccgggggtacccgtaaaccccggggg

SEQ ID NO: 300432 - DNA, 657 bp, Homo sapiens
  misc_feature: GZ8MTXP02HL1ZV.11.72.G06.1.454.CMB.2.raw
  modified_base (242)..(242): a, c, t, g, unknown or other
  misc_feature (242)..(242): n is a, c, g, or t
  modified_base (338)..(338): a, c, t, g, unknown or other
  misc_feature (338)..(338): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagccgtgggcctcagtgaaggtctcctgtaaggcctnaggttacaccttcaccgctaatgtatcactggcttcgacacggcccctggacaaggcttgaggtggtggatggatcgaactctacacacgtggaancgaagagtctagtcggacggagagtacttaccgaggggacagggacgttaccaaccctacggaaccccaacgaacggacgaaaccactacccaaacgaacccaactaacgtaccacaacgtagggaacgtcgttaggaggacgtccgtaggaacgtaccctaggaaccgaaccgaccgggtaccccttacgttaacttaccgtcggtacgaccggtaccggtacccttacgtaccccgtaatacggaccgtaccctacctaccgaaccgtccgttacggttacccgaccgtttccggacgggggtaccctaacccgggg

SEQ ID NO: 300433 - DNA, 735 bp, Homo sapiens
  misc_feature: GZ8MTXP02I1AYN.11.72.G06.1.454.CMB.2.raw
  modified_base (288)..(288): a, c, t, g, unknown or other
  misc_feature (288)..(288): n is a, c, g, or t
  modified_base (344)..(344): a, c, t, g, unknown or other
  misc_feature (344)..(344): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagccgtgggcctcagtgaaggtctccgtgtaacggcctcgaggttacaccttcaccgtctaagtgtatccacctggcttcgacncggcccctaggacaaggcttggagtgggtggatggatcaactctcacacgtggaancgagcgtctagtggacggagtagtacgttccgaagggcaggtacgtacccaacccgtacgacccaacgaagaacgaacaccgtacccaacgacccaacgtacgtacctaacaggtacggaactcgtacgggtacgggaccgtaccgttacggaacgtacccgtacgggaacccgtaaccccggacccgggttaccccttacgtttaaaccgttcgttacggggtaccggtaccggtaaccccgggtaccctttaccgttacccgttaaaccgtaacggtttaccccgaaaccccttaccccgtaacccgtaacccgggttaccgttcccgggtttaccccggtaaccccggttccggggtacccgggggaacccggttaaacccccggggg

SEQ ID NO: 300434 - DNA, 636 bp, Homo sapiens
  misc_feature: GZ8MTXP02HX5B5.11.72.G06.1.454.CMB.2.raw
  modified_base (243)..(243): a, c, t, g, unknown or other
  misc_feature (243)..(243): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagccgtggggcctcagtgaaggtctcctgtaaggcctnaggttacaccttcaccgctaatggtatcacctgctcgacacggcccctggacaaggctgagtgggtggatggatcaactctcacacgtggaagcagagtctagtcgacggagagtagttaccgaggggcaggtacgtcaacccccgtggaacccacgaaggacaaccgactacccaaccggaacccactaacgtacctaacgagtacgggacgtcgtaggtaggggactccgtaggacgaccctaggacccgtaaccaccgggtccccttaactacttaaccgttggtaccgtaccggaccggttacccctagtaccccttacgacggttaccaacctcctcccgaacgtccgttcggtacccgacttccggcgggggtaccctaaccggggg

SEQ ID NO: 300435 - DNA, 663 bp, Homo sapiens
  misc_feature: GZ8MTXP02G51TT.11.72.G06.1.454.CMB.2.raw
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagccgtggggcctcagtgaaggtctcctgtaaggcctcaggttacaccttcaccgtctaatggtatcaccgtggcttcgacacggcccctggacaaggactgaggtgggtggatggatcaactctcacacgtggaagcgagagtactagtggcgagagtacttccgaggggcagggactaccaccccgtgaacccaagagaacgaacactaacccgacgaacccaacacgtacctaacgagttagggacgtaccgtggtacggacgtccgtacggtaacgacccgtaggaaccgaaccgacccggtacccctacgttaactttaccgtgtacggccggaaccggtaccccttaagttaccccgtaacgaacggttaccgaaacccctaccgtaccccgtaaccgtaccgttacggggttacccaccgttccgggtacggggaccccgtaaacccgggg

SEQ ID NO: 300436 - DNA, 625 bp, Homo sapiens
  misc_feature: GZ8MTXP02JFI2P.11.72.G06.1.454.CMB.2.raw
  modified_base (347)..(347): a, c, t, g, unknown or other
  misc_feature (347)..(347): n is a, c, g, or t
  modified_base (354)..(354): a, c, t, g, unknown or other
  misc_feature (354)..(354): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagcctgggcctcagtgaaggtctcctgtagctcaggttacaccttcaccgctaatggtatcacctggcttcgacacggcccctggacaggacttgaggtgggtggagtggatcgaactctcacacgtggaagcagagtctagngcgaganattccgagggcagacgtccacccgtagaccagagacgacactcccacgaccacacgtctacgagtagggagtcgtggtacggacgtacgtacggacgaccgtacggaccgaccgacccggtccccttactacgttaccgtcggtacgacggtaccggtacccctagttacccgtacgtaaacggtccgaaccctaccgttacccgaacggtccgtttaccggggttacccgtacccgttccggggtccggggtacccggtaaacccggggg

SEQ ID NO: 300437 - DNA, 565 bp, Homo sapiens
  misc_feature: GZ8MTXP02GXRQ7.11.72.G06.1.454.CMB.2.raw
  modified_base (374)..(374): a, c, t, g, unknown or other
  misc_feature (374)..(374): n is a, c, g, or t
  modified_base (392)..(392): a, c, t, g, unknown or other
  misc_feature (392)..(392): n is a, c, g, or t
  modified_base (509)..(509): a, c, t, g, unknown or other
  misc_feature (509)..(509): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggacttgagtgggtgggatggatcaactctcgacacgtggaagcaagagtctatcggcggagagattccgaggggcngagtcaaccctgaaccanagagacagtacccacgaccacagtctaacgatggagctgtggagcctgacgtacctaggaccgaccgacgggtccctactaacttacctgtacgcgacggccccttaagtccctaanacgtcgaacccactccaacgtctcgggttccaccgtcgtcggggaccctaacgggg

SEQ ID NO: 300438 - DNA, 631 bp, Homo sapiens
  misc_feature: GZ8MTXP02HAC0R.11.72.G06.1.454.CMB.2.raw
  modified_base (260)..(260): a, c, t, g, unknown or other
  misc_feature (260)..(260): n is a, c, g, or t
  modified_base (337)..(337): a, c, t, g, unknown or other
  misc_feature (337)..(337): n is a, c, g, or t
  modified_base (342)..(342): a, c, t, g, unknown or other
  misc_feature (342)..(342): n is a, c, g, or t
  modified_base (386)..(386): a, c, t, g, unknown or other
  misc_feature (386)..(386): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgntaatggtatcacctggcttcgacaggcccctggacaaggacttgagtgggtggatggatcaactctcacactggaancaagngtctatcgcgagagattccgagggcagacgtcaccctgacccanagacgacactacccacgaccaacacgtactaccagtggacgtcgtggtagggacgaccgttaggaacgaccgtaggaacccgaaaccgacccgggtaccccttacgtaactttaccgtacggttacggccggtaccgggtaccccttacgtaccctacgaacgttccggaaccctacccttcccgaacggtcccgttacgggttacccgtaccggtccgtccggggggtaccctaaacccggggg

SEQ ID NO: 300439 - DNA, 634 bp, Homo sapiens
  misc_feature: GZ8MTXP02J2KS0.11.72.G06.1.454.CMB.2.raw
tcagcgagagataccacgaccggtgctcgatttagctacgactgcaagggaaaggggacccaaaaaccacacccctccttgggagaatcccctagatcatagctcctcaccatggactggacctggagcatcctttctggtggcagcagcaacaggtgcccactcacagggtcaactggtgcagtctggacctgaggtgaagagcctggggcctcagtgaaggtctcctgtaaggcctcaggttaccaccttcaccgctaatggtatcacctggcttcgacaggcccctggacaggcttgagtgggtggatggatcaactcgacacactggaagcagagtctagtcgcggagagattccgaggggtcagacgtccacccgtgaccacgagacgacactccacgaccacgagtctacacgtgggacgtccgtggtacggacgcccgtaggacgtaccgtacggaacccgaccaacccgggtccccttacgtaacgtttaccgtcggtacggaccgtaccgggtacccccttaaacctacccgtaacgaccggtaccgaacccctacccgtacccgtaaccggtccggttaccggtacccgtacccggtccgggtaccggggtacccgtaacgggg

SEQ ID NO: 300440 - DNA, 607 bp, Homo sapiens
  misc_feature: GZ8MTXP02JY0WG.11.72.G06.1.454.CMB.2.raw
  modified_base (267)..(267): a, c, t, g, unknown or other
  misc_feature (267)..(267): n is a, c, g, or t
  modified_base (307)..(307): a, c, t, g, unknown or other
  misc_feature (307)..(307): n is a, c, g, or t
  modified_base (315)..(315): a, c, t, g, unknown or other
  misc_feature (315)..(315): n is a, c, g, or t
  modified_base (360)..(360): a, c, t, g, unknown or other
  misc_feature (360)..(360): n is a, c, g, or t
  modified_base (474)..(474): a, c, t, g, unknown or other
  misc_feature (474)..(474): n is a, c, g, or t
  modified_base (531)..(531): a, c, t, g, unknown or other
  misc_feature (531)..(531): n is a, c, g, or t
  modified_base (567)..(567): a, c, t, g, unknown or other
  misc_feature (567)..(567): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtagacgtctcgtagacgtcagtacgtacctcctcactatagtgtacncctacgtgtctcgacgccgtccgtagaacgagtcgtaggnggtggggngtagtggactactactcacactgtagacgacgagtactagtacgnggagagagtaccgtacggacggacgaggtccgtacccgtaccgtacgaaccgacgaaagaacgactaccgaaccgaacccgtaaccaacgtacgttacaacgtagaacggggtntcgtagggtacgaccgtcgtacggacgtccgacgggaccacgcccgtctatactcgngtcgacgtccgtctacgtcacgcgtaccgactaccncgaacgtcgtcggtaccacggtcggaccgaccggtaccgg

SEQ ID NO: 300441 - DNA, 529 bp, Homo sapiens
  misc_feature: GZ8MTXP02FONOL.11.72.G06.1.454.CMB.2.raw
  modified_base (218)..(218): a, c, t, g, unknown or other
  misc_feature (218)..(218): n is a, c, g, or t
  modified_base (353)..(353): a, c, t, g, unknown or other
  misc_feature (353)..(353): n is a, c, g, or t
  modified_base (381)..(381): a, c, t, g, unknown or other
  misc_feature (381)..(381): n is a, c, g, or t
  modified_base (410)..(410): a, c, t, g, unknown or other
  misc_feature (410)..(410): n is a, c, g, or t
  modified_base (456)..(456): a, c, t, g, unknown or other
  misc_feature (456)..(456): n is a, c, g, or t
  modified_base (479)..(479): a, c, t, g, unknown or other
  misc_feature (479)..(479): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctnagtgaaggtctctgtaaggcctcaggttacaccttcaccgctaatggtatcactggcttcgacaggcccctggacaaggacttgagtggggtgggatggatcaactctcacactggaagcagagtctatgcgganagattccagggcagagtcacctgaccanagagacatccacgaccacagtcacatggngctgtggagcctgagacctgaacgaccacggccctacgtacttacngtcgcgacggccctataccctanacgtcgaccactccaacgcttcggttccgacctcgtcggggccaacgggg

SEQ ID NO: 300442 - DNA, 623 bp, Homo sapiens
  misc_feature: GZ8MTXP02HV6JH.11.72.G06.1.454.CMB.2.raw
  modified_base (240)..(240): a, c, t, g, unknown or other
  misc_feature (240)..(240): n is a, c, g, or t
  modified_base (337)..(337): a, c, t, g, unknown or other
  misc_feature (337)..(337): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagcctgggcctcagtgaaggtctcctgtaaggcctnaggttaccaccttcaccgtctaatgtatcacctggcttcgacaggcccctggacaaggacttggagtgggtggatggatcaactctcacactggaancagtagtctagtcgacggagagtactcgaggggcaggacgtccacccgtgaaccacgaacgacgacaactcccaacgaccaacgacgtacctacgaagtacgggagtcgtggtacggacgaccgttaggaacgtaccgtacggaaccgacgaacccggtccctacgtacttacgtcggtacgcccgtacggtcccttacgtacccttaacgacgtaccgaccctaccgtcccgtaaccgtcgttacggtcccgtaccgtaccggtcgggggtacccgaacccgggg

SEQ ID NO: 300443 - DNA, 659 bp, Homo sapiens
  misc_feature: GZ8MTXP02G4FJS.11.72.G06.1.454.CMB.2.raw
  modified_base (277)..(277): a, c, t, g, unknown or other
  misc_feature (277)..(277): n is a, c, g, or t
  modified_base (462)..(462): a, c, t, g, unknown or other
  misc_feature (462)..(462): n is a, c, g, or t
  modified_base (549)..(549): a, c, t, g, unknown or other
  misc_feature (549)..(549): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagcctggggcctcagtgaaggtctcctgtaaggctcaggttacaccttcacgctaatggtatcactgctcganggcccctggacaaggctgagtgggtggatggatcaacgtctacacacgtaggaacgtcgaagtacgtactagtcggacgggagtaagacgttaccggaaggggcagggtacgtaccgacccgtagaccaacgaagacgaaacactacccgaacgaaccactaagtacctaacgacgtagggtaanccgtaggtagggtacgaccttagggaacgacccgtagggaacccggaaccgaccccggtacccttacttaacgttaccgttgggacnccgggtaccgtacccttacgtacccgttaagaacggtccgtaaccccaaccgttaccgaaccggttacgtacgggttacccgaccttccggtacgggtccccgtaaccgg

SEQ ID NO: 300444 - DNA, 749 bp, Homo sapiens
  misc_feature: GZ8MTXP02HRHVY.11.72.G06.1.454.CMB.2.raw
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgagtgaagagctgggcctcagtgaggtctcctgtaaggcctcaggttacaccttcaccgctaatggtatcacctggcttcgacacggcccctggacaaggcttgagtgggtggagtggatcgaactctcacacgtaggaacgcagagtctagtcgcggtagagtactttaccgaggggacaggggacgttacccgacccccgttagaaccccaacgaacggaacgaaccactaccccgaacgaacccaaccgacgttactaaccgagttacggggacgtccgtggtacggggtaacgtccggttagaaccggacccgttagggaacccgaacccggacccgggtacccccttacgttaaccgtttaacgttcggggttaccgacccgggtaacccgggttaccccctttaaacgttaccccgttaaaccggtaacgggttaccccggaaaaccccgtaccccttaccccggtaacccggtcccggtttaccggggtttaccccggtaacccgtttcccggggaccgggggtacccccggtttaaaccccggggg

SEQ ID NO: 300445 - DNA, 602 bp, Homo sapiens
  misc_feature: GZ8MTXP02HM6E5.11.72.G06.1.454.CMB.2.raw
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggacttgagtgggtgggagtggatcaactctcacactaggagcagagtctatgcggagagattccgaggcagacgttttacaccctacgaccacagacgacactcccacgaccacacgtactacagtggacgcgtaggtacggacgccgtagtaacgaccgtaggaaccgaccgaccggaccctactacttacgtgtcgcggacggtcccgttactcccgtaacgacgtacgtaccctaaccgtacccgaaccgtccgttccggttaccgaacccgttccggtaccggggaccgtaaccccgggg

SEQ ID NO: 300446 - DNA, 542 bp, Homo sapiens
  misc_feature: GZ8MTXP02HLTIW.11.72.G06.1.454.CMB.2.raw
  modified_base (215)..(215): a, c, t, g, unknown or other
  misc_feature (215)..(215): n is a, c, g, or t
  modified_base (239)..(239): a, c, t, g, unknown or other
  misc_feature (239)..(239): n is a, c, g, or t
  modified_base (390)..(390): a, c, t, g, unknown or other
  misc_feature (390)..(390): n is a, c, g, or t
  modified_base (419)..(419): a, c, t, g, unknown or other
  misc_feature (419)..(419): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgagtgaagagcctgggcctnagtgaaggtctcctgtaaggcctnaggttacaccttcaccgctaatggtaatcacctggcttcgacaggcccctggacaaggacttgagtgggtgggatggatcgaactctcacacttggaagtcagagtctatgcggagagattcgagggcagacgtcacccgtgaccacaganacatcccaacgaccacagtctacatgganctgtggacgcgtagagacctgacgacaacggccctacgtatactgtcgcgacggtccctatcctacgacgtcgacctactccgaacgtctacggttcgacctcgtcggggacctaacccgggg

SEQ ID NO: 300447 - DNA, 683 bp, Homo sapiens
  misc_feature: GZ8MTXP02HH73W.11.72.G06.1.454.CMB.2.raw
  modified_base (218)..(218): a, c, t, g, unknown or other
  misc_feature (218)..(218): n is a, c, g, or t
  modified_base (285)..(285): a, c, t, g, unknown or other
  misc_feature (285)..(285): n is a, c, g, or t
  modified_base (343)..(343): a, c, t, g, unknown or other
  misc_feature (343)..(343): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcattccttttcttggtggcagcagcaacaggtgcccactcacagggtcaactggtgcagtctggacctgaggtgaagagccgtgggcctnagtgaaggtctcctgtaaggcctcgaggttacaccttcaccgctaagtggtatcacctggctcgacncggccctggacaggctgaggtgggtggatggatcgaactctcacacgtggaagcaagngtactagtcggcggagacgtacgttccgaggcaggtacgtaccgaccccgtagaaccccagaaacgtacgaacctacctacccgaaccggaacccacgtaacgtacgtaaccgaagttagggaacggtccttgggcgggaacgtccggtaggaaccgaccgtacgggaaccgaccgacccgggtcccttacgtttaacgttccgtggtacgccggtaaaccggtccccttaacgttacccgtaacgtacggttacccgaccctaccgttacccgaaccggttcgttacggggttaccccgaaccggtttccggtaccgggggtacccgtaaacccggggg

SEQ ID NO: 300448 - DNA, 614 bp, Homo sapiens
  misc_feature: GZ8MTXP02FT9EA.11.72.G06.1.454.CMB.2.raw
  modified_base (284)..(284): a, c, t, g, unknown or other
  misc_feature (284)..(284): n is a, c, g, or t
  modified_base (338)..(338): a, c, t, g, unknown or other
  misc_feature (338)..(338): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacnggcccctggacaaggactggagtgggtggatggatcgaactctcacactggaancagagtctatggcggagagattcccgaggggcaggacgtccacccgtgacccacagacgacatcccaacgaccacgagtacacagtaggatcgtggtacggacgccgtaggaacgtacccgtggaaccgaccgaccgggtcccttacgttaacgttaccgtggtcggaccggtacggtccccttaacgtcccttaacgacggttaccgaaccctaccttacccgaacgtccgttcgggtttacccacccgttcggcgggggaccctaaaccggggg

SEQ ID NO: 300449 - DNA, 623 bp, Homo sapiens
  misc_feature: GZ8MTXP02IPB1M.11.72.G06.1.454.CMB.2.raw
  modified_base (283)..(283): a, c, t, g, unknown or other
  misc_feature (283)..(283): n is a, c, g, or t
  modified_base (339)..(339): a, c, t, g, unknown or other
  misc_feature (339)..(339): n is a, c, g, or t
  modified_base (371)..(371): a, c, t, g, unknown or other
  misc_feature (371)..(371): n is a, c, g, or t
  modified_base (431)..(431): a, c, t, g, unknown or other
  misc_feature (431)..(431): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagcctggggcctcagtgaaggtctcctgtaaggcctcaggttacaccttcaccgctaatggtatcacctggcttcgacncggcccctggacaaggacttgaggtgggtggatggatcaactctcacacgtggacncagagtctatcggcggagagattccgaggacngacgtccaccctgacccagagagacactacccacgaccacagtacacagtggagcttggnggacgccgtaggacgaccgtcggaaccgaccgaccggtcccttacttaacttacgtcgtcggacccggtaacggtcccccttaaagtccccgtaaacgtacggttaccgaacccctacccttacccgaaccggtccgttacggggtttaccccgacccgttcgggtacccgggggacccgtaaacccggggg

SEQ ID NO: 300450 - DNA, 613 bp, Homo sapiens
  misc_feature: GZ8MTXP02I8WEP.11.72.G06.1.454.CMB.2.raw
  modified_base (242)..(242): a, c, t, g, unknown or other
  misc_feature (242)..(242): n is a, c, g, or t
  modified_base (335)..(335): a, c, t, g, unknown or other
  misc_feature (335)..(335): n is a, c, g, or t
  modified_base (385)..(385): a, c, t, g, unknown or other
  misc_feature (385)..(385): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctnaggttacaccttcaccgctaatggtatcacctggctcgacaggcccctggacaaggcttgagtgggtggatggatcaactctcacactggaancagagtctatgcggagagattccgagggcagacgtccaccctgacccaanacgagacatcccacgaccacacgtctaccagtaggagacgtgtaggacgcctaggacgaccctaggaccgaacccgaccggtccccttactacttaccgtggtacgccggaacggtccccttataccccgttaacgtacggttaccgaacccctaccttaccccgaacggtcccgttcgggggttaccccacccggttccggtaccgggggaccccgtaaaccggggg

SEQ ID NO: 300451 - DNA, 621 bp, Homo sapiens
  misc_feature: GZ8MTXP02G228E.11.72.G06.1.454.CMB.2.raw
  modified_base (218)..(218): a, c, t, g, unknown or other
  misc_feature (218)..(218): n is a, c, g, or t
  modified_base (282)..(282): a, c, t, g, unknown or other
  misc_feature (282)..(282): n is a, c, g, or t
tcagcgagagataccacgaccggtgctcgatttagctacgactgcaagggaaagggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcngtgaaggtctcctgtaaggcctcaggttacaccttcaccgctaatggtatcacctgcttcgacncggcccctggacaaggacttgagtgggtggatggatcaactcgtacacgacgtaggaagcaaggacgtctagtggaccgggagaggtacgttcccgaaggggccagggtacgtccaaccccgtagaacccaacgagaacgtaaccactacccgaaacgacccacacgtactaccgagtacggacgtctaggtggacgtcccgtaggacgacctggaacccgacgaacccggtccctatacgttacgtgcgccggtacggcccctagtccctacgacgtaccgaccgtacctccgaaccgtcttcggttccgaccgtccggtcggggaccctaaccgggg

SEQ ID NO: 300452 - DNA, 551 bp, Homo sapiens
  misc_feature: GZ8MTXP02JDGSX.11.72.G06.1.454.CMB.2.raw
  modified_base (388)..(388): a, c, t, g, unknown or other
  misc_feature (388)..(388): n is a, c, g, or t
  modified_base (420)..(420): a, c, t, g, unknown or other
  misc_feature (420)..(420): n is a, c, g, or t
  modified_base (425)..(425): a, c, t, g, unknown or other
  misc_feature (425)..(425): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagcctggggcctcagtgaaggtctcctgtaaggcctcaggttacaccttcaccgctaatggtatcacctggcttcgacacggcccctggacaaggcttgaggtgggtggatggatcaactctcacacgtggaagcagtagtctatgcggagagtattccgagggcagacgtccaccctgaccanagacgacactccacgaccacagtcacatggancgtgnggacgcgtgacgaccgtggaccgacgccggcccttcgtattactgcgcgacggtcccttatcccgtacacgtcaccctcaccaacgtccgttcggttccgaccgtcggtcggggtaccgaaccggg

SEQ ID NO: 300453 - DNA, 721 bp, Homo sapiens
  misc_feature: GZ8MTXP02I6MG0.11.72.G06.1.454.CMB.2.raw
  modified_base (341)..(341): a, c, t, g, unknown or other
  misc_feature (341)..(341): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagcctggggcctcagtgaaggtctcctgtaagcctcaggttacaccttcaccgctaatgtaatcacctggcttcgacacggcccctggacaaggactgaggtgggtggatggatcaactcgtacacgacgtggaacncgaagtagtctagtcggcgggagacgtacgttcccgaaggggacagggtaccgtaccaaccccgtcgaacccgaaacgagggaacgaaccacttaccccgaaccgaaaccctaacgtaacgttacctaacgaacgttagggaacgttccgtggttacggggaacgtacccggtttacggaaccggtaacccgttagggaaaccccggaaccggacccggtacccccttacgtttaaaccttacgttcggtacggcccggtaacgggtcccccttaaacgtcccgtttaaaacgacggttaccgtaaaccccaccgtttaccgaaccggtccgtttacgggttaccctacccggttacgtccgggggacctaacccggggg

SEQ ID NO: 300454 - DNA, 620 bp, Homo sapiens
  misc_feature: GZ8MTXP02HJ5PT.11.72.G06.1.454.CMB.2.raw
  modified_base (336)..(336): a, c, t, g, unknown or other
  misc_feature (336)..(336): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgagtgaagagcctgggcctcagtgaaggtctcctgtaacggctcaggttacaccttcaccgctaatggtatcacctggctcgacagggcccctggacaggacttgagtgggtgggatggatcaactctcactactggaacncaagagtctaagtcggacgggagacgattaccgaggggcaggacgtacaccccgtagacccaacagggaacgacactacccaacgaccaacgacgtactacgaatcgggaagcgtggcggacgcgttacggacgtaccgtacgggaaccgacccgacggtccccttactacgttacttcgggacgaccgtaacggccccttatacccgtaacgtacgttacgacccaccgttccgaaccgtcgtaccggttccgaccgttccggtacgggggacccaaccgggg

SEQ ID NO: 300455 - DNA, 622 bp, Homo sapiens
  misc_feature: GZ8MTXP02H4QO5.11.72.G06.1.454.CMB.2.raw
  modified_base (243)..(243): a, c, t, g, unknown or other
  misc_feature (243)..(243): n is a, c, g, or t
  modified_base (331)..(331): a, c, t, g, unknown or other
  misc_feature (331)..(331): n is a, c, g, or t
  modified_base (339)..(339): a, c, t, g, unknown or other
  misc_feature (339)..(339): n is a, c, g, or t
tcagcgagagataccacgaccggtgctcgatttagctacgactgcaagggaaagggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagccgtggggcctcgagtgaaggtctcctgtaaggcctnaggttacacttcaccgctaatggtatccacctggcttcgacacggcccctggacaggcttggagtgggtggatggatcaactctcacnctgggaancaaggtagtctagtcggcggaagtagacttccgaaggggcagacgtcaccccgtgaacccacgagagaccatcccgaacgacctacacgtctaacgagtggacgtcgtaggtcggacgtccgtaggacgtacccgtggaacccggacacccgggtcccttacgtaacgtttaccgtgtacggaccgtacggtacccccttagtccctaaacgcgttaccgaaccctactacccgaacgtcgttacgggttcccgacttccgggaccggggacccgaaccgggg

SEQ ID NO: 300456 - DNA, 629 bp, Homo sapiens
  misc_feature: GZ8MTXP02JRN8S.11.72.G06.1.454.CMB.2.raw
  modified_base (242)..(242): a, c, t, g, unknown or other
  misc_feature (242)..(242): n is a, c, g, or t
  modified_base (337)..(337): a, c, t, g, unknown or other
  misc_feature (337)..(337): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctnaggttacaccttcaccgctaatggtatcacctggcttcgacaggcccctggacaaggcttgagtgggtggatggatcaactctcacacgtggaancagagtctagtcgcggagagagttccgaggggcagacgtcacccgtagaccacgagacgacactacccacgaccactacgtactacagtacggagcgtgtacgggagtccgtaggaacgaccgtaggaaccgaccgacccggtacccttacgttaacttacgtcgtacgccggtaccggtacccttacgtacccgtaaacgtacggttaccgaaccctaccgtacccgaaccggtccgtttaccggggttaccctacccgttccggggtaccggggacccgtaaacccgggg

SEQ ID NO: 300457 - DNA, 609 bp, Homo sapiens
  misc_feature: GZ8MTXP02JFA14.11.72.G06.1.454.CMB.2.raw
  modified_base (282)..(282): a, c, t, g, unknown or other
  misc_feature (282)..(282): n is a, c, g, or t
  modified_base (427)..(427): a, c, t, g, unknown or other
  misc_feature (427)..(427): n is a, c, g, or t
  modified_base (497)..(497): a, c, t, g, unknown or other
  misc_feature (497)..(497): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcactggctcgacnggccctggacaggcttgagtgggtggatggatcaactctcacactggaagcagagtctatggacggagagattcccgaggggcaggatccgaccctgacccacagacgaacactacccacgacccacagtactacacgtaggacncgtggtagggaacgtccgttaggacgaccctagggaacccgaccgacgggtccccctagtaactttccgngtcgcggaacggtccctatccctaacgacggtccaaccctaccgttaccccaacggttcccgttacgggtttacccgacccgtttcggaccgggggaccctaaacccggggg

SEQ ID NO: 300458 - DNA, 593 bp, Homo sapiens
  misc_feature: GZ8MTXP02F9X0B.11.72.G06.1.454.CMB.2.raw
  modified_base (286)..(286): a, c, t, g, unknown or other
  misc_feature (286)..(286): n is a, c, g, or t
  modified_base (460)..(460): a, c, t, g, unknown or other
  misc_feature (460)..(460): n is a, c, g, or t
  modified_base (506)..(506): a, c, t, g, unknown or other
  misc_feature (506)..(506): n is a, c, g, or t
  modified_base (516)..(516): a, c, t, g, unknown or other
  misc_feature (516)..(516): n is a, c, g, or t
  modified_base (534)..(534): a, c, t, g, unknown or other
  misc_feature (534)..(534): n is a, c, g, or t
  modified_base (546)..(546): a, c, t, g, unknown or other
  misc_feature (546)..(546): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcgagtgaaggtctcctgtaaggcctcaggttacaccttcaccgctaatggtactcacctggcttcgacncggccccgtggacaaggcttgagtggggtggagtggatcaacctctcacacgtggaagcaagagtcgtatcggcgagagagttccgagggtcaggacgtacctacccgtacgaacccagacgacgaaccacgtacccaaccgaacccacgacgttacaaccgaagtcgggaacncgtaggtagggactccgtagacgacctagaccgaccgccgaccctnttactactgngccgacgtcccatccganacgtaccgaccncgtccgaaccgtcgtacggttcaccgttcggaccggacgtaaccggg

SEQ ID NO: 300459 - DNA, 715 bp, Homo sapiens
  misc_feature: GZ8MTXP02GSD4I.11.72.G06.1.454.CMB.2.raw
  modified_base (279)..(279): a, c, t, g, unknown or other
  misc_feature (279)..(279): n is a, c, g, or t
  modified_base (307)..(307): a, c, t, g, unknown or other
  misc_feature (307)..(307): n is a, c, g, or t
  modified_base (339)..(339): a, c, t, g, unknown or other
  misc_feature (339)..(339): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtcgcccactcacagggtcaactggtgcagtctggacctgaggtgaagagccgtgggcctcagtgaaggtctcctgtaaggcctcgagttacaccttcaccgctaatgtatcactgctcgcncggccctggacaggtctgagtgggtggntggatcgaactctacacacgtaggaagcaagngttacgtatcggacggagacgagttccgaggggcaggtacgtccacccgtagacccaacgacggaacgacctaactacccgaaccgaaccctaacgtaacgtccctaaactacgttagggaacgtccgttaggtacgggacgtcccggtaggaaccgtacccgttacgggaaccccggtaacccggtaccccggttacccctttaccgttaaccgtttaccgtacgggttacggaccccggttaaaccgggtcccccttaaacgttaccccgtaacggtaacggttacccgaacccctacccgtacccgtaaccggtccgtttaccgggtttaccgaccccggttcgggtaccgggggtaccccgtaacccggggg

SEQ ID NO: 300460 - DNA, 656 bp, Homo sapiens
  misc_feature: GZ8MTXP02JUI56.11.72.G06.1.454.CMB.2.raw
  modified_base (282)..(282): a, c, t, g, unknown or other
  misc_feature (282)..(282): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcactggctcgacncggcccctggacaaggctgagtggggtggatggatcaactctacacacgtggaagcagagtctatcggcggagagtacttaccgaaggacagacgtccacccgtagaccaacgagacgaacactacccgaaccgaccacacgtacaaccgagtagggacgtcgttaggtacgggacgtccgtaggaaccgtaccgtacgggaacccgaaccgtaccccggtacccgttacgttacgttaaccgtcggtacgaccggtacccggtaccccttacttacccgtaccgtaacgtacccgtaaccccgaccttacccgtaaccggtaccgttacgggttacccgtacccgtttaccgttcgggtaccggtaaccccgg

SEQ ID NO: 300461 - DNA, 680 bp, Homo sapiens
  misc_feature: GZ8MTXP02JLO04.11.72.G06.1.454.CMB.2.raw
  modified_base (241)..(241): a, c, t, g, unknown or other
  misc_feature (241)..(241): n is a, c, g, or t
  modified_base (309)..(309): a, c, t, g, unknown or other
  misc_feature (309)..(309): n is a, c, g, or t
  modified_base (336)..(336): a, c, t, g, unknown or other
  misc_feature (336)..(336): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagcctggggcctcagtgaaggtctcctgtaaggcctnaggttacaccttcaccgctaatggtatcacctggcttcgacacggccctggacaaggcttgagtgggnggatggatcgaactctcacactggaancagagtctaatcggcggagagtattccgagggcaggacgtaccacccgtgaacccacgaaagacgaaacactaccccaaacgaaccccacgaacgtacctacgaacgtcgggaacgtaccgtggtacgggaccgtccggtacggtacgtaaccggtcggaaaccgtaaccccggacccgggacccctttacgtaacgtttaacccgtggttacggcccggtaacggtacccccttaactaccccgtaacgtaacggttaccgaaacccctacccgttacccgaaccggtcccgttacggggttcccaacccggttcggtacccgggggaccctaaacccggggg

SEQ ID NO: 300462 - DNA, 571 bp, Homo sapiens
  misc_feature: GZ8MTXP02F8KV8.11.72.G06.1.454.CMB.2.raw
  modified_base (242)..(242): a, c, t, g, unknown or other
  misc_feature (242)..(242): n is a, c, g, or t
  modified_base (259)..(259): a, c, t, g, unknown or other
  misc_feature (259)..(259): n is a, c, g, or t
  modified_base (282)..(282): a, c, t, g, unknown or other
  misc_feature (282)..(282): n is a, c, g, or t
  modified_base (442)..(442): a, c, t, g, unknown or other
  misc_feature (442)..(442): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctnagttacaccttcaccgntaatggtatcacctggctcgacncggcccctggacaaggacttgagtgggtgggatggatcaactctcacactggaagcaagagtctatggacggagagtacttccgaggggcaggacgtccaccctgaccaacgagacgacatacccaacgaccactagtactactaagtggagtcgtaggnggaacgccgtagacgacctagaaccgacaccggtccctagttacttacgtgtcggcgacggtccctactcctaacgacgtacacctactccaacgtctacggtaccgccgtcggtcgggaccaaccggg

SEQ ID NO: 300463 - DNA, 636 bp, Homo sapiens
  misc_feature: GZ8MTXP02IEM2N.11.72.G06.1.454.CMB.2.raw
  modified_base (215)..(215): a, c, t, g, unknown or other
  misc_feature (215)..(215): n is a, c, g, or t
  modified_base (237)..(237): a, c, t, g, unknown or other
  misc_feature (237)..(237): n is a, c, g, or t
  modified_base (250)..(250): a, c, t, g, unknown or other
  misc_feature (250)..(250): n is a, c, g, or t
  modified_base (278)..(278): a, c, t, g, unknown or other
  misc_feature (278)..(278): n is a, c, g, or t
  modified_base (550)..(550): a, c, t, g, unknown or other
  misc_feature (550)..(550): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcattccttttcttggtggcagcagcaacaggtgcccactcacgagggtcaactggtgcagtctggactgagtgaagagcgtgggctnagtgaggtctcgtgtaacgctnacggttacacttnaccgtataagtgtatcacgtgctcgacncggccctaggacaggtactgaggtgggtggagtggatacaacgtctacgacacgtggaacgcgagtagtcgtagtcggacggagacgtacgttacggagggacacgtacgtaccaaccctagaacccagaaacgacgaactacacccgaacaccacacgtactactaggtacgacgtcgtggtacggacgtaccgtgtaacggacctacgggaacccgtacgaacccggtaccctacttagttaccgtggtacgaccggtacgaccctttanacccgtagaccgtaccgacctacccgttacgaacccggttcgttaccggtaccgaccgttcgggacccgggtaccgtaacccgggg

SEQ ID NO: 300464 - DNA, 587 bp, Homo sapiens
  misc_feature: GZ8MTXP02I3V1B.11.72.G06.1.454.CMB.2.raw
  modified_base (411)..(411): a, c, t, g, unknown or other
  misc_feature (411)..(411): n is a, c, g, or t
  modified_base (472)..(472): a, c, t, g, unknown or other
  misc_feature (472)..(472): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagcctggggcctcagtgaaggtctcctgtaaggcctcaggttacaccttcaccgctaagtggtatcactggcttcgacacggcccctggacaggactggagtgggtggatggatcaactctcacacgtggaagcagagtctatggacggagagtacgttccgaggggcagggacgtccaacccgtgaacccacgaaggacaacgacncccaacgaaccacacgtactacagtggacgtcgtggtacggacgtccgtaggacgtaccgngaacccgaccgaccgcccttactactcgtagtcgcgacgtccctagtccctacgcgtacgacctacaccaacgtcgtacggttaccgaccttcggtaccgggaccgtaaccgggg

SEQ ID NO: 300465 - DNA, 548 bp, Homo sapiens
  misc_feature: GZ8MTXP02GPO92.11.72.G06.1.454.CMB.2.raw
  modified_base (328)..(328): a, c, t, g, unknown or other
  misc_feature (328)..(328): n is a, c, g, or t
  modified_base (422)..(422): a, c, t, g, unknown or other
  misc_feature (422)..(422): n is a, c, g, or t
  modified_base (462)..(462): a, c, t, g, unknown or other
  misc_feature (462)..(462): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggacttgagtgggtggatggatcaacgtctnacactggaagcagagtctatcgacggagagattccaggggcagacgtcacccgtgaccacaagagacatcccgacgaccacagtcaacatgganctgtggagcctgagaccgtgacgacacggcctctattacngtgcgaggcccctagtcctacgagtacgacccactacccaacgtctacgggtttacgacccgttcgtcgggggacctaaaccgggg

SEQ ID NO: 300466 - DNA, 563 bp, Homo sapiens
  misc_feature: GZ8MTXP02FN8KH.11.72.G06.1.454.CMB.2.raw
  modified_base (338)..(338): a, c, t, g, unknown or other
  misc_feature (338)..(338): n is a, c, g, or t
  modified_base (354)..(354): a, c, t, g, unknown or other
  misc_feature (354)..(354): n is a, c, g, or t
  modified_base (390)..(390): a, c, t, g, unknown or other
  misc_feature (390)..(390): n is a, c, g, or t
  modified_base (420)..(420): a, c, t, g, unknown or other
  misc_feature (420)..(420): n is a, c, g, or t
tcagcgagagataccacgaccggtgctcgatttagctacgactgcaagggaaaggggacccaaaaaccacacccctccttgggagaatcccctagatcatagctcctcaccatggactggacatggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggcttgaggtgggtgggatggatcaactctcacactggaancagagtcagtgcgganagattcccgagggcagacgtccacccgtgaacccanagacgacactccaacgaccacagtacctanacgtggagctaggtcggacgccgtgacgaccgtagaacccgacgaccggtccctactacttacgtcgtacgcgacggtccctactacccgtacacgtacgacctactccgacgtcgtacggtccaccgtcgtcgggaacccgg

SEQ ID NO: 300467 - DNA, 613 bp, Homo sapiens
  misc_feature: GZ8MTXP02FJUGS.11.72.G06.1.454.CMB.2.raw
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacacggcccctggacaaggacttggaggtgggtggatggatcaactctcacacgtggaagcagatctatcgacgagagacttccgaaggggcaggacgtccaacccgtgaacccaagagaacgacactcccacgaccacagtcacgagtggagctggtggagcctaggacgacctaggaaccgaccgaccggtccccttattacgttacgtcgtacggaccgacggtacccccttaagtccccttaaacgacggttaccgaaccctacctacccgaacgtccgttcggtttacccgaccgttccgggtaccggggacccgtaaacccggggg

SEQ ID NO: 300468 - DNA, 682 bp, Homo sapiens
  misc_feature: GZ8MTXP02JDSLL.11.72.G06.1.454.CMB.2.raw
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagccgtggggcctcgagtgaaggtctccgtgtaacggcctcgaggttaccaccttcaccgtctaatggtatcacctggctcgacaggccctggacaggctgagtgggtggatggatcaactctcactacgtggaagcagagtctagtcggacggagagtacttcgaggggtcaggtactccgacccgtcgaaccaacgagacgaacacgtacccacgaaccacacgtacacagtacggagtccgtgtacgggaacgtccgtaggaaccgaccgtacggaaccgaccgtaacccggtacccttacgttaacgttacgttcggtacggtaccggtaccgggtaccccttacgtacccgttaaccgtacggttcccggtaaacccctacccgttacccgaacccggttaccggtttaacccgggttcccggtaaaccccgttccggggtaaccgggggtaccccgttaaaaccccggggg

SEQ ID NO: 300469 - DNA, 574 bp, Homo sapiens
  misc_feature: GZ8MTXP02GODKC.11.72.G06.1.454.CMB.2.raw
  modified_base (285)..(285): a, c, t, g, unknown or other
  misc_feature (285)..(285): n is a, c, g, or t
  modified_base (375)..(375): a, c, t, g, unknown or other
  misc_feature (375)..(375): n is a, c, g, or t
  modified_base (384)..(384): a, c, t, g, unknown or other
  misc_feature (384)..(384): n is a, c, g, or t
  modified_base (399)..(399): a, c, t, g, unknown or other
  misc_feature (399)..(399): n is a, c, g, or t
  modified_base (428)..(428): a, c, t, g, unknown or other
  misc_feature (428)..(428): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtaatcacctggcttcgacncggcccctggacaaggcttgagtgggtggatggatcaacgtctacaacacgtggaacgcagagtctagtgcggagagtattccgagggcngagtcaccngacccagagacacanacccacgaacactagtacacagtggacgngtgtggacgcgtacgacgacgacgacgacgaccgtacctactacgtacgtcgtcgacgacgtaccgtactaccgtacgtacgtaccgtaccgtacctccgtaaccgtcgtacgtaccgtaccgtacggtaccggtaccggaaccgg

SEQ ID NO: 300470 - DNA, 546 bp, Homo sapiens
  misc_feature: GZ8MTXP02FGLKM.11.72.G06.1.454.CMB.2.raw
  modified_base (217)..(217): a, c, t, g, unknown or other
  misc_feature (217)..(217): n is a, c, g, or t
  modified_base (241)..(241): a, c, t, g, unknown or other
  misc_feature (241)..(241): n is a, c, g, or t
  modified_base (363)..(363): a, c, t, g, unknown or other
  misc_feature (363)..(363): n is a, c, g, or t
  modified_base (396)..(396): a, c, t, g, unknown or other
  misc_feature (396)..(396): n is a, c, g, or t
  modified_base (408)..(408): a, c, t, g, unknown or other
  misc_feature (408)..(408): n is a, c, g, or t
  modified_base (413)..(413): a, c, t, g, unknown or other
  misc_feature (413)..(413): n is a, c, g, or t
tcagcgagagataccacgaccggtgctcgatttagctacgactgcaagggaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctnagtgaaggtctcctgtaaggcctnaggttacaccttcaccgctaatggtatcacctggcttcgacaggcccctggacaaggctgagtgggtggatggatcgaactctcacactggaagtcagagtctatgcgagagattccagggnagagtcacctgaccacagagacatccacgacanagtcacatggancgtgngagctgagaccgtgacgaccgaccggtccctatacttacgtgtcgacgacgtaccctatacccgtacacgtccgaacccactacccgaacgtccgttacggtaccgaccgttcggacggggacccgaacgggg

SEQ ID NO: 300471 - DNA, 671 bp, Homo sapiens
  misc_feature: GZ8MTXP02IBQTI.11.72.G06.1.454.CMB.2.raw
  modified_base (245)..(245): a, c, t, g, unknown or other
  misc_feature (245)..(245): n is a, c, g, or t
  modified_base (317)..(317): a, c, t, g, unknown or other
  misc_feature (317)..(317): n is a, c, g, or t
  modified_base (445)..(445): a, c, t, g, unknown or other
  misc_feature (445)..(445): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcattccttttcttggtggcagcagcaacaggtgcccactcacagggtcaactggtgcagtctggacctgaggtgaagaagccgtggggcctcagtgaaggtctccgtgtaaggcctnaggttaccacttcaccgtctaatggtactcacctggctcgacacggcccctaggacaggcttggaggtgggnggagtggatcgaactctacaacgacgtaggaagcaaggtacgtcgtagtccggacggaagtacgtagttaccggagggcaggacgtacacccctagaacccagaagacgaacacacccaacgaccaanacgtacgtacagtggaacgtcgtaggaccgggaaccgacccggacgtaacccgtacgggaacccgtaccgacccggtacctacgttacgttaacgtcggtaccggaccggtaaccggtccccttaagtaccccggtaactaccggtaccgaaccctacccgtccgaacggtccggttcggttacccgacccggttccggacggggacccgtaaccgggtaccccgg

SEQ ID NO: 300472 - DNA, 664 bp, Homo sapiens
  misc_feature: GZ8MTXP02F0M13.11.72.G06.1.454.CMB.2.raw
  modified_base (288)..(288): a, c, t, g, unknown or other
  misc_feature (288)..(288): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagccgtggggcctcagtgaaggtcctcctgtaaggcctacaggttacacccttcaccgctaatggtatcacctggcttcgacncggccctggacaaggcttggagtgggtggatggatcgaactctacacacgtggaacgcagtacgtactagtcggacggagtagtacgttccgaaggtacaggacgtcccaacccgtacgaacccagtaacggaacgaaccgactacccgaacgaacccaacgtaaacgtcctaacgtaagtacgggacgtcgtagggttacgggaacgtccgtagggaacgaaccgaacggaccgaaaccgacccggtacccttattaacgttacgtaggtcgcggtaaccggtcccttacgtccctaacgtacgtaccgaacctacccgtactaaccgtcgttacggttaccgacccgttcggtaccggggacccgtaaccgggg

SEQ ID NO: 300473 - DNA, 617 bp, Homo sapiens
  misc_feature: GZ8MTXP02HQE5F.11.72.G06.1.454.CMB.2.raw
  modified_base (240)..(240): a, c, t, g, unknown or other
  misc_feature (240)..(240): n is a, c, g, or t
  modified_base (334)..(334): a, c, t, g, unknown or other
  misc_feature (334)..(334): n is a, c, g, or t
  modified_base (410)..(410): a, c, t, g, unknown or other
  misc_feature (410)..(410): n is a, c, g, or t
  modified_base (433)..(433): a, c, t, g, unknown or other
  misc_feature (433)..(433): n is a, c, g, or t
  modified_base (455)..(455): a, c, t, g, unknown or other
  misc_feature (455)..(455): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgccaactcacagggtcaactggtgcagtctggacctgaggtgaagaagcctgggcctcagtgaaggtctcctgtaagcctnaggtacaccttcaccgctaatggtatcactggcttcgacaggcccctggacaaggactgagtgggtgggatggatcaactcgtcacactggaancgagagtctagtcgacggagagacttccgaggggcagcgtcaccctgaacccacagtacgacatacccacgaccanacgtctacagtacggagcgtagnggacgccgtaggaagtacccgnggaaacccgaccgaccgggaccccttacttaaacgttaccgtcggtagacccgggtaccggtacccccgtttaaatccccggttaaacacggtccgaacctacctaccgaaccgtcgtacggtttcccgaaccgtttccggcggggtaccccgaaaccgggg

SEQ ID NO: 300474 - DNA, 637 bp, Homo sapiens
  misc_feature: GZ8MTXP02HIRCQ.11.72.G06.1.454.CMB.2.raw
  modified_base (217)..(217): a, c, t, g, unknown or other
  misc_feature (217)..(217): n is a, c, g, or t
  modified_base (239)..(239): a, c, t, g, unknown or other
  misc_feature (239)..(239): n is a, c, g, or t
  modified_base (257)..(257): a, c, t, g, unknown or other
  misc_feature (257)..(257): n is a, c, g, or t
  modified_base (375)..(375): a, c, t, g, unknown or other
  misc_feature (375)..(375): n is a, c, g, or t
  modified_base (523)..(523): a, c, t, g, unknown or other
  misc_feature (523)..(523): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgagtgaagaagcctggggcctnagtgaaggtctctgtaaggctnaggttacaccttcaccgntaatggtatcacctggcttcgacaggcccctggacaaggcttgagtgggtggatggatcgaactctacacacgtggaacgcgagtacgtctagtcggcggagagacttccgagggacngacggtccaacccgtagacccaacgaggaacgaacccagtacccaacccgacctaacacgtaacctacgagttacgggaacgtcgtcgggtagacgtccgtaggaacgacccgtaggaccgacccgaccggtcctacttaacgtacgngttacggccgtaacggtcccttactacccgttacgacgttaccgaccctaccgttacccgaacggtccttacgggttacctacccgtccggtacgggggaccctaacccggggg

SEQ ID NO: 300475 - DNA, 728 bp, Homo sapiens
  misc_feature: GZ8MTXP02IS8SS.11.72.G06.1.454.CMB.2.raw
  modified_base (279)..(279): a, c, t, g, unknown or other
  misc_feature (279)..(279): n is a, c, g, or t
  modified_base (298)..(298): a, c, t, g, unknown or other
  misc_feature (298)..(298): n is a, c, g, or t
  modified_base (312)..(312): a, c, t, g, unknown or other
  misc_feature (312)..(312): n is a, c, g, or t
  modified_base (315)..(315): a, c, t, g, unknown or other
  misc_feature (315)..(315): n is a, c, g, or t
  modified_base (323)..(323): a, c, t, g, unknown or other
  misc_feature (323)..(323): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgagaagcctggggcctcagtgaaggtctcctgtaaggctcaggttacaccttcaccgctaatggtatcactgctcgacngccctgacagctgagtggnggatggatcactcncanactggaancgagagtctatcggacggagagtacttccgaggggcaggacgtaccaccccgttcgaacccacgaacggacgaacctacgtacccgaaccgaacccacgtacggttacctaaccgagttacgggacgtacgttagggtacgggaaaccggtcccgtagggaaccgtaccccggttagggaaaccccgtaacccggacccgggtacccctttacgtttaaaccgtttaccggtacgggttacgggacccgggtaaccgggtaccccccttaaacgttcccccgtaaaacgggtaccgttacccgaacccccttaacccgttaccccgtaaaccggtcccgttaccggggtttacccccggaccgtttacccggggtacccgggggtacccctaaaaccccgggggg

SEQ ID NO: 300476 - DNA, 660 bp, Homo sapiens
  misc_feature: GZ8MTXP02HV93Q.11.72.G06.1.454.CMB.2.raw
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctctgtaaggcctcaggttacaccttcaccgctaaatggtatcacctggcttcgacaggcccctggacaaggcttgagtggtggatggatccgaactcttacacactggaagcaggacgtctagtcgacgggagtagattcccgaggggccagggtacgtaccaccccgttggacccacgaagacaccgatcccaaccgaccacaggttactacgatgggaacgccgttaggtgggacgtccgttaggacgaaccccgttgggaacccgtaccgaaccggggaccccctttacggtatttaacccgtggttacgcccggtacgggacccctttaacgtcccgtaacgtaacggttccgaaaccgtacccttacccgaacggtccgtacgggtttcccgacccgttccggttcgggggaccccgaaaccggggg

SEQ ID NO: 300477 - DNA, 653 bp, Homo sapiens
  misc_feature: GZ8MTXP02HO8B5.11.72.G06.1.454.CMB.2.raw
  modified_base (258)..(258): a, c, t, g, unknown or other
  misc_feature (258)..(258): n is a, c, g, or t
  modified_base (308)..(308): a, c, t, g, unknown or other
  misc_feature (308)..(308): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctgggcctcagtgaagtctcctgtaaggcctcaggttacaccttcaccgntaatggtatcacctggcttcgacaggcccctggacaggacttgagtgggnggatggatcaactctcacagtggaagcagtagtctatcggacggagagtaacttcgaggggcaggtagtccaccctgaacccacgacgacgacacgtcccaacgaacccacacgtactacctagtcggaacgtcctgggtacggacgtccgttacggaacgtacccgtacggaaccgtaacccgaacccggtccccttaacgtaagtttaacccgtcgtacggacgtaccgggtacccttaacgtacccgtaacgtacggttccgaaaccctccgtaccctaaccggtccgttccggtttacccgaacccgttccgggttacgggggacccgttaaacccggggg

SEQ ID NO: 300478 - DNA, 637 bp, Homo sapiens
  misc_feature: GZ8MTXP02FXA7T.11.72.G06.1.454.CMB.2.raw
  modified_base (242)..(242): a, c, t, g, unknown or other
  misc_feature (242)..(242): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctnaggttacaccttcaccgctaatggtatcactggcttcgacaggcccctggacaaggcttgaggtgggtggatggatcgaactctcacactggaagcagagtctagtcggacggagagtacttccgaggggaccagggacgtaccaccccgtagaacccaacgaggacgacactacccaacgaccactacgtacacgatggacacgtgtacggacgccgtagacgaccgtacggaaccgaaccgaccggtaccctacgttaacttacgtacggtacgcggtaaccggtcccttacgtacccgtaacgtacgttaccgaaccctaccgttacccgaaccggtcgttacgggttacccgtacccggttacggtaccgggggacccgtaaacccggggg

SEQ ID NO: 300479 - DNA, 747 bp, Homo sapiens
  misc_feature: GZ8MTXP02JFTX4.11.72.G06.1.454.CMB.2.raw
  modified_base (315)..(315): a, c, t, g, unknown or other
  misc_feature (315)..(315): n is a, c, g, or t
  modified_base (342)..(342): a, c, t, g, unknown or other
  misc_feature (342)..(342): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagctgggcctcagtgaggtctcctgtaaggcctcaggttacaccttcaccgtactaatggtactccgactggcttcgacacggcccctaggacaaggtacttgaggtgggnggatggatcaactctcacacgtggaancagtactctagcggtaccggagtacgacgtttacccgaggggtacaggtcggttaccaacccccgtaggaaccccaacgtaaacgggacgaaacccgtactaacccccgaaccggaacccaaacgtaacgggttaccctaaccgtaaaggtcggggtaactccggtttaggacggggtaccgacccggttacggaaacccgggtaccgttacgggaaacccggaacccgaaaccccgggtaccctttaccgttaaacgttacccgtggttaccggaccggtaaccggtaccccttaaaccggtcccttaaacgcggttacccgaaacccctcgtaaaccccgtgtcccggttacggtttaccccgaaccgttcccggggtacggggtacccgtaaaacccggggg

SEQ ID NO: 300480 - DNA, 528 bp, Homo sapiens
  misc_feature: GZ8MTXP02FH1QL.11.72.G06.1.454.CMB.2.raw
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggactgagtgggtggatggatcaactctcacactggaagcagagtctatgcggagagattccgaggggcagagtcaccctgaccacagagacatcccacgaccacagtctacatggagctgtggagcctgagacctagacgacacggccctcgtatactgtcgcgacggccctagtccctacacgtcgaccactccaacgctcggttcgacctcgcggggtccaaccgggg

SEQ ID NO: 300481 - DNA, 707 bp, Homo sapiens
  misc_feature: GZ8MTXP02HY6SF.11.72.G06.1.454.CMB.2.raw
  modified_base (217)..(217): a, c, t, g, unknown or other
  misc_feature (217)..(217): n is a, c, g, or t
  modified_base (240)..(240): a, c, t, g, unknown or other
  misc_feature (240)..(240): n is a, c, g, or t
  modified_base (340)..(340): a, c, t, g, unknown or other
  misc_feature (340)..(340): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgagtgaagaagccgtgggcctnagtgaaggtctctgtaaggcctnaggttacaccttcaccgctaatggtatcacctggcttcgacacggcccctggacaggacttgaggtgggtggagtggatacaactctacacagtaggaancgaagagtcgtagtcggacgggagtacggtacttccggaggggacaggtacggtccaaccctagaacccaacgaagacgaaccacgacccaacccgaccaacgagtacctaaccgagtacgggaacgtcgttagggagggtacgtcccgtagggaaccgtacccgtacgggaacccgaaccgtaaccccgggcccccttaacgtttacgtttaacccggtcggtcggacccgggtaccgtacccctttaaccgtacccgtaaaccgtaccggtacccgaacccgttacccgtacccggtaaccgttcccgtttaccggggttacccgacccgtttccggggtaaccggggaccccggtaacccgggg

SEQ ID NO: 300482 - DNA, 649 bp, Homo sapiens
  misc_feature: GZ8MTXP02H05I4.11.72.G06.1.454.CMB.2.raw
  modified_base (308)..(308): a, c, t, g, unknown or other
  misc_feature (308)..(308): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagccgtggggcctcagtgaaggtctcctgtaaggcctcaggttacaccttcaccgctaatggtactcactggctcgacaggccctggacaggcttgagtgggnggatggatacaactctacacacgtggaacgcaagtagtactagtcgacgggagacgtacttccgaggggtccaggacgttccacccgtagacccacagacgacactacccacgaccacacgttacacgagtacggacgtcgtggtacgggacgccgttaggaacgtacccgtggaacccgaccgaccgggtacccctttataacgttacgtcggtacgaccgggtaccggtccccttaactacccgttaacgaacggttccgaaacccctacctacccggaaccgtcccgttacgggttacccctaacccggtccggtaccgggggtaccgtaacccgggg

SEQ ID NO: 300483 - DNA, 611 bp, Homo sapiens
  misc_feature: GZ8MTXP02FY3CU.11.72.G06.1.454.CMB.2.raw
  modified_base (335)..(335): a, c, t, g, unknown or other
  misc_feature (335)..(335): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcactggcttcgacaggcccctggacaaggcttgagtgggtggatggatcaactctcacactggaancagagtctatcgacggagagtacttccgaggggcagacgtccaaccgtgaacccagagagaccatcccgaacgaccaacagtactaacattagggagtccgtggtacgggacgcccgttggaacgtacccgtgggaacccgaccgacccgggtaccctacgttaacttacgtgtacggccgaacggtcccctagtccctaaacgacgttacgaaccctactcccgaacgtccgttcggttaccccgacttcggtacgggggaccctaaaccggggg

SEQ ID NO: 300484 - DNA, 663 bp, Homo sapiens
  misc_feature: GZ8MTXP02G0L93.11.72.G06.1.454.CMB.2.raw
  modified_base (290)..(290): a, c, t, g, unknown or other
  misc_feature (290)..(290): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagccgtggggcctcgagtgaaggtctccgtgtaacggcctcaggttaccaccttcaccgctaagtggtactcacctggcttcgacncggcccctggacaggactgaggtggggtggagtggatcaactctcacacgtaggacgacgagagtactagtacggacggagacgtacgttcccggagggtaccgaggtacgtaccctaaccccgtagaacccacgaaacggaacgaaccacgtacccaacgaacccgacacgtactacgaagtacggagcgtacgggtacggacgcgtacggaacgtccgtaggaccgacccgaccggtacccttacgtaactttacgtacgtcggccgtacggtaccctactccgtaaacgtacgtccggaaccctaccgttacccgaacggtccgttaccgggtcctaccggtccggtaccggggtaccgtaaccccgggg

SEQ ID NO: 300485 - DNA, 709 bp, Homo sapiens
  misc_feature: GZ8MTXP02JLNXM.11.72.G06.1.454.CMB.2.raw
  modified_base (310)..(310): a, c, t, g, unknown or other
  misc_feature (310)..(310): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctgcttcgacaggcccctggacaaggacttgagtgggnggatggatcaactctcacactggaacgcaagtagtctatcggcggtagagtacttaccgaggggtcagggacgttaccgaacccccgttaggaccccaacgaacggaaacggaaccctaacttacccgaaacccggaacccgtaacccaaacggtttaccctaaacccgaagttacgggggaacgtcccgttagggttacgggaaacggtcccggtaggaacgtacccgttaggaaccgtaaccgaccgttccggaccctttcgtaacgtttaccgtcgttacggaccggtacggtccccttaacgtcccctaaccgacgttacccggaacccaccgttccccgaacgtcccgttaccggttccgtaaccccgttccggttaccgggggtaacccccgg

SEQ ID NO: 300486 - DNA, 639 bp, Homo sapiens
  misc_feature: GZ8MTXP02GB784.11.72.G06.1.454.CMB.2.raw
  modified_base (219)..(219): a, c, t, g, unknown or other
  misc_feature (219)..(219): n is a, c, g, or t
  modified_base (255)..(255): a, c, t, g, unknown or other
  misc_feature (255)..(255): n is a, c, g, or t
  modified_base (273)..(273): a, c, t, g, unknown or other
  misc_feature (273)..(273): n is a, c, g, or t
  modified_base (292)..(292): a, c, t, g, unknown or other
  misc_feature (292)..(292): n is a, c, g, or t
  modified_base (294)..(294): a, c, t, g, unknown or other
  misc_feature (294)..(294): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcattccttttcttggtggcagcagcaacaggtcgcccactcacagggtcaacgtggtgcagtctggacctgaggtgaagagcgtgggcctnagtgagtctcgtgtacggctcgagttacacttcacntatgtatcactgctcgcncgcctgacagctgagtggngntggatcgaactcgtacactacgtaggaacgacgagtacgtcgtagtacggacggtagagtacgttacggagggcacggtacgtaccacccgtacgaaccaacgaacgacgaacaccgtaacccgaaccgaaccaacgtacgtacctaacgtacggtacggaacgtcgtacgggtaggtacgtccgtacggaccgtacccgtacgggaaccgaccgttttacccggccctttacttacgttacgtcgtcgtaccgtaccgtccttactccgtaacgacgtaccgacccgtacctaccgtccgttacgttaccggtccgaccggtcggtaccggtcccgtaaaccgg

SEQ ID NO: 300487 - DNA, 610 bp, Homo sapiens
  misc_feature: GZ8MTXP02G6V6V.11.72.G06.1.454.CMB.2.raw
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacacggcccctggacaaggtactgaggtgggtggagtggatcaactctcacacgtggaaagcagagtctagtcgacggagagacttccgaggggcaggacgtcaccccgtagacccaacagtacgaacactacccaacgaccctaacgacgttacaacaacgtagggacgtaccgtggtacggacgtccgtaggacgacctggaaccgaccgaccggtacctcgtaattaccgtgtcgccgacggtaccctacgtcctaacgacgtccgaaccctaccgtccaacggtccgttcggttaccgccgttcgccggggtacccgtaaccggg

SEQ ID NO: 300488 - DNA, 628 bp, Homo sapiens
  misc_feature: GZ8MTXP02F7QWU.11.72.G06.1.454.CMB.2.raw
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcacgctaatggtatcacctggcttcgacacggcccctggacaaggacttgaggtgggtggagtggatcgaactctacacacgtggagcagagtctatcgacggagagtattccgagggcagcgtccaccgtgaccacgagacgacactccacgaccagacgtacaccgagtggactacgtggtacggacgtcccgtaggacgtacccgtaggaaccgacccgaaccggggtcccttacgttaacttacgtcgggtacggacccggtacgggtaccccttaacgtacccttaaacgacgttaccgaaccctaccgttaccgaaccgtccgttacggtaccgaacccgttcgggtaccggggaccggtaacccggg

SEQ ID NO: 300489 - DNA, 641 bp, Homo sapiens
  misc_feature: GZ8MTXP02IERGV.11.72.G06.1.454.CMB.2.raw
  modified_base (216)..(216): a, c, t, g, unknown or other
  misc_feature (216)..(216): n is a, c, g, or t
  modified_base (235)..(235): a, c, t, g, unknown or other
  misc_feature (235)..(235): n is a, c, g, or t
  modified_base (243)..(243): a, c, t, g, unknown or other
  misc_feature (243)..(243): n is a, c, g, or t
  modified_base (247)..(247): a, c, t, g, unknown or other
  misc_feature (247)..(247): n is a, c, g, or t
  modified_base (266)..(266): a, c, t, g, unknown or other
  misc_feature (266)..(266): n is a, c, g, or t
  modified_base (293)..(293): a, c, t, g, unknown or other
  misc_feature (293)..(293): n is a, c, g, or t
  modified_base (529)..(529): a, c, t, g, unknown or other
  misc_feature (529)..(529): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagcctgggcctnagtgaggtctctgtagctnagtcactnacgntatgtatcactgctcgacncggccctgacaggctgaggtgggaggntggactcaactctacacacgtaggaagcagatctagtcggacggagagtacgttacggaggggcaggacgttaccaccccgttagaaccccagaagacgtaaccacacccgaaacgacccaacgaacgttaccaaccgtagtacgggagtccgtaggttacgggacgtccccgttaggaaccggacccgttcgggaacccgtaccgacccgggttaccctacttacgtttaccggnggtaccggaccggtaccgtaccctacctaccgtacgtacgtaccgacctacctaccgtaaccggttcgttaccggttccgtacccggttccgggtaccgggaccggtaccgg

SEQ ID NO: 300490 - DNA, 684 bp, Homo sapiens
  misc_feature: GZ8MTXP02GD4V5.11.72.G06.1.454.CMB.2.raw
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagccgtgggcctcagtgaaggtctctgtaaggcctcagttacaccttcacgctaatggtatcacctggcttcgacacggcccctggacaaggtctgagtggggtggagtggatcaactctacacgacgtggaacgcgaagacgtctagtcggacggagagtacttccgagggcaggacgtaccacccgtagaccctaagacgacgaacactacccgaacgaaccactacgtactaaccgagtacggaacgcgtagggtacggaccggaccccggaacggacccgttacggaaacccggtaccgaaccccgggtcccttacgttacgtttaccgagggttacgccgggtaaccggtacccttaaccgttcccgtaaaccgtacgggtaacccaccccgtacctaccccggtaaccgtccgtttaccgggtacccgtacccggttccggttccggggaaccccgtacggggttaacccccgg

SEQ ID NO: 300491 - DNA, 703 bp, Homo sapiens
  misc_feature: GZ8MTXP02G6L7N.11.72.G06.1.454.CMB.2.raw
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcgtaggttacaccttcaccgtctaatggtatcaccgtggcttcgacacggcccctaggacaaggtactggaggtgggtggatggatcgaactctacactacgtggaagcgaagagtctagtcgacggagagtacttccgagggcaggtacgtccgaccgtacgacccacgagacgaccactacccgacgaacccagacgtacacgagtaggtacgcgtaggacggtagacccgtggaacgacccgttagggaacccgaaccgtacccgggttaccccttagttaaaccgtttccttacggggtaccggacccggtaaaccggtccccctttactaaccccggttacgtaaacccgggtaccgtaacccccgtaaccctttacccgaaccggttccccgtttccgggggttaacccttccccggtaccggggtttacccgggggacccggttaaaccccgggg

SEQ ID NO: 300492 - DNA, 682 bp, Homo sapiens
  misc_feature: GZ8MTXP02ITM65.11.72.G06.1.454.CMB.2.raw
  modified_base (217)..(217): a, c, t, g, unknown or other
  misc_feature (217)..(217): n is a, c, g, or t
  modified_base (236)..(236): a, c, t, g, unknown or other
  misc_feature (236)..(236): n is a, c, g, or t
  modified_base (244)..(244): a, c, t, g, unknown or other
  misc_feature (244)..(244): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcattccttttcttggtggcagcagcaacaggtgcccactcacagggtcaactggtgcagtctggacctgaggtgaagagcctgggcctnagtgagtctctgtaggctnaggttacnccttcaccgctaatggtatcactggcttcgacacggcccctaggacaggctgagtgggtgatggatcgaactctcaactcgtaggaacgctaagagtactagtcggacggagagtacttccggagggtccagacgtcctaacccgtagaacccaacgaggaacgaacctaccgtacccgaaccgaaccctaacgtacgttacaaaccgtagtacgggactcgtacggtagggaccgtaccgaggtaccgaacccgtagggaacccgaaccgaccgggtccccttaattacgttacgtcggtacggacggtaaccggtccccttaagtcccctaaacgtacggttaccgaaccctaacccgttacccgaacggttcccgttaccggggtttacccaacccggtttcggggtaaccccggggtaccgtaaaacccggggg

SEQ ID NO: 300493 - DNA, 652 bp, Homo sapiens
  misc_feature: GZ8MTXP02FO57D.11.72.G06.1.454.CMB.2.raw
  modified_base (242)..(242): a, c, t, g, unknown or other
  misc_feature (242)..(242): n is a, c, g, or t
  modified_base (283)..(283): a, c, t, g, unknown or other
  misc_feature (283)..(283): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgaccactcacagggtcaactggtgcagtctggacctgaggtgaagaagcctggggcctcagtgaaggtctcctgtaaggcctnaggttacaccttcaccgctaatggtatcactggcttcgacnggcccctggacaaggctggagtggggtggatggatcaactctacaccacgtaggaagcaagagtctagtcggacggagagtacttccgagggcaggacgtccacccgtgaccacgacgagacactacccaaccgaaccctacgagtactaccagttacggggagtccgtaggtacggggaacgtccgttaggaccggaccgttacgggaacccgacccgaacccggggtccccttacgttacttacgtcggttggacccggtaacgggtaccccctagttaccctaacgtacgtaccggaacccaccttcccgaaccgtcgtacgggtttcccgaaccgtttccggacgggggtacccaaacccggggg

SEQ ID NO: 300494 - DNA, 669 bp, Homo sapiens
  misc_feature: GZ8MTXP02G7NW0.11.72.G06.1.454.CMB.2.raw
  modified_base (285)..(285): a, c, t, g, unknown or other
  misc_feature (285)..(285): n is a, c, g, or t
  modified_base (340)..(340): a, c, t, g, unknown or other
  misc_feature (340)..(340): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagccgtgggcctcagtgaaggtctcgtgtaaggcctcgaggttacaccttcaccgctaagtggtactcactggcttcgacncggccctggacaggctggaggtgggtggatggatcaactctacgacacgtggaancgagatcgtagcggacgagagacgttaccggagggtcaggcgtaccacccgtagaacccaacgaggaacgaccacgtaccccgaaccgaacccgacgtaacgtacctaacgtacgtacggggaactccgttgggtacgggacgtaccgtaggaccgtaacccgtacgggaacccgaccgtacccgggtcccttacgttacgttaccgtcggacgaccgtaccggtacccgttctaacccgttacgacggtaccaacccgtcccgtaccgaaccggttcgttacgggtacccgtacccggttcgggtaccggggacccgtaaacccgggg

SEQ ID NO: 300495 - DNA, 720 bp, Homo sapiens
  misc_feature: GZ8MTXP02GEPE6.11.72.G06.1.454.CMB.2.raw
  modified_base (364)..(364): a, c, t, g, unknown or other
  misc_feature (364)..(364): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgccccactcacgagggtcaactggtgcagtctggacctgaggtgaagagccgtgggcctcagtgaaggtctccgtagtaacggcctcgagttaccaccttcaccgtataagttggtatccgacctggccttcgacacggcccctggaaccgaaggtcttgaggtggggtggagtaggatacaacctcgacaactacgtaggaacncgtaagagtctagtcggacggagacgtacgttccgacgggcacgggtacctcccgaacccgtacggaaacccaacggaagtaaaccgaaaccctaaacgtacccccgaaaccggaaccctaaccgtaacgtaccctaacgtacggtacggggaactccggttagggaccgggaacccggccccggtaacgaccccgtacggacccggaacccggacccggttccccttagttaacgttaaccggtcgtaccgggtaccggtaacccgtacctaaccggttaccctaacggtacgtaccgaccctacgtaccgacgtccgtacggtccgaccgtcggacggtaccgtacggtacccg

SEQ ID NO: 300496 - DNA, 622 bp, Homo sapiens
  misc_feature: GZ8MTXP02G2M5J.11.72.G06.1.454.CMB.2.raw
  modified_base (240)..(240): a, c, t, g, unknown or other
  misc_feature (240)..(240): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagcctgggcctcagtgaaggtctcctgtaaggcctnaggttacaccttcaccgctaatggtatcacctggcttcgacacggcccctggacaggcttgagtgggtggatggatcaactctacacacgtaggagcagagtctagtcggcggagagtacgttccgaggggcaggacgtaccaccccgtgaacccaacgaagacgaacgactacccgaacgaccactacgtactacagtcgagtctggtggactccgtaggacgacctaggaccgaccgaccggaccccttacgttacttacgtggtacgaccggtacggtacccccttagtacccctaagacggtaccaccctaaccgtcccgaaccgtcgtttaccgggttacccgaccgtccgggtaccggggtacccgtaacccgggg

SEQ ID NO: 300497 - DNA, 721 bp, Homo sapiens
  misc_feature: GZ8MTXP02HAIWT.11.72.G06.1.454.CMB.2.raw
  modified_base (240)..(240): a, c, t, g, unknown or other
  misc_feature (240)..(240): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagcctggggcctcagtgaggtctcctgtaaggcctnaggttacaccttcaccgctaatggtatcacctggcttcgacaggcccctggacaaggacttgaggtgggtggagtggatcgaactctacaacacgtaggaaagcaagacgtactagtcggacgggaagtacgtagttcccgaggggaccagggtacgttccaaccccgtagaaccaacaagacgaacactacccaacgaaccaactacgtacctaacagtacggaagccgttaggtacgggaaacgtccgttaacggaacgtacccgtacgggaacccgtaacccgacccggtacccccgttattaaaccgtttcccgtagggtccgttaccggaaacccgggtcccctttaaacgttacccccgtaaacgttaaccggtaccgaaacccccgtacctaaccccgtaaccggtcccgttaccggggtttacccgaacccgtttcccgggccgggggttaaaccccgtaaaacccccggggg

SEQ ID NO: 300498 - DNA, 663 bp, Homo sapiens
  misc_feature: GZ8MTXP02I9B95.11.72.G06.1.454.CMB.2.raw
  modified_base (250)..(250): a, c, t, g, unknown or other
  misc_feature (250)..(250): n is a, c, g, or t
  modified_base (335)..(335): a, c, t, g, unknown or other
  misc_feature (335)..(335): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagcctggggcctcgagtgaaggtctcctgtaaggcctcaggttacnccttcacgctaatgtatcactgcttcgacaggcccctaggacaaggacttgaggtgggtggatggatcaactctcacactggaanccgaagtacgtactagtggcggagagagttccgaggggacacggacttacccaccgtacgaaccacaagacgacactcccacgaaccacacgtacacgagtacggagtcgtggtaggaccgtccggttagtaccgaccgtacgggaccgaacccgaccgggtaccccttattaacgttaccgttaggtccgtcgggtaaccggtaccccctttaaccggttacccttaacgtaccgttaccggaaaccccctatacccccgaacgttcccgttcgggtttacccggacccgtttaccgggtaccgggggacccgttaaaccccggggg

SEQ ID NO: 300499 - DNA, 649 bp, Homo sapiens
  misc_feature: GZ8MTXP02JOIJ9.11.72.G06.1.454.CMB.2.raw
  modified_base (215)..(215): a, c, t, g, unknown or other
  misc_feature (215)..(215): n is a, c, g, or t
  modified_base (263)..(263): a, c, t, g, unknown or other
  misc_feature (263)..(263): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagctgggcctnagtgaggtctctgtaaggcctcaggttacaccttcaccgctaatgtancacgtgcttcgacacggcccctaggacaaggacttaggaggtggggtgggagtggactacaactcgtacacacgtggaacgcaagtactcgtagtcggacggagagtacgttccgagggacaggtacgtaccacccgtacgaccaacgagacgaacactaccaaccgaccactacgtactacgagtacggagtacgtggtacgggaccgtacgtacggtaacgaccgtaccggaccgaacccggtacccggtaccccttacgttacgttaccgtcggttacgacccggtaccggtcccttactacccgtaacgacgttaccgaccctaccgtacccgcgtcggttaccggtaccgtaccgtcggtacccggggccgtaacccgggg

SEQ ID NO: 300500 - DNA, 577 bp, Homo sapiens
  misc_feature: GZ8MTXP02IRSLL.11.72.G06.1.454.CMB.2.raw
  modified_base (350)..(350): a, c, t, g, unknown or other
  misc_feature (350)..(350): n is a, c, g, or t
  modified_base (521)..(521): a, c, t, g, unknown or other
  misc_feature (521)..(521): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagctggggcctcagtgaaggtctcctgtaaggcctcaggttacaccttcaccgctaatggtatcacctggcttcgacaggcccctggacaaggacttgagtggggtggagtggatcaactctcacactggaagcagagtctatgnggagagacttccgaggggcaggacgtcgaaccccgtgaacccagagacgaacatcccaacgacacacgtcacagtggagcgtggtacggcgcctaggacgaccgtggaaccgaccgacggtccctactacttactgcgtacgacggtccctatccctacgacgtcgaaccnccgttacccaagtcccgttcggtaccgaccttcggtccgggggacctaacccgggg

SEQ ID NO: 300501 - DNA, 641 bp, Homo sapiens
  misc_feature: GZ8MTXP02GNPHL.11.72.G06.1.454.CMB.2.raw
  modified_base (259)..(259): a, c, t, g, unknown or other
  misc_feature (259)..(259): n is a, c, g, or t
  modified_base (279)..(279): a, c, t, g, unknown or other
  misc_feature (279)..(279): n is a, c, g, or t
  modified_base (332)..(332): a, c, t, g, unknown or other
  misc_feature (332)..(332): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcagttacaccttcaccgntatgtatcactggctcgacncggccctgacaggacttgagtgggtggatggatcaactctacacacgtggaancagagtctagtcgcgagagacttcgaggcagctcaccctgacccagagaacgacactacccacgacccacgacgttacacagtacggagtcgtggtacggacgtccgtaggaacgtaccctagggaaccgaacccgtacccggtaccccttagttaaacgtttacgtcggtacggacccggtaccggttacccccttaacgttccccgtaaacgacggttcccgaaacccctaccgtacccgtaacggtccgttacgggtttacccccgacccgttaccggggtccgggggtacccctaaacccggggg

SEQ ID NO: 300502 - DNA, 660 bp, Homo sapiens
  misc_feature: GZ8MTXP02FLLYX.11.72.G06.1.454.CMB.2.raw
  modified_base (237)..(237): a, c, t, g, unknown or other
  misc_feature (237)..(237): n is a, c, g, or t
  modified_base (270)..(270): a, c, t, g, unknown or other
  misc_feature (270)..(270): n is a, c, g, or t
  modified_base (315)..(315): a, c, t, g, unknown or other
  misc_feature (315)..(315): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagcctgggcctcagtgaagtctctgtaaggctnagttacacttcacgctatgtatcactgctgacngccctgacagctgagtggtgatggatcaactcacacacgtggaancagtagtctagtcggacggagagtacgttaccggaaggggtaccaggtaccgtaccgtaaccccgttacggaacccaaagacggaaacgaaaccacgtaaccccgaacgaacccaacgtacgtactacgaagtggacgtcgtggtaggacgtccgtagaacggacccttagggaaacccgtaccggaccggtaccctttacggttaaacttacggtcggtacggtacccggtaaccggtaccccttacgtacccgtaacgtaacgtacccgaaccctaaccgtcccgtaaccgtccgttacggtacccgaccggttacccggacgggggtaccctaacccggggg

SEQ ID NO: 300503 - DNA, 603 bp, Homo sapiens
  misc_feature: GZ8MTXP02HGM7P.11.72.G06.1.454.CMB.2.raw
  modified_base (402)..(402): a, c, t, g, unknown or other
  misc_feature (402)..(402): n is a, c, g, or t
  modified_base (440)..(440): a, c, t, g, unknown or other
  misc_feature (440)..(440): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcgagtgaaggtctcctgtaacggcctcaggttacaccttcaccgtctaagtggtatcacctggcttcgacaggcccctggacaaggacttgaggtggggtggagtggatcgaactctcacacgtggaagcagtagtctagtcgacggacgagtactccgagggcagagtccacccgtagacctanagacgacactcccaacgaccacagtactacgatcggancgtgtggacgcgtcgacgtacctgggaacgaccgaccggtcccttactacgttaccgtgtacgccggtacgtccctatcccgtacgtacgtaccgtacccaccgtacccgtaaccgtcgttacggttcccgacccgtcggtaccgggggacccgtaaccgggg

SEQ ID NO: 300504 - DNA, 549 bp, Homo sapiens
  misc_feature: GZ8MTXP02G68V0.11.72.G06.1.454.CMB.2.raw
  modified_base (242)..(242): a, c, t, g, unknown or other
  misc_feature (242)..(242): n is a, c, g, or t
  modified_base (313)..(313): a, c, t, g, unknown or other
  misc_feature (313)..(313): n is a, c, g, or t
  modified_base (415)..(415): a, c, t, g, unknown or other
  misc_feature (415)..(415): n is a, c, g, or t
  modified_base (429)..(429): a, c, t, g, unknown or other
  misc_feature (429)..(429): n is a, c, g, or t
  modified_base (468)..(468): a, c, t, g, unknown or other
  misc_feature (468)..(468): n is a, c, g, or t
  modified_base (479)..(479): a, c, t, g, unknown or other
  misc_feature (479)..(479): n is a, c, g, or t
  modified_base (483)..(483): a, c, t, g, unknown or other
  misc_feature (483)..(483): n is a, c, g, or t
  modified_base (488)..(488): a, c, t, g, unknown or other
  misc_feature (488)..(488): n is a, c, g, or t
  modified_base (510)..(510): a, c, t, g, unknown or other
  misc_feature (510)..(510): n is a, c, g, or t
  modified_base (517)..(517): a, c, t, g, unknown or other
  misc_feature (517)..(517): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagcctggggcctcagtgaaggtctcctgtaacggcctnaggttacaccttcaccgctaagtggtatcacctggcttcgacacggcccctggacaggcttgaggtggggnggatggatcaacgtctacacacgtggaagcaagtacgtctatccggaggagagacgttccggagggcagggtcgtaccacccgtgacccagacgtagaccancccgacgaaccacngtactacagtggagctggcgagcctggacgctcggaacncgacgcctatntacngtacncgacgcctatctacacgtcacnctaccgngtctcggtccaccgtcggacggctaaccgggg

SEQ ID NO: 300505 - DNA, 667 bp, Homo sapiens
  misc_feature: GZ8MTXP02GR3M8.11.72.G06.1.454.CMB.2.raw
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggcttgagtgggtggatggatcgaactctcacacgtaggaagcagagtctaagtcgacggtagacgattccgagggcaggacgtacacccgtacgaccacagacgacactacccacgaccacacgtactacagtggagctggtacggacgccgttaggacgacccgtagaaccgaaccgacccgggtaccccttacttaacgttaaccgtcggttacgacggtaacccggggtaccccttaaacgttcccccgtaaacgtaccggttacccgaaccccgtaaccttacccccggtaaccggtacccgtttcggggtttaccccgacccgttacccggggttaccgggggtaccccgtaaaaccccggggg

SEQ ID NO: 300506 - DNA, 729 bp, Homo sapiens
  misc_feature: GZ8MTXP02GTN7Q.11.72.G06.1.454.CMB.2.raw
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaacgtggtgcagtctggacctggaggtgaagagccgtggggcctgagtgaaggtctccgtgtaacggcctgacggttacacccttcaccgtactaagtggtatcaccgtggcctcgacacggcccctaggacaaggtactggaggtgggtggagtggactacaactctacaactacgtaggaagcgagagtactagtggacggagagtacgtaccggaggggacaggtacctccctaacccgtacgacccgaacgaacggaacgtaacctaccgaacccggaaccaacccgaacgtaaccgtacctaacgacgtagggacgtccggtggtaacgggacgtacccgtaaggtaccgaaccgtacgggaacccgtacccgtaacccgggtcccttacgttaacgttaccggtcggtaccgggaccggtaccggtaacccccttacgtacccgtaaccgtacgggttacccaaacccgttacccgtacccgtaacggttaccgtttccgggtacccgtaccggtaccgggtacccgggggaacccgtaacccggggg

SEQ ID NO: 300507 - DNA, 596 bp, Homo sapiens
  misc_feature: GZ8MTXP02FUHOI.11.72.G06.1.454.CMB.2.raw
  modified_base (217)..(217): a, c, t, g, unknown or other
  misc_feature (217)..(217): n is a, c, g, or t
  modified_base (236)..(236): a, c, t, g, unknown or other
  misc_feature (236)..(236): n is a, c, g, or t
  modified_base (242)..(242): a, c, t, g, unknown or other
  misc_feature (242)..(242): n is a, c, g, or t
  modified_base (250)..(250): a, c, t, g, unknown or other
  misc_feature (250)..(250): n is a, c, g, or t
  modified_base (365)..(365): a, c, t, g, unknown or other
  misc_feature (365)..(365): n is a, c, g, or t
  modified_base (383)..(383): a, c, t, g, unknown or other
  misc_feature (383)..(383): n is a, c, g, or t
  modified_base (406)..(406): a, c, t, g, unknown or other
  misc_feature (406)..(406): n is a, c, g, or t
  modified_base (417)..(417): a, c, t, g, unknown or other
  misc_feature (417)..(417): n is a, c, g, or t
  modified_base (427)..(427): a, c, t, g, unknown or other
  misc_feature (427)..(427): n is a, c, g, or t
  modified_base (497)..(497): a, c, t, g, unknown or other
  misc_feature (497)..(497): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatcctttcttggtggcagcagcaacaggtgcccactcacagggtcaactggtgcagtctggacctgaggtgaagaagcctggggcctnagtgaggtctctgaagctnagtacncttcacgntaatgtatcactggcttcgacacggcccctggacaaggcttgagtgggtggatggatacgaactctcacgacgtggaaacgcagagtacgtagtcgacggagagacttcgaggcngactccaccgtgacccanagagtaccagtcccaacgaccanacgtacaacgnttaggggaancgttaggacggacacgttgaacgtacctacggggacaaacccgccgggtacctacttaacgtttaccggngtccggacgtaccgtacccttagtaccctacgacgtaccgacccacctccgaacgttccgtaccggtccgtaccggtcggtaccggggaccgtaccggg

SEQ ID NO: 300508 - DNA, 599 bp, Homo sapiens
  misc_feature: GZ8MTXP02F38QM.11.72.G06.1.454.CMB.2.raw
  modified_base (285)..(285): a, c, t, g, unknown or other
  misc_feature (285)..(285): n is a, c, g, or t
  modified_base (315)..(315): a, c, t, g, unknown or other
  misc_feature (315)..(315): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcattccttttcttggtggcagcagcaacaggtgcccactcacagggtcaactggtgcagtctggacctgaggtgaagaagccgtggggcctcgagtgaaggtctcctgtaaggcctcaggttacaccttcaccgctaatggtatcactggctcgacncggccctggacaaggcttgaggtgggtggntggatcaactctcacacgtggaagcagagtcgtagtcggacggagagtacttccgagggcagacgtaccaccgtgaccagagacgacacgtaccacgaccagacgtacacagtggacgcgtggtacggacgtcgtacggacgtaccgtacggaccgaccgaccggtcccttaacgttacttacgtcgtacgccgtaccgtccctactaccgtacgacgtaccgaccctcgtacccgaacgtcgttcggtacccgtaccgtcggaccggggacccgtaaccgggg

SEQ ID NO: 300509 - DNA, 647 bp, Homo sapiens
  misc_feature: GZ8MTXP02F0BUO.11.72.G06.1.454.CMB.2.raw
  modified_base (283)..(283): a, c, t, g, unknown or other
  misc_feature (283)..(283): n is a, c, g, or t
  modified_base (368)..(368): a, c, t, g, unknown or other
  misc_feature (368)..(368): n is a, c, g, or t
  modified_base (384)..(384): a, c, t, g, unknown or other
  misc_feature (384)..(384): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcactggcttcgacnggcccctggacaaggacttgaggtgggtgggatggatcaactctcacactggaagcagagtctatgcggagagattcgaggggcngagtcaccctgaccanagagacactacccacgaaccacagtactacagtgggagcctggtagggagccgtagacgacccgtaggacccgacccgaaccggggtccccttacgttaacgttaacgtcggttacggccgggtaaccggtacccccgttacgttaccccgtaaacgtaaccggttacgaaaccccctaaccgttaccccgaaaccggtcccgtttacggggttacccggtaacccggtttccggttaccgggggaccccgtaaacccggggg

SEQ ID NO: 300510 - DNA, 652 bp, Homo sapiens
  misc_feature: GZ8MTXP02F56Q2.11.72.G06.1.454.CMB.2.raw
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacacggcccctggacaaggacttgagtggggtggatggatcaactctcacacgtggaagcagagtctagtcggcggagagacgttccgagggacaggacgtccacccgtgacccaacgagacgaccatacccgaacgacccactacgtacctacgagtgggacgtcgtaggtacgggacgtcccgtaggacgtacccgtagggaacccgaaccgacccggtacccttacgttaacttacgtcggtacggccggtaaccggtccccttacgttacccgtaacgtacggttaccgaacccctaccgtacccgaaccggtccgttaccggttacccgacccgttccggtaccgggggacccgtaaacccggggg

SEQ ID NO: 300511 - DNA, 639 bp, Homo sapiens
  misc_feature: GZ8MTXP02F78QT.11.72.G06.1.454.CMB.2.raw
  modified_base (239)..(239): a, c, t, g, unknown or other
  misc_feature (239)..(239): n is a, c, g, or t
  modified_base (252)..(252): a, c, t, g, unknown or other
  misc_feature (252)..(252): n is a, c, g, or t
  modified_base (277)..(277): a, c, t, g, unknown or other
  misc_feature (277)..(277): n is a, c, g, or t
  modified_base (333)..(333): a, c, t, g, unknown or other
  misc_feature (333)..(333): n is a, c, g, or t
  modified_base (339)..(339): a, c, t, g, unknown or other
  misc_feature (339)..(339): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagccgtggggcctcagtgaaggtctctgtagctnaggttacaccttnacgctaatgtatcactgcttcgacncggccctgacaaggctgaggtgggtggagtggatacactctcacacgtgaagcagntatagngacggagagacgttcgaggggacacggtatcccgaacccgtacgaacccgaacgaagaacgaacactacccgaaccgaaccaacgaagtacctacgaagtgggacgacgttgaggacgccgtaggaccgtacgacggaaccgaacccgacccgggtacccttacgttaaacttccgtggtacgaccggtaccggttaccctaacttcccgtaaacgaccggttaccgaaccctaccgttacccaaccggttaccgttcggttacccgtaccgttcggtaccggggacccgtaaaccgggg

SEQ ID NO: 300512 - DNA, 630 bp, Homo sapiens
  misc_feature: GZ8MTXP02GUPAD.11.72.G06.1.454.CMB.2.raw
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcgaggttaccaccttcaccgctaatggtatcacctggcttcgacacggcccctggacaaggacttgagtgggtggatggatccaactctacactacgtaggaagtcaagtaagtcctagtcgccggagagtacttccgaggggcaggcgtaccacccgtgaccaacagacgacactaccaacgaccaacacgtacctacgtagtcggaacgcgttcggagggactccgtaggacgaccgtcggaaccgccgaccggtccctacgtactacgtgtacgcgtaccggtacccttaatccctaacgacggtacaacccctacctacccgaaccggtaccgttacggttacccggaccgtttccgggaccgggggtacccctaaacccggggg

SEQ ID NO: 300513 - DNA, 577 bp, Homo sapiens
  misc_feature: GZ8MTXP02HM19F.11.72.G06.1.454.CMB.2.raw
  modified_base (428)..(428): a, c, t, g, unknown or other
  misc_feature (428)..(428): n is a, c, g, or t
  modified_base (437)..(437): a, c, t, g, unknown or other
  misc_feature (437)..(437): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgagtgaagaagcctggggcctcagtgaaggtctcctgtaaggcctcaggttacaccttcaccgctaatggtatcacctggcttcgacaggcccctggacaaggcttgagtgggtggatggatcaactctcacactggaagcagagtctatcgacgagagacttccgagggcaggacgtcacccgtgacccacagacgacatcccacgaaccacagtctacatggacgcgtcgnggacgtccngacgacctaggacgaccgccggaccctcgtacttaccgtgtacgcggacggccccttatacccgtacgtacgtaccgaccctacctacccgaaccgtcgttacggtcccgaaccgttcggtacggggacccgtaacgggg

SEQ ID NO: 300514 - DNA, 646 bp, Homo sapiens
  misc_feature: GZ8MTXP02F6F12.11.72.G06.1.454.CMB.2.raw
  modified_base (275)..(275): a, c, t, g, unknown or other
  misc_feature (275)..(275): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagcctgggcctcagtgagtctcctgtaaggcctcagttacaccttcaccgctatggtatcactgctcgacncggccctggacagacttgagtgggtggatggatcaactctacacacgtggaagcagagtctagcggacggagacgtacgttcgagggcaggactccaccctagaccacacgacacactacccacgaccacgtacgtactacgagtacggacgtcgttagggacgggtacgcccgttaggaaccggtacccggtacgggaacccgaacccgtacccgggtaccccttaccgtttaagtttaccgtcggttacggaccggtaccggtccctttaacgtaccctaacggtacgtaccgaacccgtacctacccgaacggttcccgttaaggttccccgtaacgttccggggtacggggacccgtaacccggggg

SEQ ID NO: 300515 - DNA, 642 bp, Homo sapiens
  misc_feature: GZ8MTXP02IG118.11.72.G06.1.454.CMB.2.raw
  modified_base (216)..(216): a, c, t, g, unknown or other
  misc_feature (216)..(216): n is a, c, g, or t
  modified_base (236)..(236): a, c, t, g, unknown or other
  misc_feature (236)..(236): n is a, c, g, or t
  modified_base (253)..(253): a, c, t, g, unknown or other
  misc_feature (253)..(253): n is a, c, g, or t
  modified_base (277)..(277): a, c, t, g, unknown or other
  misc_feature (277)..(277): n is a, c, g, or t
  modified_base (327)..(327): a, c, t, g, unknown or other
  misc_feature (327)..(327): n is a, c, g, or t
  modified_base (336)..(336): a, c, t, g, unknown or other
  misc_feature (336)..(336): n is a, c, g, or t
  modified_base (532)..(532): a, c, t, g, unknown or other
  misc_feature (532)..(532): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgagtgaagagccgtgggcctnagtgaggtctctgtagcctnaggttcaccttcaccgntaaatggtatcacctggctcgacncggcccctaggacaaggcttggaggtggggtggatggatcaactctacanacgtggaancgagacgtctagtcggacgggagacgtacgtccgaggggcagggactcccaacccgtgaacccagaagactaaccgacacccaaaccgcctaaacagtactaacgagtggaacgtctaggggtacggaccgccgttaacgggaacgtacccggtagacccggaacccgaaccggtcccttaagttactttaccggnggtacggaccggtacgtcccttactacccgaagtacgtacccgaaccctccgtaccgtccgttcggttccggtacccgtaccggtccgggtaccgggacccggtaacggg

SEQ ID NO: 300516 - DNA, 703 bp, Homo sapiens
  misc_feature: GZ8MTXP02G57UY.11.72.G06.1.454.CMB.2.raw
  modified_base (323)..(323): a, c, t, g, unknown or other
  misc_feature (323)..(323): n is a, c, g, or t
  modified_base (370)..(370): a, c, t, g, unknown or other
  misc_feature (370)..(370): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatcctttttcttggtggcagcagcaacaggtcgcccactcacgagggtcaacgtggtgcagtctggactgaggtgaagagccgtggggcctcgagtgaaggtctccgtggtaagcctcgtacggttacaccttcaccgtctagtggtactcacgtggctcgacacggcccctggaccgagacgttgaggtgggnggagtggactacgaactctacacgacgtaggaagcagtagtcgtagngacggagtacgacgtacggaggacgaggtacgtccgaaccgtacgaaccaacgagaacgaactaccaccgaaccgaaccacgtaacgtactaacgagttacgggacgtcgtggtacggacgtacccgtaggaaccgaccgtacgggaaacccgaccggtaaaccccggtccccttacgtttaaacgttacgtcgggttacggacccgggtaaccggtacccccttaggtaccccttaaacgacggttacccaaaccgtccccgttaaccgaaccgttcggtacccggttaccggaacccgttcccgggtaccgggggacccgtaaacccgggg

SEQ ID NO: 300517 - DNA, 618 bp, Homo sapiens
  misc_feature: GZ8MTXP02HRNJR.11.72.G06.1.454.CMB.2.raw
  modified_base (242)..(242): a, c, t, g, unknown or other
  misc_feature (242)..(242): n is a, c, g, or t
  modified_base (282)..(282): a, c, t, g, unknown or other
  misc_feature (282)..(282): n is a, c, g, or t
  modified_base (355)..(355): a, c, t, g, unknown or other
  misc_feature (355)..(355): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctnaggttacaccttcaccgctaatggtatcactggctcgacncggcccctggacaggacttgagtgggtggatgatcaactctcacacgtggaagcagacgtcagtcgacggagngtacttcgagggcaggacgtccaccctgaccacgaagacgacatcccaacgaccacagtctaacagtacggagcgtgtcggaactcccgtagacgacccgtggaaccgaaccaccgggtccccttagttacttaccgtggtccgacggtacgtacccgttataccctaacgacgtaccgaacccctaccgtacccgtaaccggtcgttaccgggttttccccgaccggtttccgggaccggggtaccccggtaaacccggggg

SEQ ID NO: 300518 - DNA, 624 bp, Homo sapiens
  misc_feature: GZ8MTXP02IBMH1.11.72.G06.1.454.CMB.2.raw
  modified_base (244)..(244): a, c, t, g, unknown or other
  misc_feature (244)..(244): n is a, c, g, or t
  modified_base (314)..(314): a, c, t, g, unknown or other
  misc_feature (314)..(314): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagccgtggggcctcagtgaaggtctcctgtaacggcctnaggttacaccttcaccgctaatggtatcacctggcttcgacacggcccctggacaggcttggaggtgggnggatggatcaactctcacacgtggaagcaagagtctagtcggacggagagtacttcccgaggggtcagtacgtccacccgtgaacccacgagaacgacactacccacgaccacgacgtacacagtggacgtcgtgtaggacgtcctaggacgaccgtacggaccgaccgaccggtcccttacgtaacttaccgtgtcgaccggtacggtaccccttactaccctaacgtacgttaccgacccgtaccctacccgaaccgtccgttcggttacccgaccgttccggttacggggacccgtaaacccggggg

SEQ ID NO: 300519 - DNA, 706 bp, Homo sapiens
  misc_feature: GZ8MTXP02I6QUU.11.72.G06.1.454.CMB.2.raw
  modified_base (237)..(237): a, c, t, g, unknown or other
  misc_feature (237)..(237): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgagtgagagctgggcctcagtgaaggtctcctgtaaggcctnaggttacaccttcaccgctatggtatcacctggcttcgacacggcccctggacaaggtacttggagtggggtggatgggatacaacgtctcacacgtaggaacgcgagtgtactagtcggacggacgagacgttaccgaggggcaggacgtaccacccgtacgacccaacgaagacgacctacacccgaaccgaaccaacagtacctaacgaagttggaacgcgtaggttaggacgtcccgttaagggacgaacccgtacggaaacccggaccgaacccgggtacccttaccggtttaaattcccggtaggttacggacccggttacggtacccccgttaacttaccccgtaaagtaccgggtttacccgaaaaccctacccgtaccgtaacccggtcccggtttaacgggtttcccccggtaacccgttccgggggtaccgggggtaccccgttaaaaccccgggggg

SEQ ID NO: 300520 - DNA, 656 bp, Homo sapiens
  misc_feature: GZ8MTXP02FRM94.11.72.G06.1.454.CMB.2.raw
  modified_base (218)..(218): a, c, t, g, unknown or other
  misc_feature (218)..(218): n is a, c, g, or t
  modified_base (240)..(240): a, c, t, g, unknown or other
  misc_feature (240)..(240): n is a, c, g, or t
  modified_base (248)..(248): a, c, t, g, unknown or other
  misc_feature (248)..(248): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagccgtggggcctnagtgaaggtctctgtaaggctnaggttacnccttcacgctaagtggtatcactggcttcgacacggcccctggacaaggacttgaggtgggtgggatggatactaaccgtctacacaccgtggaagctagagtctagtcggacggtagacgtacgttccgaggggacaggtacgtccgtaacccgtacgaccaacgaacggaacgaacaccgttacccaaccggaaccgaaaccacgttacctaaccgtaagttacgggaacgtcgtacggttaggggaaaccgtccgttaagggaacgccgttaacgggacccgttaaccgacccggtaccctcgttaaacgttacgtcgtacggacgtaccggacccttagtacccacgttacgacgacctacctccgaacgtctcggtaccgccgtacgccgggacgaacccggg

SEQ ID NO: 300521 - DNA, 705 bp, Homo sapiens
  misc_feature: GZ8MTXP02HNI4M.11.72.G06.1.454.CMB.2.raw
  modified_base (283)..(283): a, c, t, g, unknown or other
  misc_feature (283)..(283): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagccgtgggcctcagtgaaggtctccgtgtaacggcctcgaggttaccaccttcaccgctaatgtatcactgctcgacncggccctgacaggcttggaggtgggtggagtggatcgaactctacacacgtaggagcagtagtactagtcggacggagacgtacttaccgaaggacacggtacgtaccaccccgtacgaacccacgaagtacgaaccaactacccgaaccgaaccacgaacgttacctaacgtagtagggacgcgttcggtacgggtacgtaccgttacgggaacgtacccgtacggaaccgacccgtaccgggtacccttacgttaacgtttaccggtacggtcggacccggtaccggtacccctttaaacgtaccccgttaaacgaccgtaccgtaaccccgtacccgttaccccgaacggttcccgtttaccggggttacccgtacccggtttaccgggcccgggggttaacccggtaaaccccggggg

SEQ ID NO: 300522 - DNA, 645 bp, Homo sapiens
  misc_feature: GZ8MTXP02H70J2.11.72.G06.1.454.CMB.2.raw
  modified_base (273)..(273): a, c, t, g, unknown or other
  misc_feature (273)..(273): n is a, c, g, or t
  modified_base (288)..(288): a, c, t, g, unknown or other
  misc_feature (288)..(288): n is a, c, g, or t
  modified_base (294)..(294): a, c, t, g, unknown or other
  misc_feature (294)..(294): n is a, c, g, or t
  modified_base (302)..(302): a, c, t, g, unknown or other
  misc_feature (302)..(302): n is a, c, g, or t
  modified_base (319)..(319): a, c, t, g, unknown or other
  misc_feature (319)..(319): n is a, c, g, or t
  modified_base (458)..(458): a, c, t, g, unknown or other
  misc_feature (458)..(458): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagcctgggcctcagtgaggtctctgtaaggctcaggtacacctcacgctaatggtatcactgctcgacncgccctgacagctgnggtggnggatggancactctcacacgtggancgaagtagtcgttagcggacgggaagtacggtacgttacccggaggggccagggtaccgttacccacccccgtagaaccccaagaacgacgaccactacccgaacgaaccctaacgacgttacctaacaggtcgggacncggttggaggaccgtccggtacggaacgtaccgtggaacccggaccgtaacccgggtcccttacgttaacgtttcgtggtaccggaccggtaccggtacccttactacctacgacggttaccaccctccgtaccaaccggtccgttaacggtccgtaccgtccgggcgggtaacccgtaacccgggg

SEQ ID NO: 300523 - DNA, 636 bp, Homo sapiens
  misc_feature: GZ8MTXP02JGCRI.11.72.G06.1.454.CMB.2.raw
  modified_base (217)..(217): a, c, t, g, unknown or other
  misc_feature (217)..(217): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctgggcctnagtgaaggtctctgtaaggctcaggttacaccttcaccgctaatgtatcacctggcttcgacaggcccctggacaggcttgagtgggtggatggatcaacctctcgacaccgtggaagcagagtctatcggcggagagactttccgagggcaggcgtcacccgtacgaaccagaacgagaaccacttacccaaccgaacctacacgttacctacagtacggagccgtgtagggagtccgtaggacgtaccgcgaaccgtaccgaccggaccccttacgtacgttacgtcggtacggcccggtaccggtaccccttacgtacccttaacgtacggttaccaacccgtaaccctccgaacccggtctttacggggttcccgtaccccgtttcggaccgggggttacccgtaaacccggggg

SEQ ID NO: 300524 - DNA, 628 bp, Homo sapiens
  misc_feature: GZ8MTXP02HYQVJ.11.72.G06.1.454.CMB.2.raw
  modified_base (217)..(217): a, c, t, g, unknown or other
  misc_feature (217)..(217): n is a, c, g, or t
  modified_base (332)..(332): a, c, t, g, unknown or other
  misc_feature (332)..(332): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagccgtgggcctnagtgaaggtctcctgtaaggcctcaggttacaccttcaccgctaatggtatcacctggctcgacacggccctgacagctgagtgggtggatggatcaactctcaacagtcggaancgaaagagtctaagtcggacggaagacggtagttcccgaagggccaggtacgtccacccgtagaaccaacgagacgaacctacacccgacgaccctacgacgtactacagtggaacgcgtacggtcggagtacccgtaggacgaccgtacggaaccgaacgaacccggtccccttacggtaactttacggcgtcgaccggaccgtaccctacgtacctacgtacggtaccgaaccctacctccgaacggtcttaccgggtccacccggtcggtaccgggggaccctaaacccgggg

SEQ ID NO: 300525 - DNA, 654 bp, Homo sapiens
  misc_feature: GZ8MTXP02JIPRJ.11.72.G06.1.454.CMB.2.raw
  modified_base (348)..(348): a, c, t, g, unknown or other
  misc_feature (348)..(348): n is a, c, g, or t
  modified_base (358)..(358): a, c, t, g, unknown or other
  misc_feature (358)..(358): n is a, c, g, or t
  modified_base (451)..(451): a, c, t, g, unknown or other
  misc_feature (451)..(451): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctccgtgtaaggcctcgaggttaccaccttcaccgtctaatggtatcacctggcttcgacacggcccctggacaaggcttggaggtggggtggagtggatcaactctcactacgtaggaancagatctagnggacgagagtacgttcgaggggacaggtacgtccaacccgtgaacccaagagacgaacactcccaacgtaccacacgtactacagtaggtacngtggtaggacgtcgtagaacgtaccgtgaaccgaccgtaccggtacccttacgtacttaccggttggtcgaccggtaccggttacccttacgtacccgtaacggtaacggttcccgaaaccctaccgtacccgtaaccggtaaccgtttcccgggttacccggaaccgtttcccgggacgggggttaccgtaaaccccggggg

SEQ ID NO: 300526 - DNA, 651 bp, Homo sapiens
  misc_feature: GZ8MTXP02IE5F0.11.72.G06.1.454.CMB.2.raw
  modified_base (259)..(259): a, c, t, g, unknown or other
  misc_feature (259)..(259): n is a, c, g, or t
  modified_base (282)..(282): a, c, t, g, unknown or other
  misc_feature (282)..(282): n is a, c, g, or t
  modified_base (375)..(375): a, c, t, g, unknown or other
  misc_feature (375)..(375): n is a, c, g, or t
  modified_base (419)..(419): a, c, t, g, unknown or other
  misc_feature (419)..(419): n is a, c, g, or t
  modified_base (428)..(428): a, c, t, g, unknown or other
  misc_feature (428)..(428): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaaaagcctggggcctcagtaaaggtctcctgtaaggcctcaggttacaccttcaccgntaatggtatcactggcttcgacnggcccctggacaggacttggagtggggtggatggatcaactctacacactggaagcagacgtctagtggcggacgagattccgagggcaaggngtccacctgaccacagacgacatacccacgacccacatcacagnggatcgtgngcgccgtgacgtacccgtaggaccgtacgaacccggtcccctacgttactttaccggtacggttacggtaccgggtacccgggtacccccttacttaccccgtaaaccgtacgttaccggaacccctaaccgttaccccgaccggtaccgttccggggttacccgacccgtttccggggtacccgggggaacccgttaaccgggggaacccccgtttcggggg

SEQ ID NO: 300527 - DNA, 750 bp, Homo sapiens
  misc_feature: GZ8MTXP02FH6V6.11.72.G06.1.454.CMB.2.raw
  modified_base (218)..(218): a, c, t, g, unknown or other
  misc_feature (218)..(218): n is a, c, g, or t
  modified_base (240)..(240): a, c, t, g, unknown or other
  misc_feature (240)..(240): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctnagtgaagtctctgtaaggcctnaggttacaccttcaccgctaatggtatcacctggcttcgacacggcccctggacaaggacttgaggtgggtggatggatcaactctcacactggaagcagagtctatcggacggagagtacttccgaggggcaggacgtaccacccgtacgaacccaaacgaacgggaaacgaaaccaacgttacccccgaaaccggaaccccaaaccgtaacggttaccctaaacctaaggttacggggaaggacccgttaggggttacggggaacggtaccccgttagggaaaccggtaaccccgttacggggaaacccggtaacccggtaaccccggggtaccccctttaacgttaacgttaaccgttcgggtcgggaccggtaaccggggtacccccttaaacttccccgtaaaccgacggttacccgtaaacccctacccgttaccccgaacgtcccgttacgggtttaccccgacccggttccgggtaccgggggacccgtaaaaccccggggg

SEQ ID NO: 300528 - DNA, 652 bp, Homo sapiens
  misc_feature: GZ8MTXP02JEOAU.11.72.G06.1.454.CMB.2.raw
  modified_base (471)..(471): a, c, t, g, unknown or other
  misc_feature (471)..(471): n is a, c, g, or t
  modified_base (556)..(556): a, c, t, g, unknown or other
  misc_feature (556)..(556): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagcctggggcctcagtgaaggtctccgtgtaacggcctcgaaggttacaccttcaccggtcttaatggtatctacctggcttcgacacggccctggaccaggctgagtgggtggatggatcaactcgtcacgtacctggaagtaccagtacggtactagcggacggtagagtacgtttaccgaggggcctagggacgttccacccgtgaacccagacggagaccaacgtaccaacgaccaactagtacctacgaacgtggacgtcgnggtacggaacgtccgtagacggaccttacggaacgaccgaaccggtccctagttaatcgtagtcggacctacgggtcccccttanacccgttaacgacgttaccgaccctacccgtacccgtaacggtccgttccgggtttaccgacccgtttccgggccggggtacccgtaacccggggg

SEQ ID NO: 300529 - DNA, 605 bp, Homo sapiens
  misc_feature: GZ8MTXP02JXTRG.11.72.G06.1.454.CMB.2.raw
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaagctgagtgggtggatggatcaactctcacacgtggaagcgagagtctagtcgtacggagagacgtttcccgaggggacagacggttccaccccgttagaacccaacgacgaacgaccgaacttacccaaaccggaccaaccgaacgtacctaaaccagttacgggaagtcctgggtaggaacggtccgtaggacggaccgtacggaccgaccgaccggtcccctagtcttaccgtgtcgcgtacggcctacacgtacacgtcaccactaccgaacgtcgtacggttccacgtcgtcggactaaccggg

SEQ ID NO: 300530 - DNA, 672 bp, Homo sapiens
  misc_feature: GZ8MTXP02JTWQM.11.72.G06.1.454.CMB.2.raw
  modified_base (346)..(346): a, c, t, g, unknown or other
  misc_feature (346)..(346): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacacggcccctggacaaggcttgaggtggggtggatggactcaactctcacactggaacgcaagntactagtcggacggagacgtacttaccgaggggcaggaccgtaccaccccgtagacccaacgagacgaccacgtacccaaccgaacccacgaacgtctaacgagtaggacgtcgttagggacggacgtacccgtaggacgtaccccgtagggaaacccgacccgtacccgggtcccccttagttacgttaccgtaggtccggacccggtaccgggtaccccctaggttccccgtaaacgcggttaccgacccccaaccgttccccaaccggtcgttaccgggttcccgaacccttcggggtacccgggggacctaaaccccggggg

SEQ ID NO: 300531 - DNA, 720 bp, Homo sapiens
  misc_feature: GZ8MTXP02GOUVB.11.72.G06.1.454.CMB.2.raw
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctggaggtgaagaagccgtggggcctcagtgaaggtctcctgtaaggcctcaggttacaccttcaccgctaatggtatcactggctcgacacggccctggacaaggcttgaggtgggtggatggatacaactctacgacacgtggaagcaagagtcgtagtcggacggagaacgtacgttaccgagggacaggtacgtcccaacccgttagaacccaacgagaacgaaccactaccccgaaacgaccccaaactacgttacctaaaccgagttacgggaagtccgttaggacgggacgtacccgtagggaaccgtacccgtacgggaaccgaaccccgtaccgggtacccccttagttaaacgttaccggtcggttaccggaccggtaaccggtacccccttaaactcccccggttaaagaccggggttaacccgaaaccccttacccgtacccgtaaccggtcccgttaccggggttaccctaccccggtttcggggaccgggggtaccccggtaaaccccggggg

SEQ ID NO: 300532 - DNA, 693 bp, Homo sapiens
  misc_feature: GZ8MTXP02I66BJ.11.72.G06.1.454.CMB.2.raw
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtcgcccactcacagggtcaactggtgcagtctggacctgaggtgaagagccgtgggcctcagtgagtctctgtaaggcctcgtaggttacaccttcaccgtctaagtggtaactcaccgtggcttcgacgacggcccctaggaacaaggtcttggaggttggggtaggagtggactacgaactcctacacgacgtaggaacgcgaagtagtactagtcggacggaagacgtacgttccggaaggggctaggggacgtaccaacccgtacgaacccaacgacggaacgacactacccgacgaaccaagacgtactacgagtacggagtcgtaggtacggacgtaccgtaggacgtaccgacggaacccgaacgacccggtacccttagtacgtttacggtcggtacgacccggtaaccgtccccgttaacgtacccgtaaacgtaccgtaccgaaacccctaccgtaccccgtaacggtcccgtttacggttaccccggtaccgtcccgggtaccgggggacccgtaaacccgggg

SEQ ID NO: 300533 - DNA, 663 bp, Homo sapiens
  misc_feature: GZ8MTXP02HOTZE.11.72.G06.1.454.CMB.2.raw
  modified_base (277)..(277): a, c, t, g, unknown or other
  misc_feature (277)..(277): n is a, c, g, or t
  modified_base (458)..(458): a, c, t, g, unknown or other
  misc_feature (458)..(458): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaacgtggtgcagtctggacctggaggtgaagaagccgtggggcctcagtgaaggtctccgtgtaacggcctacgaggttaccaccttcaccgctaatggtancaccgtgctcgacacggcccctggacaaggtactggaggtgggtggagtggatcgaactctcacgacgtaggaagcgaagtagtactagtccgacgggtagacgtacgttaccggagggacagtacgtccaacccgtcgaacccacgacgacgaacactacccgacgaccacgagtaccanagaggacgtcgtgtacggacgtcgtaggaccgtaccgtcggaaccgaccgtacccgacccgttacgtaacgttaccgtcgtacggaccgtaccggtacccctttacgtaccctacggtacgtacccgaccctaccgtacccgaaccggtccgtttcgggttacccgtaccggttccgggtaccgggggtacccgtaacccggggg

SEQ ID NO: 300534 - DNA, 755 bp, Homo sapiens
  misc_feature: GZ8MTXP02I5F68.11.72.G06.1.454.CMB.2.raw
  modified_base (238)..(238): a, c, t, g, unknown or other
  misc_feature (238)..(238): n is a, c, g, or t
  modified_base (266)..(266): a, c, t, g, unknown or other
  misc_feature (266)..(266): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgagtgaagagcctgggcctcagtgaaggtctcctgtaagcctnaggttacaccgttcaccgctaatggtancactggctcgacacggcccctggacaaggcttggagtgggtggatggatcaacgtctcacgacgtggaagccaggacgtctagtcggacggggagtacgttccgaggggtccaagggtcgttaccgaaccccgtagggaacccaacggaacggtaacgggaaccctaacgttacccgaaaccggtacccaacggaaacgtttccgaaaccgtaggttcggggaaacgtcccgtttaggggacgggaaacggtccccgttaggggaacgtaacccccgttaggaacccggtaacccgaaccccggggtcccttaccggttaacttaaccgttcggtaggtccccggaacggttccccttaaaagttccccgtaaacgtaccggggttaccaaaccccgtaccctttacccggaaccgttcccggttacggggtttccccgaacccgtttcccggggtaccgggggacccgaacgggggtttaacccccgg

SEQ ID NO: 300535 - DNA, 644 bp, Homo sapiens
  misc_feature: GZ8MTXP02JP2JH.11.72.G06.1.454.CMB.2.raw
  modified_base (285)..(285): a, c, t, g, unknown or other
  misc_feature (285)..(285): n is a, c, g, or t
  modified_base (348)..(348): a, c, t, g, unknown or other
  misc_feature (348)..(348): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagccgtggggcctcgagtgaaggtctccgtgtaaggcctcaggttacaccttcaccgctaatggtatcacctgcttcgacncggcccctggacaggacttgagtggggtggagtggatcaactctacactacgtggaagcaagngtactagtcggacggagagtacgttccgagggcagacgtccacccgtagaaccgacgagacgacactacccgaccgaaccataacgtacctacgagtacggggactccgttaggacggacgtaccgtcggaacgtaccgtacggaaccgaccgtaccggaccccttagttacgttacgtgtccgcggtaccgtacccttacgtcccgtaaacgtacgtaccgaaaccctaccgtaccgtaaccggtcgtttacgggacccgtccgtcccgggtacggggacccgtaaacccggggg

SEQ ID NO: 300536 - DNA, 592 bp, Homo sapiens
  misc_feature: GZ8MTXP02GDS9J.11.72.G06.1.454.CMB.2.raw
  modified_base (262)..(262): a, c, t, g, unknown or other
  misc_feature (262)..(262): n is a, c, g, or t
  modified_base (287)..(287): a, c, t, g, unknown or other
  misc_feature (287)..(287): n is a, c, g, or t
  modified_base (443)..(443): a, c, t, g, unknown or other
  misc_feature (443)..(443): n is a, c, g, or t
  modified_base (509)..(509): a, c, t, g, unknown or other
  misc_feature (509)..(509): n is a, c, g, or t
  modified_base (569)..(569): a, c, t, g, unknown or other
  misc_feature (569)..(569): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcgaggttaccaccttcaccgntaagtggtatcacctggcttcgacncggtcccctggacaaggacttgaggtgggtggatggatcaactctacacacgtggaacgcagacgtctagtcgcggagacgtacgttaccgagggcaggtctaccgaccctagaacccacgagacgacatcccgaacgacctacgacgtacctacncgtaggactcgtaggtggaacgccgttgaacgccgtagaccgacacccggcccttagtaacttcgngtcgcgtaacgccctagtcctaacgacgtccaccactcccgaacgtccgttacggtaccncgtcggtccggggacaacccggg

SEQ ID NO: 300537 - DNA, 684 bp, Homo sapiens
  misc_feature: GZ8MTXP02GW292.11.72.G06.1.454.CMB.2.raw
  modified_base (316)..(316): a, c, t, g, unknown or other
  misc_feature (316)..(316): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagcctggggcctcagtgaaggtctccgtgtaacggcctacgaggttaccaccttcaccgctaatggtaatcaccgtgcttcgacaggcccctggaccaaggactgagtgggnggatggatacgaactcgtcaacacgtaggaacgcaagagtactatcggacggtagaagtacgttcccgaggggacacggtacgttcccgaacccgttacgacccgaaacaggaacggaaacacgtacccaaccggacccaactacgtactaccgaaagttcgggaacgtccgtaggtaggacgccctagggacaccgtacggaaccgacccgaccgggacccttacgtaacttaccggttagacggtaccggaaacggttcccccttaaatccccggttacaacgttcggaaaccccacgttaccccgaaccgtcgtaccggtttacccggacccgtttcggaccgggggacccttaaaacccggggg

SEQ ID NO: 300538 - DNA, 646 bp, Homo sapiens
  misc_feature: GZ8MTXP02JES8P.11.72.G06.1.454.CMB.2.raw
  modified_base (442)..(442): a, c, t, g, unknown or other
  misc_feature (442)..(442): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagccgtggggcctcgagtgaaggtctccgtgtaaggcctcaggttaccaccttcaccgctaatggtatcacctggctcgacacggcccctggacaaggcttggagtggggtggatggatcgaactctcacacgtggaagcagtagtctagcggacggtaagagtacgttccgaggggacagggactaccaacccgtagacccaacgacgaacgaaccacgtacccgaaccgacccanacgttacaaccgagtcgggaagcgtaggtacggacgtccgtaggaaccgacgtacggaaccgaccgaaccgggtcccttactaacttaccgtgtacgacggaaccgtcccgtactacccgtaaactacggtaccgaaaccctccgaccgtaaccgcgttaccggttaccgacccgtcggggtacccggggacctaaacccgggg

SEQ ID NO: 300539 - DNA, 645 bp, Homo sapiens
  misc_feature: GZ8MTXP02F7NAS.11.72.G06.1.454.CMB.2.raw
  modified_base (283)..(283): a, c, t, g, unknown or other
  misc_feature (283)..(283): n is a, c, g, or t
  modified_base (303)..(303): a, c, t, g, unknown or other
  misc_feature (303)..(303): n is a, c, g, or t
  modified_base (305)..(305): a, c, t, g, unknown or other
  misc_feature (305)..(305): n is a, c, g, or t
  modified_base (307)..(307): a, c, t, g, unknown or other
  misc_feature (307)..(307): n is a, c, g, or t
  modified_base (310)..(310): a, c, t, g, unknown or other
  misc_feature (310)..(310): n is a, c, g, or t
  modified_base (315)..(315): a, c, t, g, unknown or other
  misc_feature (315)..(315): n is a, c, g, or t
  modified_base (319)..(319): a, c, t, g, unknown or other
  misc_feature (319)..(319): n is a, c, g, or t
  modified_base (324)..(324): a, c, t, g, unknown or other
  misc_feature (324)..(324): n is a, c, g, or t
  modified_base (328)..(328): a, c, t, g, unknown or other
  misc_feature (328)..(328): n is a, c, g, or t
  modified_base (334)..(334): a, c, t, g, unknown or other
  misc_feature (334)..(334): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagccgtggggcctcgagtgaaggtctccgtgtaacggcctcaggttacaccttcacgctaatgtatcactgctcgacncgccctgacagctgagtggngngngancactncacngtgancagngtctgngcgagagacttcgaggcaggcgtaccaccgtagacccagacgaacgacactacccaactacccatacgtactacgagtacggactcgtacggaggtaccgccgttaacggaccgacccgttacgggaaacccgaaccccggtacccgggccctttaacttacgtttacccgtaggggttcccgaaccgggtaaacccgtccccctttaacgtccccgtttaaggaaccggttacccaacccgtaccctacccgaacggttccgttacggttacccgccggttccggaaccgggggtacccgtaacccgggg

SEQ ID NO: 300540 - DNA, 655 bp, Homo sapiens
  misc_feature: GZ8MTXP02IYZRC.11.72.G06.1.454.CMB.2.raw
  modified_base (320)..(320): a, c, t, g, unknown or other
  misc_feature (320)..(320): n is a, c, g, or t
  modified_base (347)..(347): a, c, t, g, unknown or other
  misc_feature (347)..(347): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgccccacccacagggtcaactggtgcagtctggacctgaggtgaagaagccgtgggcctcagtgaaggtctccgtgtaacgcctcaggttacaccttcaccgctaagtggtactcaccgtggcttcgactacggcccctggacaggacttgagtgggtggntggactcaactctcaactagtaggaancgagtagtcctagtgaccggagagtactccgaggggcagcgtccaccgtagacccagagacgacactccaaccgaccacgacgtaccgtaacagttacggaacgtccgtagtacgggtacgcccgttaggaccgtacgtaccggaccgaaccgcccggttacctcttaaacgttcgtacggttacgaccgaccgggttacccctacttaccgtacgtaacgttaccggaccctaaccgtaccccgaggtccctacggggtttaccctacccggtcggtaccggggaccgtaacccgggttaaccccgg

SEQ ID NO: 300541 - DNA, 676 bp, Homo sapiens
  misc_feature: GZ8MTXP02G0N50.11.72.G06.1.454.CMB.2.raw
  modified_base (257)..(257): a, c, t, g, unknown or other
  misc_feature (257)..(257): n is a, c, g, or t
  modified_base (342)..(342): a, c, t, g, unknown or other
  misc_feature (342)..(342): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagcctggggcctcagtgaggtctcctgtaaggcctcaggttacaccttcacgntaatggtatcacctggcttcgacacggccctggacaaggactgaggtgggtggatggatcaactctcacgactaggaagcgaagngtctagtcggacggagacgtagttaccgaggggcaggacgtacccaccctagacccaacgagaacgacactacccgaaccgaacccacgtaacggtacctaacctagtcggggaaacgtccgttaggttacgggacgtaccccggttaggaacgaccccgttacggggaaacccgtaacccggaaccgggtacccccttagttaacgttaccgttacgggtcgaccggtaccggtacccttaacgtcccgttaaacgcgttaccggaacccctacgttacccaacggtccgttacgggttaccgccctacgggtcgggggaccctaacccgggg

SEQ ID NO: 300542 - DNA, 701 bp, Homo sapiens
  misc_feature: GZ8MTXP02GAH91.11.72.G06.1.454.CMB.2.raw
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaagtggtatcacctggcttcgacacggcccctggacaaggcttgaggtggggtggatggatcaactctcacacgtggaagcagagtctagtcggacgggagaggtacttaccggaggggcagggacgttaccaacccgtcggaaacccagaacgggaacaaccgactacccgaaccgaaccacgtacgtacctactagtcggaagccttggtacgggacgccgtagacgaccgtggaacccgaccgaccgggtaccctacgttaacgttaccgtggtacggtaccggtaaccggtaccccttaacgtacccgttaaacggtaaccggtttaccgaaacccctaacccgttaccccgaaaccgggtttcccggttaaccgggttttacccggacccgtttaccgggggtttacccgggggaccccgtaaaaccccgggggg

SEQ ID NO: 300543 - DNA, 670 bp, Homo sapiens
  misc_feature: GZ8MTXP02JIJ8F.11.72.G06.1.454.CMB.2.raw
  modified_base (262)..(262): a, c, t, g, unknown or other
  misc_feature (262)..(262): n is a, c, g, or t
  modified_base (334)..(334): a, c, t, g, unknown or other
  misc_feature (334)..(334): n is a, c, g, or t
  modified_base (338)..(338): a, c, t, g, unknown or other
  misc_feature (338)..(338): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagcctggggcctcagtgaaggtctccgtgtaaggcctcgaggttaccaccttcaccgntaatggtatcactggctcgacaggccctggacaggctgagtgggtggatggatcaactctcacacgtggaancagngtactatcggacggagagtacgttccgaaggggcaggtacgtaccaccctagacccagaagacgaactactacccgaacgaaccctagacgttaccaacgagttacgggaagcgttcgggtacgggtacgtacccgttaggacccgtaacccggttacggaaacccggaaccgtacccggggtcccccttagttaaccgtttaaccgtcggttacggacccggtaaccggtcccttaacgtacccgtaacgtacgttacccgacccttaaccgccgaacgtccggttacggttaccgcccgtttacggcccggggtaccgtaaaccccgggg

SEQ ID NO: 300544 - DNA, 718 bp, Homo sapiens
  misc_feature: GZ8MTXP02GXANL.11.72.G06.1.454.CMB.2.raw
  modified_base (218)..(218): a, c, t, g, unknown or other
  misc_feature (218)..(218): n is a, c, g, or t
  modified_base (261)..(261): a, c, t, g, unknown or other
  misc_feature (261)..(261): n is a, c, g, or t
  modified_base (285)..(285): a, c, t, g, unknown or other
  misc_feature (285)..(285): n is a, c, g, or t
  modified_base (339)..(339): a, c, t, g, unknown or other
  misc_feature (339)..(339): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctggaggtgaagagccgtgggcctnagtgaggtctccgtgtaacggcctcaggttacaccttcaccgntaatggtatcaccgtgcttcgacncggccctgacaggctgaggtgggtggatggatcgaactctcacgtacgtggaancgagtagtactagtcggacggagacgtacgttccggagggtacagggtaccgtacccgtacccgtagaacccacgaacggaacgtaaccactacccgaacgaacccacgtacgtacctacgagtacgggacgacgttcggtacggaccgtcccgttaggaccgtaacccggttagggaaccccgtaccggtaccccggttacccctttacgttaaaccgttttaccgcggttacggaccccggtaccgggttaccccctttacgtacccgtttaacgaaccgggttcccgaacccctaccgttacccgtaaccggtccggtttaccgggtacccgtacccggttccggggtaacccggggtacccggtaaaccccgggg

SEQ ID NO: 300545 - DNA, 642 bp, Homo sapiens
  misc_feature: GZ8MTXP02FO641.11.72.G06.1.454.CMB.2.raw
  modified_base (387)..(387): a, c, t, g, unknown or other
  misc_feature (387)..(387): n is a, c, g, or t
  modified_base (424)..(424): a, c, t, g, unknown or other
  misc_feature (424)..(424): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatccactggcttcgacacggccctgacaaggcttgagtgggtggatggatcaactctcacacgtggaagcagagtctagtcggacggagagtacttcgagggcagcgtcaccctgaccanagagacatacccacgaccacagttacactagtcggancgtggtaggacgccgttagacgtacccgtaggaacccgaccgaccggtaccccttagttaacgtttacgtcgggttcccggacggtaaacccggttcccgttaaacttccccgtaaacggtaacgtttaccggaaccccttacccgtacccgaaccgttccggttacgggttaccccgaaccgttccgggtaccgggggacccgttaaaacccggggg

SEQ ID NO: 300546 - DNA, 594 bp, Homo sapiens
  misc_feature: GZ8MTXP02HPG5T.11.72.G06.1.454.CMB.2.raw
  modified_base (216)..(216): a, c, t, g, unknown or other
  misc_feature (216)..(216): n is a, c, g, or t
  modified_base (225)..(225): a, c, t, g, unknown or other
  misc_feature (225)..(225): n is a, c, g, or t
  modified_base (234)..(234): a, c, t, g, unknown or other
  misc_feature (234)..(234): n is a, c, g, or t
  modified_base (293)..(293): a, c, t, g, unknown or other
  misc_feature (293)..(293): n is a, c, g, or t
  modified_base (379)..(379): a, c, t, g, unknown or other
  misc_feature (379)..(379): n is a, c, g, or t
  modified_base (413)..(413): a, c, t, g, unknown or other
  misc_feature (413)..(413): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcattcccttttcttggtggcagcagcaacaggtgcccactcacagggtcaactggtgcagtctggacctgaggtgaagagctgggctnagtgagtcnctgaggctnagtacactcacgtctatgtatcactggcttcgacacgccctaggacagctgaggtgggnggatggatcactcacacacgtaggacgcagtagtctagtcggacggagagtacgttccgagggcaggacgtcccacctagaaccanagacacactacccacgaaccacactactacgagnggacgtcgtggtgacgtccgaggtaccgacgtaggaacccgaccgacccggtcccttcgtaacttcgtacgtcggaccgtacgtacccttacgtaccgtaactacgttacccgaaccctccgtaccgtaaccgtcgtaccggttcccgacgttcccgggtacgggaacccgtaacccgggg

SEQ ID NO: 300547 - DNA, 590 bp, Homo sapiens
  misc_feature: GZ8MTXP02GKI25.11.72.G06.1.454.CMB.2.raw
  modified_base (239)..(239): a, c, t, g, unknown or other
  misc_feature (239)..(239): n is a, c, g, or t
  modified_base (246)..(246): a, c, t, g, unknown or other
  misc_feature (246)..(246): n is a, c, g, or t
  modified_base (299)..(299): a, c, t, g, unknown or other
  misc_feature (299)..(299): n is a, c, g, or t
  modified_base (303)..(303): a, c, t, g, unknown or other
  misc_feature (303)..(303): n is a, c, g, or t
  modified_base (383)..(383): a, c, t, g, unknown or other
  misc_feature (383)..(383): n is a, c, g, or t
  modified_base (410)..(410): a, c, t, g, unknown or other
  misc_feature (410)..(410): n is a, c, g, or t
  modified_base (496)..(496): a, c, t, g, unknown or other
  misc_feature (496)..(496): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctgggacctgaggtgaagaagccgtgggcctgagtgaaggtctctgaagctnagttacncttcacgctaatgatcactggcttcgacagccctgacaagctgagtgggtganggancaactctcacacgtagaagcagagtctagtcgacggagaagacgttccgaagggcaggactcaacccgtgactaacaganacactacaaacgacacagtacactagngaagcgtgagagaccgtagacgaccgtagaccgaaacacccggtacctaccgtaattacgtagtacggacgacggtaccctttaanccttaaacgacgttaccgaacccgtacctaacccgaaccgtccgttacggtttaccggaaccgttcccggtacggggggacccaaacccggggg

SEQ ID NO: 300548 - DNA, 595 bp, Homo sapiens
  misc_feature: GZ8MTXP02HVP6T.11.72.G06.1.454.CMB.2.raw
  modified_base (185)..(185): a, c, t, g, unknown or other
  misc_feature (185)..(185): n is a, c, g, or t
  modified_base (473)..(473): a, c, t, g, unknown or other
  misc_feature (473)..(473): n is a, c, g, or t
  modified_base (509)..(509): a, c, t, g, unknown or other
  misc_feature (509)..(509): n is a, c, g, or t
  modified_base (554)..(554): a, c, t, g, unknown or other
  misc_feature (554)..(554): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcattccttttcttggtggcagcagcaacaggtgcccactcacagggtcaacgtggtncagtctggacctgaggtgaagagccgtgggcctcagtgaaggtctcctgtaaggcctgaggttaccaccttcaccgctaatggtactcacgtggcttcgacacggcccctggacaacggtcttggaggttggggtggacgtggatcaacctctcacgacgtaggaacgcagagtctagtcggacggagagtacgttccgagggacacgggactccacccgtacgaaccacgaagtaccgacaacgtcccgaaacgacccacgtacgtacctaacgagtcggatcgtgnggacgtccgagtacgacagaccgacgaccgtccctntacgttacgtgacgcgtacgtcctagtcccgatacgcgtaacccnccacgtcgtacgtacgtccgacgtcggaccggtaccgacgg

SEQ ID NO: 300549 - DNA, 716 bp, Homo sapiens
  misc_feature: GZ8MTXP02JVXN0.11.72.G06.1.454.CMB.2.raw
  modified_base (264)..(264): a, c, t, g, unknown or other
  misc_feature (264)..(264): n is a, c, g, or t
  modified_base (287)..(287): a, c, t, g, unknown or other
  misc_feature (287)..(287): n is a, c, g, or t
  modified_base (294)..(294): a, c, t, g, unknown or other
  misc_feature (294)..(294): n is a, c, g, or t
  modified_base (304)..(304): a, c, t, g, unknown or other
  misc_feature (304)..(304): n is a, c, g, or t
  modified_base (311)..(311): a, c, t, g, unknown or other
  misc_feature (311)..(311): n is a, c, g, or t
  modified_base (336)..(336): a, c, t, g, unknown or other
  misc_feature (336)..(336): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagccgtggggcctcgagtgaaggtctctggtaacggcctcgaggttacaccttcaccgntagtggtatcactggcttcgacncggcccngacaggctgnggtgggnggatggatcactctcacagtggaancagagtctagtcggacggagagtacttccggagggacagggtaccgtcctaaccccgtacgaacccaacgaacgaacgaacctaaccgtacccgaaacccggacccaacgtacgtactacgtaagtacgggaacgtcgtacggttacgggacgtccggtacggacgtaacccgtacgggaacccggaacccgtaccccgggtacccctttaacgttaacgtttaccgtgggtacccggaccgggtaaaccggtcccctttaacgtaccccgtaaaacggtccggttaacctacccccgtaaccgtaccccgaaccggttccggttaacggttccccggaccgtttccggggtacccgggggtacccgttaaccccggggg

SEQ ID NO: 300550 - DNA, 720 bp, Homo sapiens
  misc_feature: GZ8MTXP02I41KU.11.72.G06.1.454.CMB.2.raw
  modified_base (322)..(322): a, c, t, g, unknown or other
  misc_feature (322)..(322): n is a, c, g, or t
  modified_base (350)..(350): a, c, t, g, unknown or other
  misc_feature (350)..(350): n is a, c, g, or t
  modified_base (354)..(354): a, c, t, g, unknown or other
  misc_feature (354)..(354): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccatcacagggtcaactggtgcagtctggacctgaggtgaagagcctggggcctcagtgaaggtctccgtggtaacggctcaggttacaccttcaccgcttaagtggtactcaccgtggtcttcgacgacggcccctggaacaaggcttggagtgggtggntggatcgaactctacacgacgtggaacncagngtactagtcggacggagagtacttaccggagggcacgggtactcccggtaccctagaaccccgaagacggaacgtaaccactacccgaaccggaaaccaccgtaagtacctaaaccgagtacgggacgtacgtgggttacggaaccgtccgtacgggtaacgcccgtagggaacccgtacccggacccggtacccctttacttaaacggtttccgtaggtaccggaccggtaaaccgggtccccgtttaataccccgtaaaacgtccgggttaaacccaaacccgtccttacccgaaccgttacccggttacggtttaccccgaacccggtttccggtaaccggggtacccggtaaacccccgggg

SEQ ID NO: 300551 - DNA, 611 bp, Homo sapiens
  misc_feature: GZ8MTXP02IDB58.11.72.G06.1.454.CMB.2.raw
  modified_base (340)..(340): a, c, t, g, unknown or other
  misc_feature (340)..(340): n is a, c, g, or t
  modified_base (424)..(424): a, c, t, g, unknown or other
  misc_feature (424)..(424): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagcctggggcctcagtgaaggtctccgtgtaaggcctcaggttaccaccttcaccgctaagtggtatcacctggctcgacacggcccctggacaggacttgaggtgggtggatggatcaactctcacgactggaancagagtctatcggacggagagattcgagggcagacgtcaccctagaccacgagacgactacgacccacgaccacacgtactacncgtaggacgtcgtgtcggacgtccgagtacgacccgttaggacccgaccgtacccgggacccttacttacttaccgtacggtcggacccggtacggtacccctagtacccttacggaccgtacgaccctacctacccgaaccgtcggttcgtcccgtacccggttcgccgggggtacaaccccgggg

SEQ ID NO: 300552 - DNA, 648 bp, Homo sapiens
  misc_feature: GZ8MTXP02FLDTX.11.72.G06.1.454.CMB.2.raw
  modified_base (219)..(219): a, c, t, g, unknown or other
  misc_feature (219)..(219): n is a, c, g, or t
  modified_base (342)..(342): a, c, t, g, unknown or other
  misc_feature (342)..(342): n is a, c, g, or t
  modified_base (566)..(566): a, c, t, g, unknown or other
  misc_feature (566)..(566): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcattccttttcttggtggcagcagcaacaggtgcccactcacagggtcaactggtgcagtctggacctgaggtgaagaagccgtgggcctnagtgagtctctgtaaggcctcagttacaccttcacgctaatgtatcactggcttcgacacggccctggacaaggtacttggaggtggggtggatggactcaactctacaacacgtagggaacncgaaggtacgtactagtcggacgggagagtacgttaccggaggggacacggacgtcccaacccgtacgaaccaacgacgacgaaccaactaccccgaaacgaaccctacaagtacctaacagtacgggagtcgtggtaggacgtcgtaggacgaccgtaggaaccgaccgtaccggcccttagttacgtacgtgtcgacgtacggtaccctagtacccgtaacncggtaccaaccctccgttaccgaaccggtaccgttccgggttaccctccgttacgggaccgggggtacccgtaaacccgggg

SEQ ID NO: 300553 - DNA, 609 bp, Homo sapiens
  misc_feature: GZ8MTXP02JYMAS.11.72.G06.1.454.CMB.2.raw
  modified_base (312)..(312): a, c, t, g, unknown or other
  misc_feature (312)..(312): n is a, c, g, or t
  modified_base (325)..(325): a, c, t, g, unknown or other
  misc_feature (325)..(325): n is a, c, g, or t
  modified_base (336)..(337): a, c, t, g, unknown or other
  misc_feature (336)..(337): n is a, c, g, or t
  modified_base (340)..(340): a, c, t, g, unknown or other
  misc_feature (340)..(340): n is a, c, g, or t
  modified_base (345)..(345): a, c, t, g, unknown or other
  misc_feature (345)..(345): n is a, c, g, or t
  modified_base (366)..(366): a, c, t, g, unknown or other
  misc_feature (366)..(366): n is a, c, g, or t
  modified_base (419)..(419): a, c, t, g, unknown or other
  misc_feature (419)..(419): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagcctggggcctcgagtgaaggtctccgtaggtaacggcctcgaggttaccaccttcaccgctaatggtatcactggctcgacacggccctggacaggctgagtgggnggatgatcactcncacagtaggannagntctancggcgagagtattcgagggcngcgtcaccctgaccacgagacacactccacgaccacagtactacagtacggancgtgaggacgcgtcgagtaccgtacggaacgaccgacggtaccctacgtacgttacgtcggtacggacggtaccggtaccctacgtacccgttaacgaccgtaccgaacccctaccgttacccgaaccggttccggttaccgggttacccgtacccgttaccggggtccgggggtaccgtaacccggggg

SEQ ID NO: 300554 - DNA, 634 bp, Homo sapiens
  misc_feature: GZ8MTXP02I905Z.11.72.G06.1.454.CMB.2.raw
  modified_base (214)..(214): a, c, t, g, unknown or other
  misc_feature (214)..(214): n is a, c, g, or t
  modified_base (238)..(238): a, c, t, g, unknown or other
  misc_feature (238)..(238): n is a, c, g, or t
  modified_base (278)..(278): a, c, t, g, unknown or other
  misc_feature (278)..(278): n is a, c, g, or t
  modified_base (307)..(307): a, c, t, g, unknown or other
  misc_feature (307)..(307): n is a, c, g, or t
  modified_base (438)..(438): a, c, t, g, unknown or other
  misc_feature (438)..(438): n is a, c, g, or t
  modified_base (501)..(501): a, c, t, g, unknown or other
  misc_feature (501)..(501): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgagtgaagagctgggcctnagtgaaggtctcctgtaaggcctnaggttacaccttcaccgctaatgtatcactggcttcgacncggccctggacaggcttggaggtggtggntggatcaactctcactacgtggaatcgaagtacgtacgttatggaccggtagaagtacgttccgaagggtcaggtcgacccacccgtagacctacgagacgacactcccaacgaccactacgtctaacagnggtagcgttggaggctcgtgagccctaggaaccgtacgaccggtccctagttaacgttaccgnggttacgacggtacggccccgttagtaccctaacgtacgttaccgaaaccccgtaccgttcccgaacggtaccctttacggggttacccgtacccggtttaccggtccgggggtacccgtaaaaccccggggg

SEQ ID NO: 300555 - DNA, 627 bp, Homo sapiens
  misc_feature: GZ8MTXP02HZVMB.11.72.G06.1.454.CMB.2.raw
  modified_base (243)..(243): a, c, t, g, unknown or other
  misc_feature (243)..(243): n is a, c, g, or t
  modified_base (461)..(461): a, c, t, g, unknown or other
  misc_feature (461)..(461): n is a, c, g, or t
  modified_base (522)..(522): a, c, t, g, unknown or other
  misc_feature (522)..(522): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagccgtggggcctcagtgaaggtctcctgtaaggcctnaggttacaccttcaccgctaatggtatcactggcttcgacaggcccctggacaaggcttggaggtgggtggatggatcgaactctacacacgtggaagcgagacgtctagtcgacggagagattccgaggggtcaggacgtccaaccccgttgacccagtaagacgtaccaatccccaacgacccaacacgttaccacgagtcgggaacgcgttaggngggacgtccctaggaacgccccgtaggacccgaacccgacggtcccctattaacgttacgngtcgaccggtacggtccccttatccctaacgacgtcaacccctaccgtacccctaacggtccgttcggtttccgaacccttcgggtcgggaccgttaacccgggg

SEQ ID NO: 300556 - DNA, 679 bp, Homo sapiens
  misc_feature: GZ8MTXP02HWYNA.11.72.G06.1.454.CMB.2.raw
  modified_base (260)..(260): a, c, t, g, unknown or other
  misc_feature (260)..(260): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagccgtggggcctcagtgaaggtctctgtaaggcctcgaggttacaccttcaccgntaatggtatcacctggcttcgacacggcccctaggacaggacttggagtggggtggatggactcaactctcacacgtggaagcaagtagtctagtcggacggagagtaacgttcccggaaggggcagggtacgtacccaccccgtggaaacccagacgacgaccacgtacccgacgaacccatacgttacgacgagttcgggactcgtaggacggagtccgtaggacgaccgtacgggaaccaccggtacccggaccctttacgtaactttacgtcggtacggtccgtaccgggtaccccttacggtacctaaccggtacgttacccggaacccctaccgtacccggtaacggttcccgtttacggggttaccccgacccggtttcccgggacgggggttaaccccgtaaacccggggg

SEQ ID NO: 300557 - DNA, 724 bp, Homo sapiens
  misc_feature: GZ8MTXP02GADFQ.11.72.G06.1.454.CMB.2.raw
  modified_base (259)..(259): a, c, t, g, unknown or other
  misc_feature (259)..(259): n is a, c, g, or t
  modified_base (280)..(280): a, c, t, g, unknown or other
  misc_feature (280)..(280): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagcctggggcctgagtgaaggtctcgtgtaaggcctcaggttacaccttcaccgntaatggtatcactgctcgacnggccctgacaggctgagtgggtggatggatcgaactctacacatggaacgtacagagtactagcgtcggagagtacttccgagggacaggtacgtccgacccgtcgaacccaacgaagacgaacctactacccaaccgaacccaaccgaacgttacctacgtaacgtcggtaagaccgttagggtacgggaccgtacccgtaagggtaccggtaacccgttaacgggaacccgtaacccggtacccgggtacccctttaccgttaacgtttaccgtaggtaccgggtaccggtaaccgggttacccctttaacgtaccccgttaaacgtaaccggttaccgaaaccccctaccggttaccccctaaccggttcccgttaccggggttaccccgtaccccggtttaccgggtacccgggggtaccccggttaaaacccccggggg

SEQ ID NO: 300558 - DNA, 699 bp, Homo sapiens
  misc_feature: GZ8MTXP02HFKXO.11.72.G06.1.454.CMB.2.raw
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctggaggtgaagaagccgtggggcctcgagtgaaggtctcctgtaacggcctcgtaaggttaccacccttcgaccgtactaagtcggtactccacctggtccttcggacacggcccctaggacaaggacttggaggtggggtggatggatcaactctacacaccgtggaacgacgagtagtcgtaagtccggacgggagacgtacgttaccggagggtcaggacgttaccacccccgtagaaccctacggaagtaacgaccgtaactaccccgaaaccgtacccaacgtacgttacctaacgagttacgggacgtcgtaggtacgggacgtccgtagggacacccgtaggaacccgaacgtacccggacccgttacttaacgttaccgtcgtacggacgtaccggtacccctattaccccgtacgaccgtacgacccctactaccccgaaggtccgttacgggtacccgtacccgttcgggtacgggggaccccgtaacccggggg

SEQ ID NO: 300559 - DNA, 725 bp, Homo sapiens
  misc_feature: GZ8MTXP02JVJVV.11.72.G06.1.454.CMB.2.raw
  modified_base (212)..(212): a, c, t, g, unknown or other
  misc_feature (212)..(212): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacgagggtcaactggtgcagtctggacctgaggtgaagaagccgnggggcctcgagtgaaggtctccgtgtaaggcctcaggttacaccttcaccgctaagtggtatcactggtctcgacgacgccctggacgaaggacttggaggtggggtaggagtggataccgaactcctacaacgtacgtaggaacgtcaaggtagtactagtcggacggtagacggttacttaccggagggtcaggtaccgctaccccgtagaacccgagaaggacgaacctactcccgaacgacccaacgtacgtacctaacgagttacggaagtccgttaggacgggacgtcccgttaggaacgtacccgtacggaaaccggtcccgaacccgggttaccctacgtttaacgttaccgtttacgggacgggtcccggtaaccggggtaccccttaaacggttccgtaaccggttaccgtacccggtaaccctacccgtaccgtaacccggttccgttaccggttaccgtacccggttaccgggttccgggggaaacccgttaccccggggg

SEQ ID NO: 300560 - DNA, 632 bp, Homo sapiens
  misc_feature: GZ8MTXP02HFD08.11.72.G06.1.454.CMB.2.raw
  modified_base (297)..(297): a, c, t, g, unknown or other
  misc_feature (297)..(297): n is a, c, g, or t
  modified_base (325)..(325): a, c, t, g, unknown or other
  misc_feature (325)..(325): n is a, c, g, or t
  modified_base (354)..(354): a, c, t, g, unknown or other
  misc_feature (354)..(354): n is a, c, g, or t
  modified_base (534)..(534): a, c, t, g, unknown or other
  misc_feature (534)..(534): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaacgtggtgcagtctggacctgaggtgaagagccgtgggcctgagtgaaggtctccgtagtaacggcctacgtaggttaccaccttcaccgtctaagtcggtaatcaccgtggcttcggacncggcccctaggaccaggctgaggtgggnggatggactcaactctcacacgtggaacncgagtagtactagtcggacgagaagtacgttaccggagggacacggtacgtaccacccgagaacccacgaggacgtaccactacccgaccgaccacgtacgtactacaggtacggagtcgtaggtcggactccgtagaccgacgtcggaaccaccgaccggtaccccttagtacttacgngtcgaccgtacggtaccctagtaccctagacgtaccgtacccacgtaccgtaacgtcgttcggtacccaccgtccgggtacgggacccgtaacccggg

SEQ ID NO: 300561 - DNA, 636 bp, Homo sapiens
  misc_feature: GZ8MTXP02JBIP8.11.72.G06.1.454.CMB.2.raw
  modified_base (362)..(362): a, c, t, g, unknown or other
  misc_feature (362)..(362): n is a, c, g, or t
  modified_base (373)..(373): a, c, t, g, unknown or other
  misc_feature (373)..(373): n is a, c, g, or t
  modified_base (417)..(417): a, c, t, g, unknown or other
  misc_feature (417)..(417): n is a, c, g, or t
  modified_base (551)..(551): a, c, t, g, unknown or other
  misc_feature (551)..(551): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagccgtgggcctgagtgaagtctccgtgtaacgcctcgtaggttacctaccttcaccgactaagtggtactcaccgtggccttacgacgaccggcccctaggaacaaggtcgttggaggtgggtggatggactacgactcgtacacgtacgaggacncgaagtacgtntagcgacgagagtactcggaggcacggactcccgacgtcaccanagacacacgtccacgaccacgacgtcgtacagtaggtcgcgtcggtacgaccgtcgtacgacgtaccgtaggacccgaccggtacccgtccttacgtaacgttcgttcggacgtaccgtaccgtcccgttaacnccgttaaccgacgttccgaaccctccgtaccgccggtcgttaccggttccgtaccggtcccggtacgggtaccccggtaaaccgg

SEQ ID NO: 300562 - DNA, 759 bp, Homo sapiens
  misc_feature: GZ8MTXP02I9NH1.11.72.G06.1.454.CMB.2.raw
  modified_base (220)..(220): a, c, t, g, unknown or other
  misc_feature (220)..(220): n is a, c, g, or t
  modified_base (240)..(240): a, c, t, g, unknown or other
  misc_feature (240)..(240): n is a, c, g, or t
  modified_base (247)..(247): a, c, t, g, unknown or other
  misc_feature (247)..(247): n is a, c, g, or t
  modified_base (283)..(283): a, c, t, g, unknown or other
  misc_feature (283)..(283): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcattccttttcttggtggcagcagcaacaggtcgcccactcacgagggtcaacgtggtgcagtctggacctgaggtgaagagcgtgggcctnagtgagtctcgtagtagctnagttacncttcacgtctagtgtatcactggctcgacgcgcccngacaaggtcgttggaggtggggtggagtggactacgaactcctacacgtacgtaggaacgcagtagtctagtcgacggagagtacgtcggacgggactaggccgtacctacccgtacgacccgaagaacggtaaacgacctaacgtaacccgaaccgtaacccgtaacgtacgtacctaacggtacggtacgggaagtcgtagggttaccggacggttaccgtacggtaaccgaacccgttacgggaaaccccgacccgtaaccccgggttaccccttaacgtttacggttaccgtacgggttacggtaacccgggtacccggttacccttaaccggttaaccccgttaacggttaacccggttacctaaacccccgttaacccggttaacccgtccccgggttacggtttacccgggttaacccggtccgggtttaccccggggtaccgggggtaaccccgttaaaccccggggg

SEQ ID NO: 300563 - DNA, 776 bp, Homo sapiens
  misc_feature: GZ8MTXP02G3SU2.11.72.G06.1.454.CMB.2.raw
  modified_base (219)..(219): a, c, t, g, unknown or other
  misc_feature (219)..(219): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctggaggtgaagagccgtggggcctnagtgaaggtctcctggtaacggcctgaggttacaccttcaccgtctaatggtactcgactggcttcgacacggccctggaacaaggtcttgaggtgggtggatggatccaacgtctacacgtacgtggaagccgaagtagtactagtcggaccggtagacgtacgttcccggaaggggtacctacgggtaccgttacccaaccccggttacgaacccccgtaaacgaacgggaaaccgtaaaccctaaccggtacccccgaaaccggaacccctaagtaaccggtttaaccaaccgtaagtacgggaacgtccggttagggtacgggaccgtacccggtagaaccggtaaccctacgggaaacccgacccgtacccgggtacccctttaccgttaagtttaccgacgggttaccgacccggggtaacccttaccccggttctaaaccccggttacgttaacggacccctaaacccgtccccgttaacgccggttccgttaccggggttacccctaaccgggttcccggtacgggggtaaccccgtaaaccccggggg

SEQ ID NO: 300564 - DNA, 590 bp, Homo sapiens
  misc_feature: GZ8MTXP02JY770.11.72.G06.1.454.CMB.2.raw
  modified_base (241)..(241): a, c, t, g, unknown or other
  misc_feature (241)..(241): n is a, c, g, or t
  modified_base (335)..(335): a, c, t, g, unknown or other
  misc_feature (335)..(335): n is a, c, g, or t
  modified_base (425)..(425): a, c, t, g, unknown or other
  misc_feature (425)..(425): n is a, c, g, or t
  modified_base (458)..(458): a, c, t, g, unknown or other
  misc_feature (458)..(458): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagcctggggcctcagtgaaggtctcctgtaaggcctnaggttacaccttcaccgctaatggtatcactggctcgacaggccctggacaaggcttgaggtggggtggatggatcaactctcacacgtggaancagagtctagtcggacggagagtacgtccgagggcaggacgtccacctgaccaacagacgacactaccgaccaaccaacacgttacaacngtacggagcgtaggtggagccgtggacacccgnggaaccgacgaccggtcccttaacgtattaccgtgtacgaccgtacggtaccctatcccgtaaacgcgtaccgacccacttaccgaacgtccgtacggttcccaccggttcggacggggacctaaccggggg

SEQ ID NO: 300565 - DNA, 631 bp, Homo sapiens
  misc_feature: GZ8MTXP02GUVDT.11.72.G06.1.454.CMB.2.raw
  modified_base (218)..(218): a, c, t, g, unknown or other
  misc_feature (218)..(218): n is a, c, g, or t
  modified_base (289)..(289): a, c, t, g, unknown or other
  misc_feature (289)..(289): n is a, c, g, or t
  modified_base (316)..(316): a, c, t, g, unknown or other
  misc_feature (316)..(316): n is a, c, g, or t
  modified_base (344)..(344): a, c, t, g, unknown or other
  misc_feature (344)..(344): n is a, c, g, or t
  modified_base (426)..(426): a, c, t, g, unknown or other
  misc_feature (426)..(426): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagccgtggggcctnagtgaaggtctccgtgtaacggcctcgaggttaccaccttcaccgtctaatggtatcacctggcttcgacncggcccctggacaaggcttgagtgggnggatggatcaactctacactactggaancagtgtctagcggacggagagtacgttccgagggcagacgtccacccgtgaccaagagacgtaacactacccaacgaccaanacgtactacagtggagccgtggtacgacggtccctaggggaacctccgtagggaacccgaaccgtacccgggtacccctttataacttaccgtggtacgaccggtacggtcccctagtaccctagtacgtaccgaaccctacgtcccgaacgttcccgtacgggttacccgcccgtacgggtaccggggacccgttaacccgggg

SEQ ID NO: 300566 - DNA, 645 bp, Homo sapiens
  misc_feature: GZ8MTXP02GJQ3Q.11.72.G06.1.454.CMB.2.raw
  modified_base (242)..(242): a, c, t, g, unknown or other
  misc_feature (242)..(242): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagccgtgggcctcagtgaaggtctcctgtaaggcctnaggttacaccttcaccgctaagtggtatcacctggcttcgacacggcccctaggacaagacttgaggtgggtggagtggatcgaactctcacacgtggaagcagagtctatcggacgagagacttcgagggtacacggactccgaccgtcgaaccgacagacgaacagtacccacgaccaacacgtacacctagtacgaggctaggtaggagtccgtagacgacgtacggaacggtaacccgaccggtaccctaccgttaacgttacgtacggttacggacccgtaccggacccctttacgtacccgtaccgtaacggtaccggaaccctaccgttaccccaaaccggtcccgttacgggttacccgacccggtttccgccgggggacccgtaaaccccgggg

SEQ ID NO: 300567 - DNA, 664 bp, Homo sapiens
  misc_feature: GZ8MTXP02GVT3E.11.72.G06.1.454.CMB.2.raw
  modified_base (235)..(235): a, c, t, g, unknown or other
  misc_feature (235)..(235): n is a, c, g, or t
  modified_base (242)..(242): a, c, t, g, unknown or other
  misc_feature (242)..(242): n is a, c, g, or t
  modified_base (298)..(298): a, c, t, g, unknown or other
  misc_feature (298)..(298): n is a, c, g, or t
  modified_base (319)..(319): a, c, t, g, unknown or other
  misc_feature (319)..(319): n is a, c, g, or t
  modified_base (328)..(328): a, c, t, g, unknown or other
  misc_feature (328)..(328): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagcctgggcctcagtgagtctctgtaagctnagttacncttcacgctaatgtatcactggcttcgacacggccctgacaaggacttgagtgggnggatggatcaactctacgacnctagggaancaagtacgtctaagtcggcgggaagtagtaacttccggaaaggggcaggtacgtaccgaacccctggaacccccaagaaggtaacgaacactaccccgaaccggaaccaacgtaacgtacctaacgaaagtcggaagccgtagtacgggactaccgtaggacgtaacgtcgaaccgaccgtacccggacccttactaacttaccgttgtacggaccgacgaccccttactaccgtaacgtaccggttacaacccaacccgtttccgaaacccggtcgtttaaccggttccgggtaacccgtcccgggttacgggggtaacccgtaaaccccggggg

SEQ ID NO: 300568 - DNA, 604 bp, Homo sapiens
  misc_feature: GZ8MTXP02JVG2J.11.72.G06.1.454.CMB.2.raw
tcagcgagagataccacgaccggtgctcgatttagctacgactgcaagggaaaggggacccaaaaaccacacccctccttgggagaatcccctagatcatagctcctcaccatggactggacctggagcattccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcactggcttcgacacggcccctggacaaggacttggagtggggtggagtggactcaactctacacacgtggaagcagagtctagtcgcggagagtagtccaggggcagacgtcacccgtgaccacgagacgaacactccacgaaccacgaagtctacgaatggagcgtgtgggacgccgtaggactaccgtcggaaccgaccgaccggtacccctcgtttaaacgtccgttcggtagaccggaccggtcccctaacgcctaacgtacgacgaaccccacttacccgaacgtccgtcggtacccgaccgttcggaccggggaccctaacccgggg

SEQ ID NO: 300569 - DNA, 719 bp, Homo sapiens
  misc_feature: GZ8MTXP02JRKCH.11.72.G06.1.454.CMB.2.raw
  modified_base (241)..(241): a, c, t, g, unknown or other
  misc_feature (241)..(241): n is a, c, g, or t
  modified_base (282)..(282): a, c, t, g, unknown or other
  misc_feature (282)..(282): n is a, c, g, or t
  modified_base (339)..(339): a, c, t, g, unknown or other
  misc_feature (339)..(339): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagcctggggcctcagtgaaggtctcctgtaaggcctnaggttacaccttcaccgctaatggtatcactggcttcgacnggcccctggacaaggcttggagtgggtggatggactcaactctacacgactaggaancgaagtacgtctagtcggacgggagacgtacgttacccggaggggaccgagggtaccgtaccgtaaccccgtacgggaaacccaacgacgggaacgaaccaaccgttaccccgaaaccggaacccacgtaacggttacctaacgacggttacgggaacgtccgtaagggttcggacggttacccgtaggaaccgggtaccaggttaccgggaaacccgaccgtaacccgggtcccccttaagtttaacgtttacccgaggttccggaacccggtacggtccccttaacttaccccgtacggttaaccgacccgtaaccacccgttccgaaccggttcgttaccggggttaccccgtccggttccgggtacggggtacccg

SEQ ID NO: 300570 - DNA, 722 bp, Homo sapiens
  misc_feature: GZ8MTXP02HHEZU.11.72.G06.1.454.CMB.2.raw
  modified_base (240)..(240): a, c, t, g, unknown or other
  misc_feature (240)..(240): n is a, c, g, or t
  modified_base (250)..(250): a, c, t, g, unknown or other
  misc_feature (250)..(250): n is a, c, g, or t
  modified_base (270)..(270): a, c, t, g, unknown or other
  misc_feature (270)..(270): n is a, c, g, or t
  modified_base (292)..(292): a, c, t, g, unknown or other
  misc_feature (292)..(292): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagctgggcctcagtgaagtctctgtagctgagtacnccttcaccgntaatgtatcactgctcgacncgccctgacagctgaggtgggnggatggatcgaactctacacgtacgtaggaacgcaagacgtcgtagtcggacggagagtacgttaccggacggggtcacgggtacgtaccctaccccgtagaaacccacggaacggaaccgaacccgtaacttaccccgaaacccgaacccgtaacgaccgttactaaccgaaacggttcgggaaacgtccgtagggttcgggaaccgtccggttaaggaacccgtacccgtaacggaaacccgaaccggtaccccggtaccccctttaagtaaccggttttaaccgtcgggtaccggtaacccgggtaccgtaccccgttaccttacccggttaaaccacggtacccgacccttaacccgtaccgaacccgttcggttaaccggtcccgttaccggtccgggtaccgggggtaaccctaaccccggggg

SEQ ID NO: 300571 - DNA, 700 bp, Homo sapiens
  misc_feature: GZ8MTXP02IW4S9.11.72.G06.1.454.CMB.2.raw
  modified_base (184)..(184): a, c, t, g, unknown or other
  misc_feature (184)..(184): n is a, c, g, or t
  modified_base (215)..(215): a, c, t, g, unknown or other
  misc_feature (215)..(215): n is a, c, g, or t
  modified_base (249)..(249): a, c, t, g, unknown or other
  misc_feature (249)..(249): n is a, c, g, or t
  modified_base (295)..(295): a, c, t, g, unknown or other
  misc_feature (295)..(295): n is a, c, g, or t
  modified_base (318)..(318): a, c, t, g, unknown or other
  misc_feature (318)..(318): n is a, c, g, or t
  modified_base (322)..(322): a, c, t, g, unknown or other
  misc_feature (322)..(322): n is a, c, g, or t
  modified_base (336)..(336): a, c, t, g, unknown or other
  misc_feature (336)..(336): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgnagtctggacctgaggtgaagagcgtgggctnagtgagtctctgtaggctcagttcaccttcacgntatgtatcactgcttgactcgccctgacaaggcttgagtgggaggntggatacaatctacacagtggancagntactatggacgganagtattccgagggcagggacgttaccaccccgtagaccccaagagggaaacctactagaccccaacgacccaaagtcgtacttaccgaattacgggacgtcgtagggttacggaacgttccgtagggaaccgaacccgtaggggaaccccgtaaaccccggccggggttaccccctttaggtttaaaacctttcccggttaggggtccgaaccgggtaaacccccggtccctttaaaacggtccccctttaaacggaccggttaccgaaacccccgtaacctttcccgaaaaccggttcccggtttaccggttaacccggaccgtttcccggggtaccggggaaccccgtttaaacccccgggg

SEQ ID NO: 300572 - DNA, 701 bp, Homo sapiens
  misc_feature: GZ8MTXP02JEVF8.11.72.G06.1.454.CMB.2.raw
  modified_base (286)..(286): a, c, t, g, unknown or other
  misc_feature (286)..(286): n is a, c, g, or t
  modified_base (319)..(319): a, c, t, g, unknown or other
  misc_feature (319)..(319): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagccgtggggcctcgagtgaaggtctccgtgtaaggcctcaggttacacccttcaccgctaatggtatcactggctcgacncggcccctggacaaggacttggaggtgggtggntggatcaactctcacacgtggaagcagatctagtggacggagagtacgttccgaggggcaggtacgtaccacccgtacgaacccagaagacgaccactaccccaaccggaacccacgtagttacccaacgtagttaggggaactccgttagggtacgggaccgttacccgtagggtaacgaccccgttagggaaacccccgaccggtacccggtaccccttagttaactttaccggtggtacggaaccggtaccggtaccccttattacccccgtaaagacgggttacccaaccctacccgttacccgaaccggtttccgttacccgggggtttaaccccgcccggtttaccggggtaccggggtaaccccgtaaccggggg

SEQ ID NO: 300573 - DNA, 812 bp, Homo sapiens
  misc_feature: GZ8MTXP02GDG76.11.72.G06.1.454.CMB.2.raw
  modified_base (264)..(264): a, c, t, g, unknown or other
  misc_feature (264)..(264): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctggaggtgaagaagcctggggcctcagtgaaggtctccgtgtaaggcctcgaggttacaccttcaccgtntaatggtatcgacctggcttcgacacggcccctggacaaggacttaggagtgggtggagtggactctaaacgtcctacgtacacgttaggaaacgtccgaaaggtacgttacgtacgtacgggacccgggtaagtaaacgtacgtttaccccggaacggggtaaccgtacggtaaccggttaaccccgtaaacccccggttacggtaaacccccccgtaaaggaaacgggtaaacccggtaaaacccgaaaaccggttaacccccccgtaaaaccgggaaaaccccctaaacggtaaacccgttaacccgttaaaccccgaaggtaccggggtaaacggtccgtttaggggacggggtaccgtacccgtacggtaaccgaccgtacgggaaccggaaccctaccccgggtaccctacgtttaacttaaccggtggtacgaccgtaaccggtaccttaccgtaccttaacacggttacccgaacccttaccacccgtgtacgtttcccgggtacctacccggttccggcgggtaacccggtaaccgggg

SEQ ID NO: 300574 - DNA, 629 bp, Homo sapiens
  misc_feature: GZ8MTXP02G6QK3.11.72.G06.1.454.CMB.2.raw
  modified_base (204)..(204): a, c, t, g, unknown or other
  misc_feature (204)..(204): n is a, c, g, or t
  modified_base (243)..(243): a, c, t, g, unknown or other
  misc_feature (243)..(243): n is a, c, g, or t
  modified_base (273)..(273): a, c, t, g, unknown or other
  misc_feature (273)..(273): n is a, c, g, or t
  modified_base (281)..(281): a, c, t, g, unknown or other
  misc_feature (281)..(281): n is a, c, g, or t
  modified_base (304)..(304): a, c, t, g, unknown or other
  misc_feature (304)..(304): n is a, c, g, or t
  modified_base (307)..(307): a, c, t, g, unknown or other
  misc_feature (307)..(307): n is a, c, g, or t
  modified_base (314)..(314): a, c, t, g, unknown or other
  misc_feature (314)..(314): n is a, c, g, or t
  modified_base (317)..(317): a, c, t, g, unknown or other
  misc_feature (317)..(317): n is a, c, g, or t
  modified_base (323)..(323): a, c, t, g, unknown or other
  misc_feature (323)..(323): n is a, c, g, or t
  modified_base (326)..(326): a, c, t, g, unknown or other
  misc_feature (326)..(326): n is a, c, g, or t
  modified_base (333)..(333): a, c, t, g, unknown or other
  misc_feature (333)..(333): n is a, c, g, or t
  modified_base (404)..(404): a, c, t, g, unknown or other
  misc_feature (404)..(404): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaaacaggtgcccactcaacagggtcaactggtgcagtctgggacctgaggtnaagaagcgtggggcctcagtgaaggtctctgaaggcctnaggttacaccttcacgctaatggatcaccngctcgacngccctgacaaggactgagtgggngangatcatncanatgagnagngtctagngacggagagtactcgaggcagactcaccctgaccacgagacacactccgaacaccaagtacgtctaaacgngtacgagtcgtggtacggcgacgtacggaacgtaccgtacggaaccgaacccgacccggtaccccgttactaacgtttaaccgtcggtacggaccggtaaccggtacccttacctaccgtaaacgtaacggtacccaaacccgtacccgtaacccgtaaccggttaccgtaccgggttaccgtacccggtaccggggtaccgggggtaacccggtaaacccgggg

SEQ ID NO: 300575 - DNA, 613 bp, Homo sapiens
  misc_feature: GZ8MTXP02I53C3.11.72.G06.1.454.CMB.2.raw
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagccgtggggcctcgagtgaaggttctcctggtaacggcctcgaaggttaccacccttcaccgctaagtggtatcacctggcttcgacacgcccctggacaaggcttgaggtgggtggagtggactcaactctacactacgtggaactcgagtacgtctagtcggacggagagtacttccgaggcaggctcccgaccgtcgaacccagagacgaacacacccaacgaacctacacgtactacgagtcgagtcgttggaggacctcgtaggacgtaccgtcggaaaccgaccaccggtcccctagtaacgtttccgtgtcgaccgtacgtcctactaccgtacgacgtaccgaccctacgtaccgaacgttcgtaccggtaccgtccgtcggtaccgggaccgtaaccgg

SEQ ID NO: 300576 - DNA, 581 bp, Homo sapiens
  misc_feature: GZ8MTXP02FOW8P.11.72.G06.1.454.CMB.2.raw
  modified_base (367)..(367): a, c, t, g, unknown or other
  misc_feature (367)..(367): n is a, c, g, or t
  modified_base (378)..(378): a, c, t, g, unknown or other
  misc_feature (378)..(378): n is a, c, g, or t
  modified_base (395)..(395): a, c, t, g, unknown or other
  misc_feature (395)..(395): n is a, c, g, or t
  modified_base (397)..(397): a, c, t, g, unknown or other
  misc_feature (397)..(397): n is a, c, g, or t
  modified_base (409)..(409): a, c, t, g, unknown or other
  misc_feature (409)..(409): n is a, c, g, or t
  modified_base (524)..(524): a, c, t, g, unknown or other
  misc_feature (524)..(524): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgccactcacagggtcaactggtgcagtctggacctgaggtgaagaagcctggggcctcagtgaaggtctcctgtaaggcctcgaggttacaccttcaccgactaattggtatccacgtgcttcgactacgcccctaggacaaggacttgagtgggaggagtggatactaactctacacacgtggaacgcagagtctatggacgagagnttaccgaggcngatcaccgtgacacgananacatcacgaacncgtactcacatcggatcgtagtcggaagccgtagacgactacggacaccgcggtccttacggtacttacgtagtcgacggtacgtacccctatcccgtacgtaacgtcgtaaccncttacccggaagtcccgttacggtacccgtccgtacggtaccgggtaccgaaccggg

SEQ ID NO: 300577 - DNA, 625 bp, Homo sapiens
  misc_feature: GZ8MTXP02HL201.11.72.G06.1.454.CMB.2.raw
  modified_base (262)..(262): a, c, t, g, unknown or other
  misc_feature (262)..(262): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagagcctggggcctgagtgaaggtctcctgtaaggcctcgaggttaccaccttcaccgtntaagtgtatcaccgtgcttcgacaggcccctaggacaaggcttggaggtgggtggagtggatcaactcgtacacgactggaagcaggtatctatcggacggagagtagttccgagggtcaggtacgttaccaaccgtcgaacctacggaagaacgaaccgtacacccgaaacgacccgaactacgtacctacgacgtggacgtacgtgttcggaacgccgtagtacgccgtagaccgacgcccgccctagtactacgtgtcgacccgtacgtacacgtttacccaagttccgtacgacctacccgaccgtaaccggtcttacgggttcccgacgtcccggacggggtaccccgtaacccgggg

SEQ ID NO: 300578 - DNA, 611 bp, Homo sapiens
  misc_feature: GZ8MTXP02HT0WM.11.72.G06.1.454.CMB.2.raw
  modified_base (228)..(228): a, c, t, g, unknown or other
  misc_feature (228)..(228): n is a, c, g, or t
  modified_base (247)..(247): a, c, t, g, unknown or other
  misc_feature (247)..(247): n is a, c, g, or t
  modified_base (253)..(253): a, c, t, g, unknown or other
  misc_feature (253)..(253): n is a, c, g, or t
  modified_base (307)..(307): a, c, t, g, unknown or other
  misc_feature (307)..(307): n is a, c, g, or t
  modified_base (360)..(360): a, c, t, g, unknown or other
  misc_feature (360)..(360): n is a, c, g, or t
  modified_base (447)..(447): a, c, t, g, unknown or other
  misc_feature (447)..(447): n is a, c, g, or t
tcagcgagagataccacgaccggtgctcgatttagctacgactgcaagggaaaggggacccaaaaaccacacccctccttgggagaatcccctagatcatagctcctcaccatggactggacctggagcatccttttcttggtgcagcagcaacaggtgcccatcacagggtcaactggtgcagtctggacctgaggtgaagagcctggggcctcagtgaaggtcttntgtaaggcctcaggttacncccttnaccgctaatggtatcacctggcttcgacaggcccctggacaggcttgagtgggnggatcggatcaactcgtcacacgtggaaagcagtaagtcctagtcgcgggtanaggacttccgagggcagctcgaccctgaccactagacgtacaactccacgaccgactaacgtctaccatcggagcgttagagggtcnccgttgacgaccgtcgaaccgtacaaccgggtccttaccgatttaccgacggttcgccggaacggccccttaacgcccgttacaaacggttcgaccccaacgttccccgaaccgtcgtaaccggttccggtaacctaccggttcgggggaccctaacccggggg

SEQ ID NO: 300579 - DNA, 381 bp, Homo sapiens
  misc_feature: GZ8MTXP01EINV5.21.87.H10.1.454.CMB.2.raw
  modified_base (371)..(371): a, c, t, g, unknown or other
  misc_feature (371)..(371): n is a, c, g, or t
  modified_base (375)..(381): a, c, t, g, unknown or other
  misc_feature (375)..(381): n is a, c, g, or t
tcagtcgtcgctcgcacgaccggtgctcgatttagcagtactgcgttgggttttaaccttgtctcctggtatcaacaacaccaggacaaagccccaaaactcttaatttctggcctcaatcagcgaccctcacatgtttccagtcgattctctgcatccaagtctggcaacacggcctttctgacaatctctcaactccaggctgaagacgaggctatttattactgctcctcatacgcaggtgcactatttttcttggttttggcggcgggacccagatgactgtcctcagtcagcccaaggctcgccccctggtcactctcgttccccgccctctccgagcgacgactgacgcgggctggcaaggcgcntagnnnnnnn

SEQ ID NO: 300580 - DNA, 524 bp, Homo sapiens
  misc_feature: GZ8MTXP01DW706.21.87.H10.1.454.CMB.2.raw
  modified_base (319)..(319): a, c, t, g, unknown or other
  misc_feature (319)..(319): n is a, c, g, or t
  modified_base (376)..(376): a, c, t, g, unknown or other
  misc_feature (376)..(376): n is a, c, g, or t
  modified_base (431)..(431): a, c, t, g, unknown or other
  misc_feature (431)..(431): n is a, c, g, or t
  modified_base (489)..(489): a, c, t, g, unknown or other
  misc_feature (489)..(489): n is a, c, g, or t
tcagtcgtcgctcgcacgaccggtgctcgatttagcagtactgcgttgggtttggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacttttaacctgtctctggtatcaacaacaccaggacaaagcccccaaaatcttaatttctggctcaatcagcgaccctnacatgtttccagtcgattcctctgcatccaaaagttctggcaaacacggtcctttcngacaatctctcaactcaggctagaagacgtagttattattactgctctcatacgnaggtgctactatttttcttggtttttggcggtcgggaacccagatgactgtccttcgnttcaagcccaaggcctcgcccctcggttctaaccg

SEQ ID NO: 300581 - DNA, 598 bp, Homo sapiens
  misc_feature: GZ8MTXP01EGCWJ.21.87.H10.1.454.CMB.2.raw
  modified_base (193)..(193): a, c, t, g, unknown or other
  misc_feature (193)..(193): n is a, c, g, or t
  modified_base (289)..(289): a, c, t, g, unknown or other
  misc_feature (289)..(289): n is a, c, g, or t
  modified_base (330)..(330): a, c, t, g, unknown or other
  misc_feature (330)..(330): n is a, c, g, or t
tcagtcgtcgctcgcacgaccggtgctcgatttagcagtactgcgttgggtttgggggggtcacaagaggcagcgctctcgggacgtctccaccatggcctgggctctgctgctcctcactctcctcactcagggcacagggtcctgggcccagtctgccctgactcagcctgcctcgtgtctggtctccggnagtcgtcaccatctcttgcgctggatccagcgatgatattggtacttttactgtctctgtatcaacacacagacaaacgccccaaatcttaattcnggctacaatcagcaccctcactatgtttccagtcgattccnctgctatcccaaaagttctcggacaaaccgtaccggtccttttacagaacctaaattccttactaccaaacctccgaggctaggaaacgacgaggtacttatttaacttactcgtcttctacacttacgcgtaggtcgactacttagtttttcgttggtttttcgggccgggtcgggacccttaggtacttcgtacgttcgttccgttcgacgttaaccgacgtaacccgtaacgggtcccttccggtccccccgttgggttaacccc

SEQ ID NO: 300582 - DNA, 517 bp, Homo sapiens
  misc_feature: GZ8MTXP01DHSJ4.21.87.H10.1.454.CMB.2.raw
  modified_base (375)..(375): a, c, t, g, unknown or other
  misc_feature (375)..(375): n is a, c, g, or t
  modified_base (473)..(473): a, c, t, g, unknown or other
  misc_feature (473)..(473): n is a, c, g, or t
tcagtcgtcgctcgcacgaccggtgctcgatttagcagtactgcgttgggtttggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacttttaacctgtctctggtatcaacaacaccaggacaaagccccaaaactcttaatttctggcgtcaatcagcgaccctcacatgtttccagtcgattcctctgcatccaaagtctggcaaacacggtcctttcngacaatctctcaactccaggctagaagacgagcttatttattactgctcctcatacgcaggtgctactatttttcttggttttggcggtcgggacccngattgactgttccttcagtcagcccaggcttcgccccttggtcc

SEQ ID NO: 300583 - DNA, 515 bp, Homo sapiens
  misc_feature: GZ8MTXP01CIANP.21.87.H10.1.454.CMB.2.raw
  modified_base (297)..(297): a, c, t, g, unknown or other
  misc_feature (297)..(297): n is a, c, g, or t
  modified_base (316)..(316): a, c, t, g, unknown or other
  misc_feature (316)..(316): n is a, c, g, or t
  modified_base (337)..(337): a, c, t, g, unknown or other
  misc_feature (337)..(337): n is a, c, g, or t
  modified_base (360)..(360): a, c, t, g, unknown or other
  misc_feature (360)..(360): n is a, c, g, or t
  modified_base (369)..(369): a, c, t, g, unknown or other
  misc_feature (369)..(369): n is a, c, g, or t
  modified_base (422)..(422): a, c, t, g, unknown or other
  misc_feature (422)..(422): n is a, c, g, or t
  modified_base (482)..(482): a, c, t, g, unknown or other
  misc_feature (482)..(482): n is a, c, g, or t
tcagtcgtcgctcgcacgaccggtgctcgatttagcagtactgcgttgggtttgggggggtcacaagaggcagcgctctcgggacgtctccaccatggcctgggctctgctgctcctcactctcctcactcagggcacagggtcctgggcccagtctgccctgactcagcctgcctccgtgtctgggtctcccggcagtcggtcaccatctcttgcgctggatccagcgatgatattggacttttaacctgtctctggtatcaacaacaccagacaaagccccaaaatcttaattcnggctcaatcagcgaccctnacatgtttccagtcgattccnctgcatccaaagtctggcaaacncgtcctttngacaatctctcaactcaggctagagacgagcttattatactgctctcatacgnagtgctacttatttttccgtggttttggcggtcggaccttggtacttgacttgttccttnacgtcacgtccaggcttcgtccccttggtaacc

SEQ ID NO: 300584 - DNA, 545 bp, Homo sapiens
  misc_feature: GZ8MTXP01BRO5D.21.87.H10.1.454.CMB.2.raw
  modified_base (295)..(295): a, c, t, g, unknown or other
  misc_feature (295)..(295): n is a, c, g, or t
  modified_base (369)..(369): a, c, t, g, unknown or other
  misc_feature (369)..(369): n is a, c, g, or t
  modified_base (433)..(433): a, c, t, g, unknown or other
  misc_feature (433)..(433): n is a, c, g, or t
tcagtcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacttttactgtctctgtatcaacacaccagacaaagccccaaaatcttaattcngctcaatcagcgaccctcacattgtttccagtcgattcctctgcatccaaagtctggcaaacgacggtcctttngacaatctctcaactcagctagaagacgagtctattatactgactctcatacgcagtgctactntttttcgttggttttcggcggtcggtacccttaggtacttcggtacttcggttcccttcgacgttccgacgtaaccctaacgggtccttacccgtcccccgttcgggttccc

SEQ ID NO: 300585 - DNA, 522 bp, Homo sapiens
  misc_feature: GZ8MTXP01C2NR4.21.87.H10.1.454.CMB.2.raw
  modified_base (198)..(198): a, c, t, g, unknown or other
  misc_feature (198)..(198): n is a, c, g, or t
  modified_base (294)..(294): a, c, t, g, unknown or other
  misc_feature (294)..(294): n is a, c, g, or t
  modified_base (441)..(441): a, c, t, g, unknown or other
  misc_feature (441)..(441): n is a, c, g, or t
tcagtcgtcgctcgcacgaccggtgctcgatttagcagtactgcgttgggtttgggggggtcacaagaggcagcgctctcgggacgtctccaccatggcctgggctctgctgctcctcactctcctcactcagggcacagggtcctgggcccagtctgccctgactcagcctgcctccgtgtctgggtcctcccgggnagtcggtcaccatctcttgcgctggatccagcgatgatattggacttttaacctgtctctgtatcaacaacacagacaaagcccaaatctaattcngctcaatcagcacctcacatgtttccagtcattcctctgcatcccaaaagtctggacaaacacggtcctttctacgacaactctactcaaactccaggctagaagacgagcttattatactgactctcatacgcaggtgctaacttntttttcgttggttttcggcggtcgggaccagtacttgtactgttccttcagtcagtcccgaggccttcgccccgttggtcc

SEQ ID NO: 300586 - DNA, 533 bp, Homo sapiens
  misc_feature: GZ8MTXP01AHGV2.21.87.H10.1.454.CMB.2.raw
  modified_base (295)..(295): a, c, t, g, unknown or other
  misc_feature (295)..(295): n is a, c, g, or t
tcagtcgtcgctcgcacgaccggtgctcgatttagcagtactgcgttgggtttgggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggactttactgtctctgtatcaacaacacaggacaaagccccaaaatcttaatttcnggcgtcaatcagcgaccctcacatgtttccagtcgattcctctgcatccaaagtctggcaacacggcctttctgactaatctactcaactccaggctagaagacgtaggacttatttattactgctctcataacgcagtgctacttattttctgggttttcggcgggtcggtacccagtattgtacttgttaccgttcacgtcacgccctaaggccttccgtccccttcgggtaaccc

SEQ ID NO: 300587 - DNA, 604 bp, Homo sapiens
  misc_feature: GZ8MTXP01EMTMB.21.87.H10.1.454.CMB.2.raw
  modified_base (295)..(295): a, c, t, g, unknown or other
  misc_feature (295)..(295): n is a, c, g, or t
  modified_base (305)..(305): a, c, t, g, unknown or other
  misc_feature (305)..(305): n is a, c, g, or t
  modified_base (315)..(315): a, c, t, g, unknown or other
  misc_feature (315)..(315): n is a, c, g, or t
  modified_base (331)..(331): a, c, t, g, unknown or other
  misc_feature (331)..(331): n is a, c, g, or t
  modified_base (355)..(355): a, c, t, g, unknown or other
  misc_feature (355)..(355): n is a, c, g, or t
  modified_base (366)..(366): a, c, t, g, unknown or other
  misc_feature (366)..(366): n is a, c, g, or t
  modified_base (424)..(424): a, c, t, g, unknown or other
  misc_feature (424)..(424): n is a, c, g, or t
  modified_base (433)..(433): a, c, t, g, unknown or other
  misc_feature (433)..(433): n is a, c, g, or t
tcagtcgtcgctcgcacgaccggtgctcgatttagcagtactgcgttgggtttgggggggtcacaagaggcagcgctctcgggacgtctccaccatggcctgggctctgctgctcctcactctcctcactcagggcacagggtcctgggcccagtctgccctgactcagcctgcctccgtgtctgggtcctcccgggcagtcggtcaccatctcttgcgctggatccagcgatgattattggtacttttactgtctctgtatcaacaacacagacaaagccccaaatctaattcngctcaatcancacctcactntgttccagtcattccnctgcatccaaagtctggacaaacncgtcctttacnactaaactcctactacaaactcaaggctaagaacgtacgagtacttattacttactcncttacctanacttacgcgtagggtcgaccttaaacgttcttttttcgtttcgggttttcgggccgggtaaccgggtaacccttaggtacgttacggtaccttcggttacccttcgttacggttaacccacggtaaccccgaaaggggtccccttccggtccccccgtttcggttaacccc

SEQ ID NO: 300588 - DNA, 525 bp, Homo sapiens
  misc_feature: GZ8MTXP01DA433.21.87.H10.1.454.CMB.2.raw
  modified_base (319)..(319): a, c, t, g, unknown or other
  misc_feature (319)..(319): n is a, c, g, or t
  modified_base (340)..(340): a, c, t, g, unknown or other
  misc_feature (340)..(340): n is a, c, g, or t
  modified_base (424)..(424): a, c, t, g, unknown or other
  misc_feature (424)..(424): n is a, c, g, or t
  modified_base (429)..(429): a, c, t, g, unknown or other
  misc_feature (429)..(429): n is a, c, g, or t
tcagtcgtcgctcgcacgaccggtgctcgatttagcagtactgcgttgggtttgggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcgtcaccatctcttgcgctggatccagcgatgatattggacttttaactgtctctggtatcaacaacaccaggacaaaagccccaaaatcttaatttctggctcaatcaagcgaccctnacatgtttccagtcgattccnctgcatcccaaaagtctggcaaacacggcctttctgacaatctctcaactccaggactagaaagacgagacttatttattactnctctnatacgcaggtgctaacttattttcgttggttttcggcggtcgggtcccagtattgacttgttccttcatcagcccaaggcttcgccccttcggtcc

SEQ ID NO: 300589 - DNA, 529 bp, Homo sapiens
  misc_feature: GZ8MTXP01D92BN.21.87.H10.1.454.CMB.2.raw
  modified_base (197)..(197): a, c, t, g, unknown or other
  misc_feature (197)..(197): n is a, c, g, or t
  modified_base (293)..(293): a, c, t, g, unknown or other
  misc_feature (293)..(293): n is a, c, g, or t
  modified_base (313)..(313): a, c, t, g, unknown or other
  misc_feature (313)..(313): n is a, c, g, or t
  modified_base (336)..(336): a, c, t, g, unknown or other
  misc_feature (336)..(336): n is a, c, g, or t
  modified_base (369)..(369): a, c, t, g, unknown or other
  misc_feature (369)..(369): n is a, c, g, or t
  modified_base (420)..(420): a, c, t, g, unknown or other
  misc_feature (420)..(420): n is a, c, g, or t
  modified_base (427)..(427): a, c, t, g, unknown or other
  misc_feature (427)..(427): n is a, c, g, or t
tcagtcgtcgctcgcacgaccggtgctcgatttagcagtactgcgttgggtttgggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggnagtcggtcaccatctcttgcgctggatccagcgatgatattggacttttactgtctctgtatcaacaacacagacaaagccccaaatcttaattcnggctcaatcagccgaccctnacattgtttccagtcgtattccnctgcatccaaagtctggcaacacggtcctttcngactaatctctcaactcaggctagaagacgagtctatttatactgctcctnactacgnaggtcgactacttattttcgttggttttcggcggtcggtacccagcttgacttcgttccttcgagtccacgcccgaaggcccttccgtcccccgttcgtccc

SEQ ID NO: 300590 - DNA, 584 bp, Homo sapiens
  misc_feature: GZ8MTXP01BALLY.21.87.H10.1.454.CMB.2.raw
  modified_base (196)..(196): a, c, t, g, unknown or other
  misc_feature (196)..(196): n is a, c, g, or t
  modified_base (290)..(290): a, c, t, g, unknown or other
  misc_feature (290)..(290): n is a, c, g, or t
  modified_base (366)..(366): a, c, t, g, unknown or other
  misc_feature (366)..(366): n is a, c, g, or t
tcagtcgtcgctcgcacgaccggtgctcgatttagcagtactgcgttgggtttgggggggtcacaagaggcagcgctctcgggacgtctccaccatggcctgggctctgctgctcctcactctcctcactcagggcacagggtcctgggcccagtctgccctgactcagcctgcctccgtgtctggtctcccgggnagtcggtcaccatctctgcgctggatccagcgatgatattggacttttactgtctctgtatcaacaacacagacaaagcccaaatcttaattcnggcgtcaatcagcgacctcactatcgtttccagtcattcctctgcatccaaaagtctggacaacacggtcctttcngactaatctctacaactcagctagaagacgagtcttattattactcgtcttcctactactacgcgtaggtcggtactacgtttacgtttttccgtttgggtttttcgggtacgggtcccgggtaacccttaggtaacgttggtaaccttcggttcccttcgttaacgttccgacggtccccgtaaagggtcccttacccggtccccgttcggttcccc

SEQ ID NO: 300591 - DNA, 577 bp, Homo sapiens
  misc_feature: GZ8MTXP01D9A41.21.87.H10.1.454.CMB.2.raw
  modified_base (295)..(295): a, c, t, g, unknown or other
  misc_feature (295)..(295): n is a, c, g, or t
  modified_base (357)..(357): a, c, t, g, unknown or other
  misc_feature (357)..(357): n is a, c, g, or t
  modified_base (369)..(369): a, c, t, g, unknown or other
  misc_feature (369)..(369): n is a, c, g, or t
  modified_base (421)..(421): a, c, t, g, unknown or other
  misc_feature (421)..(421): n is a, c, g, or t
tcagtcgtcgctcgcacgaccggtgctcgatttagcagtactgcgttgggtttgggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggtacttttactgtctctgtatcaacaacacagacaaagcccaaaactcttaattcngctacaatcagcacctcacatcgtttccagtcattcctctgcatccaaagtctggacaaacncggtcctttacncgacaactctctacaactcagctagaagacgagcttattattactgctcctnatacgcgagtcgactacttatttttcgttgggttttcggcgggtaacgggtaacccttaggtaacgttcgaaccttcggttacccttcgttaacggttccaaccggtaaccccgtaaagggtccccttccgggtcccccccgttaaggggttcccc

SEQ ID NO: 300592 - DNA, 601 bp, Homo sapiens
  misc_feature: GZ8MTXP01BLGNJ.21.87.H10.1.454.CMB.2.raw
  modified_base (198)..(198): a, c, t, g, unknown or other
  misc_feature (198)..(198): n is a, c, g, or t
  modified_base (291)..(291): a, c, t, g, unknown or other
  misc_feature (291)..(291): n is a, c, g, or t
tcagtcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggnagtcggtcaccatctcttgcgctggatccagcgatgatatggtacttttactgtctctgtatcaacacacagacaagcccaaactctaattcngcgtcaatcagcgaccctcactatcgttccagtcgattcctctgcactccaaagttcctggccaaaccgtacggtccctttactcgaactaacttccttactaccaacttcccgaaggtctagaaacgtacgaacggtacctttaatttattaactctaccgttcctactaacttacgacaacgggttgacttacgttatttttccgttggtttttacgggccggtcggggtacccttagtacgttcggtaactcggttccttcttacgttcacgtccgtaacggccttccgtaaccccgttcgttcccg

SEQ ID NO: 300593 - DNA, 566 bp, Homo sapiens
  misc_feature: GZ8MTXP01BJJIB.21.87.H10.1.454.CMB.2.raw
  modified_base (294)..(294): a, c, t, g, unknown or other
  misc_feature (294)..(294): n is a, c, g, or t
  modified_base (332)..(332): a, c, t, g, unknown or other
  misc_feature (332)..(332): n is a, c, g, or t
tcagtcgtcgctcgcacgaccggtgctcgatttagcagtactgcgttgggtttgggggggtcacaagaggcagcgctctcgggacgtctccaccatggcctgggctctgctgctcctcactctcctcactcagggcacagggtcctgggcccagtctgccctgactcagcctgcctccgtgtctgggtctccgggcagtcgtcaccatctcttgcgctggatccagcgatgattattggtacttttacctgtctctgtatcaacacacagacaaagccccaaatcttaatttcngctcaatcagcgacctcactatgtttccagtcattccnctgcatcccaaaagtctggacaacacggtcctttcagactaatctctcaactccagctagaagtacgagtcttattacttactgtctcctactactacgcgaggtgctacgttatttttcgtttggtttttcggcgggtaacggtacccgttaggtacttcgtacgttcgttcccgttcgttacgttccacgtccccgaaacgggcccttcccggtcccccgttccggttcccg

SEQ ID NO: 300594 - DNA, 626 bp, Homo sapiens
  misc_feature: GZ8MTXP01D93ZE.21.87.H10.1.454.CMB.2.raw
  modified_base (197)..(197): a, c, t, g, unknown or other
  misc_feature (197)..(197): n is a, c, g, or t
  modified_base (280)..(280): a, c, t, g, unknown or other
  misc_feature (280)..(280): n is a, c, g, or t
  modified_base (335)..(335): a, c, t, g, unknown or other
  misc_feature (335)..(335): n is a, c, g, or t
  modified_base (338)..(338): a, c, t, g, unknown or other
  misc_feature (338)..(338): n is a, c, g, or t
tcagtcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctcgtgtctgggtctcccgggnagtcggtcaccatctcttgcgctggactccagcatgtattattggtacttttaactgtctctgtatcaacacacagacaaacnccccaaatcttaattctgctacaatcagccgacctcactatctttccatcattcnctncatccaaagtctggacaacgaccgtcctttacgacgactaactcctctaccaacgttccagactaaggaaacgacgtaaggtacttaagtttattaacctcgtaccttcctactaacgttacgacgtaggttccggtacttactttacgttttttcggtttcgggttttcgggccggggtaacccgggtaacccgaggttaacgttcgtaaccggttccttaccgttcgttacgttccgacgtaacccgaacgggtcccttacccggtcccccgtttcgggtaacccc

SEQ ID NO: 300595 - DNA, 665 bp, Homo sapiens
  misc_feature: GZ8MTXP01ELAR6.21.87.H10.1.454.CMB.2.raw
  modified_base (194)..(194): a, c, t, g, unknown or other
  misc_feature (194)..(194): n is a, c, g, or t
  modified_base (205)..(205): a, c, t, g, unknown or other
  misc_feature (205)..(205): n is a, c, g, or t
  modified_base (231)..(231): a, c, t, g, unknown or other
  misc_feature (231)..(231): n is a, c, g, or t
  modified_base (261)..(261): a, c, t, g, unknown or other
  misc_feature (261)..(261): n is a, c, g, or t
  modified_base (285)..(285): a, c, t, g, unknown or other
  misc_feature (285)..(285): n is a, c, g, or t
  modified_base (338)..(338): a, c, t, g, unknown or other
  misc_feature (338)..(338): n is a, c, g, or t
tcagtcgtcgctcgcacgaccggtgctcgatttagcagtactgcgttgggtttgggggggtcacaagaggcagcgctctcgggacgtctccaccatggcctgggctctgctgctcctcactctcctcactcagggcacagggtcctgggcccagtctgccctgactcagcctgcctcgtgtctgggtctccggnagtcgtcaccntctcttgcgctgatccagcgatgatnttggtacttttactgtctctgtatcaacanacagacaagcccaaatcttattcngcgtcaatcagcgaccctcaactattcgtttaccagttctactttcctcgtanctactacctaaaagttctcggaccaaaccgtaccggttccttttacgtacgaaccttaacttcccttactaccgtaaacccgtcgacgggtaccttaagggaaacgtacggacgttacctttaattttacttaacgtcctaccgttaccgttaacaacgttaccggacgtaaccggggttcgttaacctttacgtttttcggtttttcggttttcgggtttccggaccgggtaaccggtaacgttaggtacgttacgtacgttcgttaccgttcgttacgtaaccgaaccgtaaccgtacggtccgttaccccgtcccgttcgtccc

SEQ ID NO: 300596 - DNA, 390 bp, Homo sapiens
  misc_feature: GZ8MTXP01CV7D8.21.87.H10.1.454.CMB.2.raw
  modified_base (232)..(232): a, c, t, g, unknown or other
  misc_feature (232)..(232): n is a, c, g, or t
  modified_base (382)..(390): a, c, t, g, unknown or other
  misc_feature (382)..(390): n is a, c, g, or t
tcagtcgtcgctcgcacgaccggtgctcgatttagcagtactgcgttgggttttaaccttgtctcctggtatcaacaacaccaggacaaagccccaaaactcttaatttctggcgtcaatcagcgaccctcacatgtttccagtcgattctcttcatccaagtctggcaacacggcctttctgacaatctctcaactccaggctgaagacgaggctatttatactgctcctnatacgcaggtgcactatttttctgggttttggcggcgggacccaggatgactgtcctcagtcagccccaaggcctgccccctcggtcactctgttccccgccctccctccgagcgacgactggacgcccggggctggcaaggcgacatgnnnnnnnnn

SEQ ID NO: 300597 - DNA, 575 bp, Homo sapiens
  misc_feature: GZ8MTXP01EBCNG.21.87.H10.1.454.CMB.2.raw
  modified_base (197)..(197): a, c, t, g, unknown or other
  misc_feature (197)..(197): n is a, c, g, or t
  modified_base (293)..(293): a, c, t, g, unknown or other
  misc_feature (293)..(293): n is a, c, g, or t
  modified_base (311)..(311): a, c, t, g, unknown or other
  misc_feature (311)..(311): n is a, c, g, or t
  modified_base (332)..(332): a, c, t, g, unknown or other
  misc_feature (332)..(332): n is a, c, g, or t
  modified_base (368)..(368): a, c, t, g, unknown or other
  misc_feature (368)..(368): n is a, c, g, or t
tcagtcgtcgctcgcacgaccggtgctcgatttagcagtactgcgttgggtttgggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggnagtcgtcaccatctcttgcgctggatccagcgatgatattggacttttactgtctctgtatcaacaacacagacaaacgccccaaatcttaattcngctcaatcagccgacctnactatgttccagtcgattccnctgctatccaaagtctggacaacgtacgtcctttangactaatctctacaactcagctagaagacgagtacttattatactcgtctctactatacgcgtagtcgtactacttagtttttcgttcgggtttttcgggccgggtaacgggtacccgttagtacgttcgtaacgttcggttaccttcgttacggttaaccacggtaacccgaacggtccgttaccgtcccccgttcggttaacccc

SEQ ID NO: 300598 - DNA, 570 bp, Homo sapiens
  misc_feature: GZ8MTXP01ALECF.21.87.H10.1.454.CMB.2.raw
  modified_base (291)..(291): a, c, t, g, unknown or other
  misc_feature (291)..(291): n is a, c, g, or t
  modified_base (373)..(373): a, c, t, g, unknown or other
  misc_feature (373)..(373): n is a, c, g, or t
  modified_base (433)..(433): a, c, t, g, unknown or other
  misc_feature (433)..(433): n is a, c, g, or t
tcagtcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacttttactgtctctgtatcaacacacagacaagcccaaatcttaattcngcgtcaatcagccgaccctcactatcgtttccagtctattccctctgcatccaaagttcctggaccaaactcggtcctttcngaactaactctactacaactccgagctagaacgacgagtacttatttactactgcttctnactacgctaggtgctacttgttttcgttagggttttcggcggtccgggaccttagtacttcggtacttcgttcccttcgttacgtcccgacggtccccgtaacggtcccgttacccgtcccccgttcggtaaccccg

SEQ ID NO: 300599 - DNA, 557 bp, Homo sapiens
  misc_feature: GZ8MTXP01AXTBY.21.87.H10.1.454.CMB.2.raw
  modified_base (193)..(193): a, c, t, g, unknown or other
  misc_feature (193)..(193): n is a, c, g, or t
  modified_base (291)..(291): a, c, t, g, unknown or other
  misc_feature (291)..(291): n is a, c, g, or t
  modified_base (303)..(303): a, c, t, g, unknown or other
  misc_feature (303)..(303): n is a, c, g, or t
  modified_base (306)..(306): a, c, t, g, unknown or other
  misc_feature (306)..(306): n is a, c, g, or t
  modified_base (417)..(417): a, c, t, g, unknown or other
  misc_feature (417)..(417): n is a, c, g, or t
  modified_base (428)..(428): a, c, t, g, unknown or other
  misc_feature (428)..(428): n is a, c, g, or t
tcagtcgtcgctcgcacgaccggtgctcgatttagcagtactgcgttgggtttggggggtcacaagaggcagcgctctcgggacgtctccaccatggcctgggctctgctgctcctcactctcctcactcagggcacagggtcctgggcccagtctgccctgactcagcctgcctcgtgtctggtctccgggnagtcgtcaccatctcttgcgctggatccagcgatgatattggacttttactgtctctgtatcaacacacagacaaagcccaaatcttaattctgctanaatcagcacctnacntcgtttccagtcattcctctgctatccaaaagtctggacaaaccgtacggtccctttcagacctaaattctctacaactccagctagaacgacgagtacttattatactcnctctcatacgntaggtgactacttattttcgtttaggttttcggcggtccggtacccgttagtacgttgtaacgttcgttcccgttcgttacgtccgacgtcccgaacggtccttacccgtcccccgttcgggttaaccc

SEQ ID NO: 300600 - DNA, 631 bp, Homo sapiens
  misc_feature: GZ8MTXP01AESED.21.87.H10.1.454.CMB.2.raw
  modified_base (196)..(196): a, c, t, g, unknown or other
  misc_feature (196)..(196): n is a, c, g, or t
  modified_base (299)..(299): a, c, t, g, unknown or other
  misc_feature (299)..(299): n is a, c, g, or t
  modified_base (348)..(348): a, c, t, g, unknown or other
  misc_feature (348)..(348): n is a, c, g, or t
tcagtcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctcgtgtctgggtctcccggnagtcgtcaccatctcttgcgctggatccagcgatgattagttggtacttttactgtctcgtgtactacaacacacagaacaaacgaccctaaatcttaattcngtactacaatcacgccacctcactattcgtttaccagttctattcctcngctactccaaagtccgtggacctaaaccgtcggttccctttgacgaactaactcctactactaactcgagtactacgaagacgtagtactttatttacttacgtcgtaccttctacgtacgtacgtacgtacggttcgtactttaacgttttcgttttttaccggtttcgggttttcggggaccgggtaacgggtaacccttaggtacgttcgtacgttcgttcccgttcgacgttccgaccgtaacccggtagtcccgttccggtccccgttcggttaaccc

SEQ ID NO: 300601 - DNA, 405 bp, Homo sapiens
  misc_feature: GZ8MTXP01ESBFL.21.87.H10.1.454.CMB.2.raw
  modified_base (234)..(234): a, c, t, g, unknown or other
  misc_feature (234)..(234): n is a, c, g, or t
  modified_base (240)..(240): a, c, t, g, unknown or other
  misc_feature (240)..(240): n is a, c, g, or t
  modified_base (291)..(291): a, c, t, g, unknown or other
  misc_feature (291)..(291): n is a, c, g, or t
  modified_base (388)..(405): a, c, t, g, unknown or other
  misc_feature (388)..(405): n is a, c, g, or t
tcagtcgtcgctcgcacgaccggtgctcgatttagcagtactgcgttgggttttaaccttgtctcctggtatcaacaacaccaggacaaagccccaaaactcttaatttctggcgtcaatcagcgaccctcacatgtttccagtcgattctctgcatccaagtctggcaacacggccttttctgacaatctctcaactccaggctgaagacgaggctatttattactgctcctnatacgnaggtgcactatttttcttggttttggcggcgggacccagatgactgtcctnagtcagcccaaggcctcgccccctggtcactctcgttccccaccctcctccgagcgacgactgacgccggggctgggaccaagggccgacaagtagnnnnnnnnnnnnnnnnnn

SEQ ID NO: 300602 - DNA, 621 bp, Homo sapiens
  misc_feature: GZ8MTXP01DCCHU.21.87.H10.1.454.CMB.2.raw
  modified_base (198)..(198): a, c, t, g, unknown or other
  misc_feature (198)..(198): n is a, c, g, or t
  modified_base (292)..(292): a, c, t, g, unknown or other
  misc_feature (292)..(292): n is a, c, g, or t
  modified_base (582)..(582): a, c, t, g, unknown or other
  misc_feature (582)..(582): n is a, c, g, or t
tcagtcgtcgctcgcacgaccggtgctcgatttagcagtactgcgttgggtttgggggggtcacaagaggcagcgctctcgggacgtctccaccatggcctgggctctgctgctcctcactctcctcactcagggcacagggtcctgggcccagtctgccctgactcagcctgcctccgtgtctgggtcctcccgggnagtcgtcaccatctcttgcgctggatccagcgatgatattggacttttactgtctctgtatcaacaacacagacaaagccccaaatctaattcngctcaatcagcacctcacattgtttccagtcgattcctctgctactccaaaagttctggacaaaccgtacggtcctttcgagactaaacttcctacttacaaaccttcccgaggtaccctaggaaacgtaccggtaaggtccttaaattttaacttaacttcgtaccgtttacccttactaaacgttaccggacgtaacggggttcgtaccttaaccgtttaagtttttttcgtttcgggtttttcgggccggtaacgggtaacccttagtattcgtactgttacccttnacgtcaacgccctaaggccttcgtccccgttggtaaccc

SEQ ID NO: 300603 - DNA, 648 bp, Homo sapiens
  misc_feature: GZ8MTXP01E285B.21.87.H10.1.454.CMB.2.raw
  modified_base (197)..(197): a, c, t, g, unknown or other
  misc_feature (197)..(197): n is a, c, g, or t
  modified_base (297)..(297): a, c, t, g, unknown or other
  misc_feature (297)..(297): n is a, c, g, or t
tcagtcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctcgtgtctgggtctcccgggnagtcggtcaccatctcttgcgctggatccagcgatgattattggtacttttactgtctctgtatcaacaacacagacaaacgaccccaaatcttaattcnggactcaatcagccacctcactattcgttccagtcgtattccctctgctatcccgaaaagttctggaccaaacgtaccggtccttttacagaactaatcctactaccaaactccgaagtctaaggaaacgtacgagttacttaagtttacttaactcgtccttaccgtacacgttacggacgtagggttcgtaccttaacgtttacgttttttcggtttaggggttttcgggcccgggtaaccggtaacccgttaggtacttcggtaaccgtttcgttacccgttcgttacggtaacccaacggtccccgtaaagggtccccttacccggtaaccccccgttggtaacccc

SEQ ID NO: 300604 - DNA, 585 bp, Homo sapiens
  misc_feature: GZ8MTXP01EM4BE.21.87.H10.1.454.CMB.2.raw
  modified_base (197)..(197): a, c, t, g, unknown or other
  misc_feature (197)..(197): n is a, c, g, or t
  modified_base (283)..(283): a, c, t, g, unknown or other
  misc_feature (283)..(283): n is a, c, g, or t
  modified_base (291)..(291): a, c, t, g, unknown or other
  misc_feature (291)..(291): n is a, c, g, or t
  modified_base (331)..(331): a, c, t, g, unknown or other
  misc_feature (331)..(331): n is a, c, g, or t
  modified_base (367)..(367): a, c, t, g, unknown or other
  misc_feature (367)..(367): n is a, c, g, or t
tcagtcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctccgtgtctggtctcccgggnagtcgtcaccatctcttgcgctggatccagcgatgattattggtacttttactgtctctgtatcaacacacagacaagcccaaatnttaattcngctcaatcagcaccctcactatgtttccagtcgatttccnctgcatccaaagttctggacaacgtacgtccctttnagactaatcctactactaactccaggctagaagtacgtaggtcttatttactactcgtaccttctactaactacgacgtaggttcggtacttactttacgtttttcggttcgggttttcggacccggggttcgggtaacccttaggtacgttcgtaacgttcgttacccgttgacgtcacgaacccgtacggtccgttacccgtccccgttcggtccc

SEQ ID NO: 300605 - DNA, 598 bp, Homo sapiens
  misc_feature: GZ8MTXP01C9JUS.21.87.H10.1.454.CMB.2.raw
  modified_base (197)..(197): a, c, t, g, unknown or other
  misc_feature (197)..(197): n is a, c, g, or t
tcagtcgtcgctcgcacgaccggtgctcgatttagcagtactgcgttgggtttgggggggtcacaagaggcagcgctctcgggacgtctccaccatggcctgggctctgctgctcctcactctcctcactcagggcacagggtcctgggcccagtctgccctgactcagcctgcctcgtgtctgggtcctcccgggnagtcggtcaccatctcttgcgctggactccagcgatgattattggtaccttttactgtctctgtatcaacacacagacaagcccaaactcttaattctggctcaatcagcaccctcactattcgtttccagtcgtacttcctctgcactcccaaagtctcggacaaccgaccggttcctttactacgaactaacttccttctaaccaacctcccgaagtcgtagaaacgacgtaggtacttaatttacttaacgttcgccttaccttcgaattaccgcgtaaggtcgtactacgtttatttttccgttgggttttcggccggtaacgggaccttggtattcgtacgtcgttccgttcgacgtccgtacgcccgaaggccttccgtcccccgttggtaaccc

SEQ ID NO: 300606 - DNA, 720 bp, Homo sapiens
  misc_feature: GZ8MTXP01CFX5L.21.87.H10.1.454.CMB.2.raw
  modified_base (196)..(196): a, c, t, g, unknown or other
  misc_feature (196)..(196): n is a, c, g, or t
  modified_base (295)..(295): a, c, t, g, unknown or other
  misc_feature (295)..(295): n is a, c, g, or t
tcagtcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctcgtgtctgggtctcccggnagtcgtcaccatctcttgcgctggactccagcgatgattagttggtactttttactgtctctgtatcaacacacagacaaagccccaaatcttaattcngctcaatcagcgacctcacatgtttccagtcgatttccactgctatcccaaaagttcctgggacctaaacgtaccgggtccttttacacggtaaacctaaacttcccgttaccttaccaaaccgttcccgaagggtacccttagggaaaacgtaccggtaagggttacccttaaagtttttaactttaacccgttcggttaccccgtttccgttaacctaacgttaaccggtacgtaacgggttcggtactttaaccgtttagtttttttccggtttgggttttttcgggaccggggttcccggggtaaccccgttaggtacgttacggtaacccgtttcgttcccgttcgttacggttccgtaaccggaaccccgtaaacgggggtccccttacccgggtcccccccgtttgggttaacccccg

SEQ ID NO: 300607 - DNA, 694 bp, Homo sapiens
  misc_feature: GZ8MTXP01ANK7B.21.87.H10.1.454.CMB.2.raw
tcagtcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctccgtgtctggtctcccggcagtcgtcaccatctcttgcgctggatccagcgatgattattcggtacttttactgtctctgtatcaacacacagacaaacgacccaaatcttaattctgctcaatcagcgaccctcaactattcgttacagtcgtattcctctgactataccaaagttctggactaaacgtacggtttctttacgtagaactaaacttccttactacctaaacctccgaaggtactaaggaaacgtacggtagtactttaatttaacgttacttcgtccgttacccttacgtaactaccggtacgtaacggggttcgtacctttaaacgtttttcgtttttttccgggttttaggggttttttaccggggcccggggttaacccgggtaaaccccgttaggttaaccgttcggttaaacccgtttcggttacccttacgttaccggttaaccaccggtaaccccgtaacgggtccccttccccgggtccccccgttcgggttaacccc

SEQ ID NO: 300608 - DNA, 640 bp, Homo sapiens
  misc_feature: GZ8MTXP01CS53X.21.87.H10.1.454.CMB.2.raw
tcagtcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctccgtgtctgggtctccgggcagtcgtcaccatctctgcgctgatccagcatgatattggtacttttactgtctctgtactacaacacacagaacaacaccctaaatcttaatctagctacatcagccgacctacactattcgttaccagtcgtacttccctctagactactacctaaaacgtctaacggacctaaacgtaccggttcctttacgacgtaactaactccttactactaaacctcgaacggtactaacggaaacgtacgtacggtactttaactttaactaccgttctacccgttcctaactaacgtaccggagtaacggtcgtacttacgttttacgtttttcggtttcgggtttcgggaccggtcgggtaaccaggttacgttcgtacgtcgttaccgttcgttaacgtccgaacgtccgacgtccgttcccgttccccgttaacggttcccg

SEQ ID NO: 300609 - DNA, 583 bp, Homo sapiens
  misc_feature: GZ8MTXP01D5HU0.21.87.H10.1.454.CMB.2.raw
  modified_base (198)..(198): a, c, t, g, unknown or other
  misc_feature (198)..(198): n is a, c, g, or t
  modified_base (284)..(284): a, c, t, g, unknown or other
  misc_feature (284)..(284): n is a, c, g, or t
  modified_base (291)..(291): a, c, t, g, unknown or other
  misc_feature (291)..(291): n is a, c, g, or t
  modified_base (296)..(296): a, c, t, g, unknown or other
  misc_feature (296)..(296): n is a, c, g, or t
  modified_base (309)..(309): a, c, t, g, unknown or other
  misc_feature (309)..(309): n is a, c, g, or t
  modified_base (373)..(373): a, c, t, g, unknown or other
  misc_feature (373)..(373): n is a, c, g, or t
tcagtcgtcgctcgcacgaccggtgctcgatttagcagtactgcgttggggtttggggggggtcacaagaggcagcgctctcgggacgtctccaccatggcctgggctctgctgctcctcactctcctcactcagggcgcagggtcctgggcccagtctgccctgactcagcctgcctccgtgtctggtctcccgggnagtcggtcacatctcttgcgctggatccagcgatgatattggtacttttacctgtctctgtatcaacacacagacaagcccaaatnttaatcnggctnatcagcctacctnactattgtttccagtctattccctctgctactccaaagtctggaccaacgtaccggtctttacngactactctactacactcgagtctagaagacgtagtacttatttacttactacgtcttacctacacgtacgcgtaggtcgtactacttttgtttttcgtttgggttttcggcgggtaacggtaccttaggtacgttgtaccgttcgttaccgttcgttacgttaaccgacgtcccgaacggtcccgttccgtcccccgttcggttccccg

SEQ ID NO: 300610 - DNA, 724 bp, Homo sapiens
  misc_feature: GZ8MTXP01CIZG5.21.87.H10.1.454.CMB.2.raw
  modified_base (300)..(300): a, c, t, g, unknown or other
  misc_feature (300)..(300): n is a, c, g, or t
  modified_base (350)..(350): a, c, t, g, unknown or other
  misc_feature (350)..(350): n is a, c, g, or t
tcagtcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctccgtgtctgggtcctcccgggcagtcgtcaccatctcttgcgctggatccagcatgattattggtactttttactgtctctgtatcaacaacacagaacaacgaccccaaaatcttaatttcnggactacaatcacgccaccctcactattgttaccagttcgtatttccccnctgactactccgaaaagttcctcgggacctaaaccgtaaccgggttcccttttacgacgaaactaacttcccttacctactaaacccgttccgaacggttaccgtaacggtaaacggaaccgtaagggtacctttaaacttttaacgttaccttacggtccgttcccttaacgtacgttaaccgacgtacgggttcggtaccttaacgtttacgttttttccggtttcgggttttttcggggccggttaacccggggtaacccgttaggttaacgttcggttaacgtttccgttcccgttacgttaccggttaaccgaaaccggtccccgtaaacgggtcccttaccccggtcccccgttccgggttaaccccg

SEQ ID NO: 300611 - DNA, 660 bp, Homo sapiens
  misc_feature: GZ8MTXP01C5PPZ.21.87.H10.1.454.CMB.2.raw
  modified_base (195)..(195): a, c, t, g, unknown or other
  misc_feature (195)..(195): n is a, c, g, or t
  modified_base (205)..(205): a, c, t, g, unknown or other
  misc_feature (205)..(205): n is a, c, g, or t
  modified_base (214)..(214): a, c, t, g, unknown or other
  misc_feature (214)..(214): n is a, c, g, or t
  modified_base (315)..(315): a, c, t, g, unknown or other
  misc_feature (315)..(315): n is a, c, g, or t
  modified_base (600)..(600): a, c, t, g, unknown or other
  misc_feature (600)..(600): n is a, c, g, or t
tcagtcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctcgtgtctggtctccgggnagtcgtcacntctctgcgntgactcagcgatgattagttggtacttttactgtctctgtatacaacaacacagaacaaacgaccccaaaatcttaattcaggctacaatcacgccacctnactattcgttacagtctattccctactgactactaccaaagttctcgaacctaacgtccgttcctttacgactactaactctactaccaactcgaagtcgtaagaacgtacgtacgtacttaatttaactccgtacgttaccgttaccttacgtaaagttaccggacgttaagggttcggtaccttttaaacgtttttacgtttttttccggggtttcgggttttacggggcccgggttaaccggggtaacccttagggttacttacgtaccgttcgttacccgngttaccgttaaccgaccgtaacccgacgggtcccttcccggtccccgttcggttaacccc

SEQ ID NO: 300612 - DNA, 676 bp, Homo sapiens
  misc_feature: GZ8MTXP01CV6DK.21.87.H10.1.454.CMB.2.raw
  modified_base (197)..(197): a, c, t, g, unknown or other
  misc_feature (197)..(197): n is a, c, g, or t
  modified_base (297)..(297): a, c, t, g, unknown or other
  misc_feature (297)..(297): n is a, c, g, or t
  modified_base (339)..(339): a, c, t, g, unknown or other
  misc_feature (339)..(339): n is a, c, g, or t
tcagtcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctcgtgtctgggtcctccgggnagtcgtcaccatctctgcgctggactccagcgatgatattggtacttttaactgtctctgtatacaacaacacagaacaaacgccccaaatcttaattcngctcaatcagccacctcacattcgttccagttcgactttccncttgctactccaaagtctggactaaacgtaccggtcctttcacgtaactaacttccttactacaaccttccgaacggtacgtagaaacgtacgtaaggtcctttaaatttacttaacttcgtacctttacccctacgtaacttaccggtcgtaagggttcgtacttaaccgttttagtttttttccggtttacggggtttttcgggccggggtaaccgggggtaacccttagggttaacgttcgttaacccgtttcgggttaccccttcggttaaccgttccgaacggtccccgtaaacgggtccccgttacccggtccccccgttcgggtttcccc

SEQ ID NO: 300613 - DNA, 674 bp, Homo sapiens
  misc_feature: GZ8MTXP01DOZCL.21.87.H10.1.454.CMB.2.raw
  modified_base (195)..(195): a, c, t, g, unknown or other
  misc_feature (195)..(195): n is a, c, g, or t
  modified_base (299)..(299): a, c, t, g, unknown or other
  misc_feature (299)..(299): n is a, c, g, or t
tcagtcgtcgctcgcacgaccggtgctcgatttagcagtactgcgttgggtttgggggggtcacaagaggcagcgctctcgggacgtctccaccatggcctgggctctgctgctcctcactctcctcactcagggcacagggtcctgggcccagtctgccctgactcagcctgcctcgtgtctggtctcccgggnagtcggtcaccatctcttgcgctggatccagcgatgattattggtacttttaacctgtctctgtatcaacaacacagaacaaacgacccctaaatcttaattcnggactacaatcagccgaccctcaactattcgtttaccagttcgtatttcccctactgtaccctaactacccgtaaaacgttccgtaacggacctaaaccgttccggttcccctttacgtacgtaaacctaactttccttacctaaccgtaaacctccgaacggtacctaaggaaacgtacgtacgttacctttaatttacttaactcgtaccttccgttaactaacgttaccgacgtacggtcgtacttacgtttacgttttttccggttgggttttccgggcggtaaccggtaaccgttagttaacgttcgtacgttcgttccttcgttacgtccgaccgccgtacggccgttacccgtccccgttaaggtccc

SEQ ID NO: 300614 - DNA, 610 bp, Homo sapiens
  misc_feature: GZ8MTXP01EI32Y.21.87.H10.1.454.CMB.2.raw
  modified_base (195)..(195): a, c, t, g, unknown or other
  misc_feature (195)..(195): n is a, c, g, or t
  modified_base (206)..(206): a, c, t, g, unknown or other
  misc_feature (206)..(206): n is a, c, g, or t
  modified_base (210)..(210): a, c, t, g, unknown or other
  misc_feature (210)..(210): n is a, c, g, or t
  modified_base (289)..(289): a, c, t, g, unknown or other
  misc_feature (289)..(289): n is a, c, g, or t
  modified_base (293)..(293): a, c, t, g, unknown or other
  misc_feature (293)..(293): n is a, c, g, or t
  modified_base (329)..(329): a, c, t, g, unknown or other
  misc_feature (329)..(329): n is a, c, g, or t
  modified_base (432)..(432): a, c, t, g, unknown or other
  misc_feature (432)..(432): n is a, c, g, or t
  modified_base (453)..(453): a, c, t, g, unknown or other
  misc_feature (453)..(453): n is a, c, g, or t
tcagtcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctcgtgtctggtctccgggnagtcgtcaccntctnttgcgctggatccagcgatgattattggtacttttactgtctctgtatcaacacacagacaagcccaaatcttaattcngctnatcagccacctcactattcgttccagtcgatttccnctgctatcccaaagtctcgacaacgtaccgtcctttactagaacttaacttcctactaccaactccgaggtacctaggaacgacgagtacttatttatacgtntccttacgtcaacgttaccgngtacggtcgtacttacgttttagtttttccggtttagggttttcgggccgggtaaccggtacccttaaggtcgttcggtacttcggttacccttgttacgttaacccacggtaacccgaacggggtcccttcccggttcccccgttcggttaacccc

SEQ ID NO: 300615 - DNA, 394 bp, Homo sapiens
  misc_feature: GZ8MTXP01DXAKG.21.87.H10.1.454.CMB.2.raw
  modified_base (353)..(353): a, c, t, g, unknown or other
  misc_feature (353)..(353): n is a, c, g, or t
  modified_base (385)..(394): a, c, t, g, unknown or other
  misc_feature (385)..(394): n is a, c, g, or t
tcagtcgtcgctcgcacgaccggtgctcgatttagcagtactgcgttgggttttaaccttgtctcctggtatcaacaacaccaggacaaagccccaaaactcttaatttctggcgtcaatcagcgaccctcacatgtttccagtcgattctctgcatccaagtctggcaacacggcctttctgacaatctctcaactccaggctgaagacgaggctatttatactgctcctcatacgcaggtgctactatttttcttgggttttggcggcgggacccagatgactgtcctcagtcacgcccaaggcctcgccccctggtccactctcgttccccaccctcctccgagcgacgntcggacggcgggctggcaacggcgcaagtagnnnnnnnnnn

SEQ ID NO: 300616 - DNA, 634 bp, Homo sapiens
  misc_feature: GZ8MTXP01C9ZUW.21.87.H10.1.454.CMB.2.raw
  modified_base (195)..(195): a, c, t, g, unknown or other
  misc_feature (195)..(195): n is a, c, g, or t
  modified_base (282)..(282): a, c, t, g, unknown or other
  misc_feature (282)..(282): n is a, c, g, or t
  modified_base (288)..(288): a, c, t, g, unknown or other
  misc_feature (288)..(288): n is a, c, g, or t
tcagtcgtcgctcgcacgaccggtgctcgatttagcagtactgcgttgggtttgggggggtcacaagaggcagcgctctcgggacgtctccaccatggcctgggctctgctgctcctcactctcctcactcagggcacagggtcctgggcccagtctgccctgactcagcctgcctcgtgtctggtctcccgggnagtcggtcaccatctcttgcgctggactccagcgatgatattggacttttaactgtctctgtatcaacacacagacaagcccaaatntattcngctcaatcagcacctcacattgtttccagtcgactttccctctgctactccaaaagttctggaccaaacctaccgggtccttttacacgactaaacttcctctacaaactccaaggcctagaacgaccggtaggtaccttaagtttaacttaactcgtaccttccttacaaattaccggcgtaacggtcggtaccttaaccgtttagttttttccgtttgggtttttcgggccgggttaaccgggtacccttaggtacttcgtaaccgtttcggttacccttcgttacggttccaccggtaaccccgtaagggtcccgttaccggtcccccccgttcgggttcccc

SEQ ID NO: 300617 - DNA, 550 bp, Homo sapiens
  misc_feature: GZ8MTXP01CXQVR.21.87.H10.1.454.CMB.2.raw
  modified_base (198)..(198): a, c, t, g, unknown or other
  misc_feature (198)..(198): n is a, c, g, or t
  modified_base (371)..(372): a, c, t, g, unknown or other
  misc_feature (371)..(372): n is a, c, g, or t
  modified_base (442)..(442): a, c, t, g, unknown or other
  misc_feature (442)..(442): n is a, c, g, or t
  modified_base (485)..(485): a, c, t, g, unknown or other
  misc_feature (485)..(485): n is a, c, g, or t
  modified_base (520)..(520): a, c, t, g, unknown or other
  misc_feature (520)..(520): n is a, c, g, or t
tcagtcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggnagtcgtcaccatctctgcgctggatccagcatgatattggtacttttaactgtctctggtatcaacacacagaacaagcccaaaactcttaattctgctacaatcagcgaccctcactattcgtttccagtcgtattcctctgcactcaaagtctggcaaacacggtccttannacactctctacaactcgagactagaacgacgagtcttaatttacttaactcgcttcctactaactaccgngtaaggtcgtactactttagttttttcggttggttttacgggnggtaaccggtaccagtacttgtactgttaccgttnacgtcacgtcacggcttccgtcccttgtcc

SEQ ID NO: 300618 - DNA, 593 bp, Homo sapiens
  misc_feature: GZ8MTXP01ET5VW.21.87.H10.1.454.CMB.2.raw
  modified_base (194)..(194): a, c, t, g, unknown or other
  misc_feature (194)..(194): n is a, c, g, or t
  modified_base (484)..(484): a, c, t, g, unknown or other
  misc_feature (484)..(484): n is a, c, g, or t
tcagtcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctcgtgtctggtctccggnagtcgtcaccatctctgcgctggatccagcgatgatattggtacttttactgtctctgtatcaacacacagaacaaacgccccaaaactcttaattctgctacaatcagcgaccctcaactatcgtttccagtcgtattcctctgctactcctaaagtctggactaaccgcggtcctttcgtagaactaatctactacaactccgagctagaacgtacgtacggtacttaacttaacttactacggtccttacccttagtaactacgtacgtaggtcgtctaaacgtttntttttccgttagggttttcggccggtaacgggtaaccttaggacttcgacttcggttaccttcgttacgtcacgtccgaacgtccgttccgtaaccccgttggtaaccc

SEQ ID NO: 300619 - DNA, 706 bp, Homo sapiens
  misc_feature: GZ8MTXP01BBU6H.21.87.H10.1.454.CMB.2.raw
  modified_base (193)..(193): a, c, t, g, unknown or other
  misc_feature (193)..(193): n is a, c, g, or t
  modified_base (204)..(204): a, c, t, g, unknown or other
  misc_feature (204)..(204): n is a, c, g, or t
  modified_base (301)..(301): a, c, t, g, unknown or other
  misc_feature (301)..(301): n is a, c, g, or t
  modified_base (308)..(308): a, c, t, g, unknown or other
  misc_feature (308)..(308): n is a, c, g, or t
  modified_base (315)..(315): a, c, t, g, unknown or other
  misc_feature (315)..(315): n is a, c, g, or t
tcagtcgtcgctcgcacgaccggtgctcgatttagcagtactgcgttgggtttgggggggtcacaagaggcagcgctctcgggacgtctccaccatggcctgggctctgctgctcctcactctcctcactcagggcacagggtcctgggcccagtctgccctgactcagcctgcctcgtgtctggtctccggnagtcgtcaccntctcttgcgctggatccagcgatgattagttggtacttttactgtctctgtatacaacaacacagaacaaacgacccaaatcttaattcagtactanaactcanccacctnactattcgttccagtcgtacttcctctagactactaccaaagtctcggacctaaacgtacccggttcctttacgacgaacttaaactcccttaacctacctaaaccgtcccgtaaggtaccttaaacggaaacggtaaccggttacggtaacctttaaacttttaaccgttaacgttccgtaccctttaaccctacgtaaaccgttaccgggacttaacggggttccggtaactttaaaccggttttacttttttcgggtttcggggttttacgggcccggggtaacccggtaaacccgttaggtaacgttcggtaacctttcggttccttacgacgttaaccacccggtaaccgtaacggtcccttacccgtcccccgttggttaacccc

SEQ ID NO: 300620 - DNA, 639 bp, Homo sapiens
  misc_feature: GZ8MTXP01DKA9L.21.87.H10.1.454.CMB.2.raw
  modified_base (197)..(197): a, c, t, g, unknown or other
  misc_feature (197)..(197): n is a, c, g, or t
  modified_base (207)..(207): a, c, t, g, unknown or other
  misc_feature (207)..(207): n is a, c, g, or t
  modified_base (216)..(216): a, c, t, g, unknown or other
  misc_feature (216)..(216): n is a, c, g, or t
tcagtcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctcgtgtctgggtcctccgggnagtcgtcacntctctgcgntgactccagcgatgatagttcggtacttttactgtctctgtatacaacacacagaacaaacgaccccaaatcttaattctggctacaatcacgccgacctacactattcgtttaccagtcgtatttccctctgactactacctaaaagttcctggacctaaaccgtaccggttccctttacacgtaactaaactccttactacctaaaccgtccgaggtactaaggaaacgtacgtaagttacttaatttactacgtcgtaccttcctacgaactacggcgtaggttcgacttacgtttacgtttttcggttgggttttcggcgggtaaccggtaaccttaggtacgttcgtaaccttcgttaccgttcgttacggtcgaaccgtcccgtaacggtccttcccggtccccgttcggttaaccc

SEQ ID NO: 300621 - DNA, 538 bp, Homo sapiens
  misc_feature: GZ8MTXP01ALXXM.21.87.H10.1.454.CMB.2.raw
  modified_base (194)..(194): a, c, t, g, unknown or other
  misc_feature (194)..(194): n is a, c, g, or t
  modified_base (205)..(205): a, c, t, g, unknown or other
  misc_feature (205)..(205): n is a, c, g, or t
  modified_base (293)..(293): a, c, t, g, unknown or other
  misc_feature (293)..(293): n is a, c, g, or t
  modified_base (311)..(311): a, c, t, g, unknown or other
  misc_feature (311)..(311): n is a, c, g, or t
  modified_base (370)..(370): a, c, t, g, unknown or other
  misc_feature (370)..(370): n is a, c, g, or t
  modified_base (416)..(416): a, c, t, g, unknown or other
  misc_feature (416)..(416): n is a, c, g, or t
  modified_base (422)..(422): a, c, t, g, unknown or other
  misc_feature (422)..(422): n is a, c, g, or t
  modified_base (440)..(440): a, c, t, g, unknown or other
  misc_feature (440)..(440): n is a, c, g, or t
tcagtcgtcgctcgcacgaccggtgctcgatttagcagtactgcgttgggtttgggggggtcacaagaggcagcgctctcgggactctccaccatggcctgggctctgctgctcctcactctcctcactcagggcacagggtcctgggcccagtctgccctgactcagcctgcctcgtgtctgggtctccgggnagtcgtcaccntctctgcgctggatccagcatgattattggacttttacctgtctctgtatcaacaacacaggacaaacgccccaaaatcttaatttcnggctcaatcagcgacctnactatgtttccagtcgattcctctgcatccaaaagttctggacaaacgtcggtcctttnagactaatctactcaactcagctagaagacgagtcttattatactnctctanatacgcagtgctaacttnttttcgttggttttcggcgggttcgggaccttagtacttcggtactcgttccttcttacgtcgacgcccgaacggtccttccgtccccgttcggtccc

SEQ ID NO: 300622 - DNA, 669 bp, Homo sapiens
  misc_feature: GZ8MTXP01CY11B.21.87.H10.1.454.CMB.2.raw
  modified_base (199)..(199): a, c, t, g, unknown or other
  misc_feature (199)..(199): n is a, c, g, or t
  modified_base (291)..(291): a, c, t, g, unknown or other
  misc_feature (291)..(291): n is a, c, g, or t
  modified_base (320)..(320): a, c, t, g, unknown or other
  misc_feature (320)..(320): n is a, c, g, or t
tcagtcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctccgtgtctgggtcctcccgggnagtcggtcaccatctcttgcgctggactccagcgatgattattggtactttttactgtctctgtatcaacacacagaacaaacgcccaaatnttaattctggctacaatcagccaccctanactattcgtttaccagtcgtactttccctctgctaactccctaaaagttctcggacctaaacgtaccggttcccttttacgacgtaacctaaacttcctacctaccaaaccgttccgaaggtccgtaaggtaaccggacggtaaggttacctttaatttaacgttacctacgtaccttccctactaacgtaccgtacgtaaggtcgtacttaacctttagttttttccggtttcgggtttcgggccgggtaaccgggtaacccttaggttacttcgtaccgttcgttccgttcttacggttaaccacggtcccgtaacggtccttaccccgtccccgttcggttaaccc

SEQ ID NO: 300623 - DNA, 723 bp, Homo sapiens
  misc_feature: GZ8MTXP01BV1LQ.21.87.H10.1.454.CMB.2.raw
  modified_base (296)..(296): a, c, t, g, unknown or other
  misc_feature (296)..(296): n is a, c, g, or t
  modified_base (301)..(301): a, c, t, g, unknown or other
  misc_feature (301)..(301): n is a, c, g, or t
tcagtcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctcgtgtctgggtctcccgggcagtcggtcaccatctcttgcgctggatccagcgatgattattggtacttttactgtctctgtatcaacaacacagacaaacgccccaaatcttaattcngctanatcagcaccctcactattcgtttaccagtcgtacttccctctgctactcctaaaagttctggacctaaaccgtccggtcctttcgacgaacctaaacttccttacctacctaaaccttcccgaacgggtacgtaacggtaaacggtaccgggtaacggttactttaaacgttttaacttaaccgttacgtccctttacccgttacgtaaaccgttaccggtacggtacggggttaccggtacctttaaaccgttttacgttttttttccgggtttacggggttttttccggggccggggtaaccggggtaaaccccttaggttacgttcgtaaaccgttcggttacccttccgttaccggttaaccacccggtcccggtaaacgggtcccgttacccggtccccccgtttcgggttaacccc

SEQ ID NO: 300624 - DNA, 386 bp, Homo sapiens
  misc_feature: GZ8MTXP01COA79.21.87.H10.1.454.CMB.2.raw
  modified_base (238)..(238): a, c, t, g, unknown or other
  misc_feature (238)..(238): n is a, c, g, or t
  modified_base (295)..(295): a, c, t, g, unknown or other
  misc_feature (295)..(295): n is a, c, g, or t
  modified_base (320)..(320): a, c, t, g, unknown or other
  misc_feature (320)..(320): n is a, c, g, or t
  modified_base (337)..(337): a, c, t, g, unknown or other
  misc_feature (337)..(337): n is a, c, g, or t
  modified_base (342)..(342): a, c, t, g, unknown or other
  misc_feature (342)..(342): n is a, c, g, or t
  modified_base (348)..(348): a, c, t, g, unknown or other
  misc_feature (348)..(348): n is a, c, g, or t
  modified_base (371)..(371): a, c, t, g, unknown or other
  misc_feature (371)..(371): n is a, c, g, or t
  modified_base (376)..(386): a, c, t, g, unknown or other
  misc_feature (376)..(386): n is a, c, g, or t
tcagtcgtcgctcgcacgaccggtgctcgatttagcagtactgcgttgggttttaaccttgtctcctggtatcaacaacaccaggacaaagccccaaaactcttaatttctggcgtcaatcagcgaccctcacatgtttccagtcgattctctgcatccaagtctggcaacacggcctttctgacaatctctcaactccaggctgaagacgaggctatttatactgctcctcatacgnaggtgctacttatttttcgttgggtttttggcggtcgggacccagatgactgtcctngtcagcccaggctcgccccctggcnctctctcccaccctccnccgancgacgntcgacgcgggctggcaaggcacntacgnnnnnnnnnnn

SEQ ID NO: 300625 - DNA, 684 bp, Homo sapiens
  misc_feature: GZ8MTXP01A23SU.21.87.H10.1.454.CMB.2.raw
tcagtcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctcgtgtcgtgggtcctccgggcagtcgtcaccatctcttgcgctggatccagcatgattagttggtacttttactgtctctgtatacaacacacagaacaacgacccaaactcttaattctacgtctacaatcacgccacctacactattcgtttaccagtcgtacttcctctcgactactccaaaacgttcgtcggactaaacgtaccggttcctttacgtacgtaactaaacttcctaccttaacctaaccttccgagtacgtaacggaaacggtacgaacggttacttaaacttttaacgttacttaccgtaccgttaccttacgtaacgtacggacgtacgggtcgtacttaacgttttacgttttttcggtttcgggtttttcgggacccggggtaaccgggtaacccttaggttaacttcggttaacgttcgttccgttcgttagttaacccgacggtaaccccgtacggtcccgttacccggtcccccgttcggttaaccc

SEQ ID NO: 300626 - DNA, 641 bp, Homo sapiens
  misc_feature: GZ8MTXP01C4NMC.21.87.H10.1.454.CMB.2.raw
  modified_base (197)..(197): a, c, t, g, unknown or other
  misc_feature (197)..(197): n is a, c, g, or t
  modified_base (302)..(302): a, c, t, g, unknown or other
  misc_feature (302)..(302): n is a, c, g, or t
  modified_base (308)..(308): a, c, t, g, unknown or other
  misc_feature (308)..(308): n is a, c, g, or t
  modified_base (321)..(321): a, c, t, g, unknown or other
  misc_feature (321)..(321): n is a, c, g, or t
  modified_base (346)..(346): a, c, t, g, unknown or other
  misc_feature (346)..(346): n is a, c, g, or t
  modified_base (392)..(392): a, c, t, g, unknown or other
  misc_feature (392)..(392): n is a, c, g, or t
  modified_base (554)..(554): a, c, t, g, unknown or other
  misc_feature (554)..(554): n is a, c, g, or t
tcagtcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctccgtgtctggtctcccgggnagtcgtcacatctcttgcgctggatccagcgatgattagttacggtacttttaactgtctcgtgtatacaacaacacagaacaaacgaccctaaatcttaattcngactanaatcagccacctnactattgttaccagttctattcccnctgctataccaaagttctcggacctaaaccgtaccggttcctttanacgtaactaaacttcctacctaacgtaaacctccgaggtactaaggaaacgtacgtaacgtacttaatttactaactctaccgttacctatacgtacgcgtaaggttcgtacttacgtttagtttttcgggttggttttcggccgggtaaccggtaacccgngtacgttacgtaccgtcgttacccttcggttactaaccgaccgtaaccgtaaccgggtccttccccggtcccccgttaaggttcccc

SEQ ID NO: 300627 - DNA, 574 bp, Homo sapiens
  misc_feature: GZ8MTXP01DP3SN.21.87.H10.1.454.CMB.2.raw
  modified_base (294)..(294): a, c, t, g, unknown or other
  misc_feature (294)..(294): n is a, c, g, or t
  modified_base (312)..(312): a, c, t, g, unknown or other
  misc_feature (312)..(312): n is a, c, g, or t
  modified_base (332)..(332): a, c, t, g, unknown or other
  misc_feature (332)..(332): n is a, c, g, or t
  modified_base (370)..(370): a, c, t, g, unknown or other
  misc_feature (370)..(370): n is a, c, g, or t
tcagtcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctccgtgtctggtctccgggcagtcggtcaccatctcttgcgctggatccagcgatgatattggacttttaactgtctctgtatcaacaacacagacaaagccccaaaatcttaattcngactcaatcagcaccctnactatgttccagtcattccnctgcatccaaaagtctggacaaacgacggtcctttacngactaaactctactacaaactccaaggctagaacgacgtagacttattatactcgctctactatacgcgtaaggtggtacctaacttagttttttcgtttagggtttttcgggccgggtcgggtaacccaggtattacgtacgttcgttccgttccttagttccaacgtcccgaaacgggcttccgtcccccgttcggtaaccc

SEQ ID NO: 300628 - DNA, 614 bp, Homo sapiens
  misc_feature: GZ8MTXP01BY20D.21.87.H10.1.454.CMB.2.raw
  modified_base (306)..(306): a, c, t, g, unknown or other
  misc_feature (306)..(306): n is a, c, g, or t
  modified_base (555)..(555): a, c, t, g, unknown or other
  misc_feature (555)..(555): n is a, c, g, or t
tcagtcgtcgctcgcacgaccggtgctcgatttagcagtactgcgttggggtttggggggggtcacaagaggcagcgctctcgggacgtctccaccatggcctgggctctgctgctcctcactctcctcactcagggcacagggtcctgggcccagtctgccctgactcagcctgccctcgtgtctgggtcctccgggcagtcggtcacctatctcttgcgtctggactccgagcgatgatagttcggtacttttaacctgtctctagtatacaacacacagacaacgacccaaactcttaattcnggctacaatcacgcgaccctacactattcgttaccagtcgtattccctctcgactactaccgtaaacgtcttcgggactaaaccgtaccggttcccttttcgacgaaactacttcctacctaccaactcgaggtactaggaacgacgtaaggtcttaattacgttactcgtccttcctacgaacttcgacgtggtacgtacttacgttttactttttccgggttggttttcgggacggtccggtaaccngtacgttcggtactcggttccttcgacgtcaccgctacgccttccgtcccgttcgtccc

SEQ ID NO: 300629 - DNA, 740 bp, Homo sapiens
  misc_feature: GZ8MTXP01AG3I1.21.87.H10.1.454.CMB.2.raw
  modified_base (197)..(197): a, c, t, g, unknown or other
  misc_feature (197)..(197): n is a, c, g, or t
  modified_base (208)..(208): a, c, t, g, unknown or other
  misc_feature (208)..(208): n is a, c, g, or t
  modified_base (304)..(304): a, c, t, g, unknown or other
  misc_feature (304)..(304): n is a, c, g, or t
tcagtcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctcgtgtctgggtcctccgggnagtcgtcaccntctcttgcgctggactccagcgatgatattggtacttttactgtctctgtatacaacacacaggacaacgacccctaaatcttaattctggactanaaactcacgccgtaccctcaactacttcgtttcccaagttccgtactttcccctcgttgacctaactacccgtaaaacgttccgttcgggacctaaacccgtaccgggttaccctttttacgacgtaaacctaaaccttccttaaccgtacctaaacccgttcccgaagggtaccttaacgggaaacgtacccggtaggtttaacctttaattttaaccgttaacgttccgtaccgttacccttacgtaacgttaccggacggtaacgggttcggtacctttacgtttttacgttttttcggtttcgggggtttttccgggcggggtaacccgggtaaccttagggtacttaggtacccgttcgttcccgacgttacggtaaccgaaccgtcccgtaacgggtcccgttaccccggtcccccgttcggttaacccc

SEQ ID NO: 300630 - DNA, 644 bp, Homo sapiens
  misc_feature: GZ8MTXP01A6SJF.21.87.H10.1.454.CMB.2.raw
  modified_base (199)..(199): a, c, t, g, unknown or other
  misc_feature (199)..(199): n is a, c, g, or t
  modified_base (210)..(210): a, c, t, g, unknown or other
  misc_feature (210)..(210): n is a, c, g, or t
  modified_base (214)..(214): a, c, t, g, unknown or other
  misc_feature (214)..(214): n is a, c, g, or t
  modified_base (299)..(299): a, c, t, g, unknown or other
  misc_feature (299)..(299): n is a, c, g, or t
  modified_base (315)..(315): a, c, t, g, unknown or other
  misc_feature (315)..(315): n is a, c, g, or t
  modified_base (318)..(318): a, c, t, g, unknown or other
  misc_feature (318)..(318): n is a, c, g, or t
  modified_base (336)..(336): a, c, t, g, unknown or other
  misc_feature (336)..(336): n is a, c, g, or t
  modified_base (373)..(373): a, c, t, g, unknown or other
  misc_feature (373)..(373): n is a, c, g, or t
tcagtcgtcgctcgcacgaccggtgctcgatttagcagtactgcgttgggtttggggggggtcacaagaggcagcgctctcgggacgtctccaccatggcctgggctctgctgctcctcactctcctcactcagggcacgagggtcctgggcccagtctgccctgactcagcctgcctcgtgtctgggtcctcccgggnagtcgtcaccntctntgcgctgactccgagcatgattagttggtaccttttacctgtctcgtgtactacaacacacagacaacgcccaaatcttaattcngactcatcagcacctnatntgttccagtcattcctcngctactcaaagtctggactaaaccgtcgtccctttanacgactaactcgtactaccaactcgacgattagaacgtacgtacgtacttatttacttaacgtcgtaccttaccctacgtaaacgttacggacgtacgggttcggtacctttaaacggtttcgttttttcgggttttcgggttttaccgggcccggggttaaccgggtaacccttaggggttacttccggttaaccgttccgttaccgttgacccgtaaccgtaccggtaaccctaggggtcccttacccggtcccccgttcggtaacccc

SEQ ID NO: 300631 - DNA, 508 bp, Homo sapiens
  misc_feature: GZ8MTXP02HGWAW.21.87.H10.1.454.CMB.2.raw
  modified_base (315)..(315): a, c, t, g, unknown or other
  misc_feature (315)..(315): n is a, c, g, or t
  modified_base (365)..(365): a, c, t, g, unknown or other
  misc_feature (365)..(365): n is a, c, g, or t
tcagtcgtcgctcgcacgaccggtgctcgatttagcagtactgcgttgggtttggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacgttttaacctgtctcctggtatcaacacaccagacaaagccccaaaatcttaattctgctcaatcagcgacctnacatgttccagtcgattcctctgcatccaagtctggcaacacgtcctttntgacatctctcaactcagctgaagacgagctattattactgtctctcatacgcaggtcgctacttatttttcgttggtttttcggcggtcgggacctagtactgactcgtcctcagtcgacgccacggctcgcccctcggtcc

SEQ ID NO: 300632 - DNA, 505 bp, Homo sapiens
  misc_feature: GZ8MTXP02JT72Z.21.87.H10.1.454.CMB.2.raw
  modified_base (370)..(370): a, c, t, g, unknown or other
  misc_feature (370)..(370): n is a, c, g, or t
  modified_base (419)..(419): a, c, t, g, unknown or other
  misc_feature (419)..(419): n is a, c, g, or t
  modified_base (478)..(478): a, c, t, g, unknown or other
  misc_feature (478)..(478): n is a, c, g, or t
  modified_base (493)..(493): a, c, t, g, unknown or other
  misc_feature (493)..(493): n is a, c, g, or t
  modified_base (500)..(500): a, c, t, g, unknown or other
  misc_feature (500)..(500): n is a, c, g, or t
tcagtcgtcgctcgcacgaccggtgctcgatttagcagtactgcgttgggtttgggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacttttaacctgtctcctggtatcaacaacaccaggacaaagccccaaaactcttaaatttctggctcaatcagcgaccctcacatgtttccagtcgattcctctgcatccaagtctgcaacacggcctttntgacaatctcttcaactcaggctagaagacgagctattatactgctctnatacgcaggtgctactatttttctggttttgcggtcgggacccagactgactcgtcctnagtcagcccaggtcncgccccnggtcc

SEQ ID NO: 300633 - DNA, 548 bp, Homo sapiens
  misc_feature: GZ8MTXP02HF1WK.21.87.H10.1.454.CMB.2.raw
  modified_base (196)..(196): a, c, t, g, unknown or other
  misc_feature (196)..(196): n is a, c, g, or t
  modified_base (436)..(436): a, c, t, g, unknown or other
  misc_feature (436)..(436): n is a, c, g, or t
tcagtcgtcgctcgcacgaccggtgctcgatttagcagtactgcgttgggtttggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggnagtcggtcaccatctcttgcgctggatccagcgatgatattggacttttaaccttgtctcctgtatcaacaacaccaggacaaagaccccaaaatcttaatttctggctcaaatcagccgaccctcacatgtttccagtcgtattcctctgcatccaaagtctggacaaactaccggtcctttcagactaatctctacaactcagctagaagacgagctattatactgtctctcatacgnagtgactactattttcttaggttttcgacggtacggtacccagtacgtcgtacttcgtcctacgtacgtaaccgacggacccgaacggtcctccgtcccccgttacggtccc

SEQ ID NO: 300634 - DNA, 526 bp, Homo sapiens
  misc_feature: GZ8MTXP02I6QB3.21.87.H10.1.454.CMB.2.raw
  modified_base (319)..(319): a, c, t, g, unknown or other
  misc_feature (319)..(319): n is a, c, g, or t
  modified_base (370)..(370): a, c, t, g, unknown or other
  misc_feature (370)..(370): n is a, c, g, or t
tcagtcgtcgctcgcacgaccggtgctcgatttagcagtactgcgttgggtttggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacttttaacctgtctcctgtatcaacaacaccaggacaaagccccaaaatcttaaatttctggctcaatcagcgaccctnacatgtttccagtcgattcctctgcatccaagtctggcaacacggtccttntgactaatctctcaactcagctagaagacgagctattattactgtctcctcatacgcaggtgctactattttcgttggttttcgcggtcggtaccagtactcgtacgtcgtcctcgacgtcgacgacccgtaacggcctacgccccctcggtaccc

SEQ ID NO: 300635 - DNA, 521 bp, Homo sapiens
  misc_feature: GZ8MTXP02JRC6W.21.87.H10.1.454.CMB.2.raw
  modified_base (299)..(299): a, c, t, g, unknown or other
  misc_feature (299)..(299): n is a, c, g, or t
  modified_base (304)..(304): a, c, t, g, unknown or other
  misc_feature (304)..(304): n is a, c, g, or t
  modified_base (318)..(318): a, c, t, g, unknown or other
  misc_feature (318)..(318): n is a, c, g, or t
  modified_base (359)..(359): a, c, t, g, unknown or other
  misc_feature (359)..(359): n is a, c, g, or t
  modified_base (368)..(368): a, c, t, g, unknown or other
  misc_feature (368)..(368): n is a, c, g, or t
  modified_base (419)..(419): a, c, t, g, unknown or other
  misc_feature (419)..(419): n is a, c, g, or t
tcagtcgtcgctcgcacgaccggtgctcgatttagcagtactgcgttgggtttggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacttttaacctgtctcctggtatcaacaacaccaggacaaagccccaaaatcttaattcnggctnaatcagcgaccctnacatgttccagtcgattcctctgcatccaagtctggcaacncgtcctttngacaatctctacaactcaggctagagacgagcttattattactgtctcctnatacgcaggtcgctacttatttttcgttggttttcggcggtcggacctagacgtcgactcgtccttgacgtcgacgtcccacggctccgtccccgtcggtcc

SEQ ID NO: 300636 - DNA, 380 bp, Homo sapiens
  misc_feature: GZ8MTXP02H23DQ.21.87.H10.1.454.CMB.2.raw
  modified_base (182)..(182): a, c, t, g, unknown or other
  misc_feature (182)..(182): n is a, c, g, or t
  modified_base (232)..(232): a, c, t, g, unknown or other
  misc_feature (232)..(232): n is a, c, g, or t
  modified_base (248)..(248): a, c, t, g, unknown or other
  misc_feature (248)..(248): n is a, c, g, or t
  modified_base (369)..(369): a, c, t, g, unknown or other
  misc_feature (369)..(369): n is a, c, g, or t
  modified_base (373)..(380): a, c, t, g, unknown or other
  misc_feature (373)..(380): n is a, c, g, or t
tcagtcgtcgctcgcacgaccggtgctcgatttagcagtactgcgttgggttttaaccttgtctcctggtatcaacaacaccaggacaaagccccaaaactcttaatttctggcgtcaatcagcgaccctcacatgtttccagtcgattctctgcatccaagtctggcaacacggcctttcngacaatctctcaactccaggctgaagacgaggctatttattactgctctnatacgcaggtgcactntttttcttggttttggcggcgggacccagatgactgtcctcagtcagcccaaggctcgccccctggtccactctgttccccgccctcctccgagcgacgactgcgcggctggcaaggcgcntagnnnnnnnn

SEQ ID NO: 300637 - DNA, 528 bp, Homo sapiens
  misc_feature: GZ8MTXP02GG7YD.21.87.H10.1.454.CMB.2.raw
  modified_base (301)..(301): a, c, t, g, unknown or other
  misc_feature (301)..(301): n is a, c, g, or t
  modified_base (322)..(322): a, c, t, g, unknown or other
  misc_feature (322)..(322): n is a, c, g, or t
  modified_base (379)..(379): a, c, t, g, unknown or other
  misc_feature (379)..(379): n is a, c, g, or t
  modified_base (431)..(431): a, c, t, g, unknown or other
  misc_feature (431)..(431): n is a, c, g, or t
tcagtcgtcgctcgcacgaccggtgctcgatttagcagtactgcgttgggtttgggggtcacaagaggcagcgctctcgggacgtctccaccatggcctgggctctgctgctcctcactctcctcactcagggcacagggtcctgggcccagtctgccctgactcagcctgcctccgtgtctgggtcctcccgggcagtcggtcaccatctcttgcgctggatccagcgatgatattggacgttttaacctgtctctggtatcaacaacaccaggacaaagccccaaaactcttaatttcnggcgtacaatcagcgaccctnacattgtttccagtcgattcctctgcatccaaagttctggcaacacggtcctttganacaatctctacaactccaggctagaagacgagactattattactgctcctanatacgcaggtgacacttatttttcgttggttttggcggtacgggacccaggtatcgacttcgtcctcagtcacgccaacggtctccgccccgtgtcc

SEQ ID NO: 300638 - DNA, 503 bp, Homo sapiens
  misc_feature: GZ8MTXP02FNSRG.21.87.H10.1.454.CMB.2.raw
  modified_base (355)..(355): a, c, t, g, unknown or other
  misc_feature (355)..(355): n is a, c, g, or t
  modified_base (365)..(365): a, c, t, g, unknown or other
  misc_feature (365)..(365): n is a, c, g, or t
  modified_base (414)..(414): a, c, t, g, unknown or other
  misc_feature (414)..(414): n is a, c, g, or t
tcagtcgtcgctcgcacgaccggtgctcgatttagcagtactgcgttgggtttggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacttttactgtctcctgtatcaacaacaccagacaaagccccaaaactcttaattctggctcaatcagcacctcacatgtttccagtcgattcctctgcatccaagttctgcaacncggcctttcngacatctctcaactcagctgagacgagctattatactgctctcatacgnagtgctacttattttcgttggttttggcggtccgggaccagtactggactcgtccctcgtagtcacgcccgacgctcgcccctcggtcc

SEQ ID NO: 300639 - DNA, 563 bp, Homo sapiens
  misc_feature: GZ8MTXP02G5U8C.21.87.H10.1.454.CMB.2.raw
  modified_base (290)..(290): a, c, t, g, unknown or other
  misc_feature (290)..(290): n is a, c, g, or t
  modified_base (294)..(294): a, c, t, g, unknown or other
  misc_feature (294)..(294): n is a, c, g, or t
  modified_base (360)..(360): a, c, t, g, unknown or other
  misc_feature (360)..(360): n is a, c, g, or t
tcagtcgtcgctcgcacgaccggtgctcgatttagcagtactgcgttgggtttggggggtcacaagaggcagcgctctcgggacgtctccaccatggcctgggctctgctgctcctcactctcctcactcagggcacagggtcctgggcccagtctgccctgactcagcctgcctccgtgtctgggtctccgggcagtcggtcacatctcttgcgctggatccagcgatgatattggacttttacctgtctctgtatcaacacacagacaaacgcccaaatcttaattcngctnaatcagcgacctcacatcgtttccagtcgtattcctctgcatccaagtctgcaactccgtcctttnagaacaatctctacaactcagctagacgacgagtacttatttatactgtcctacttcgaatacgacgtaggtacgactacgtttagtttttcgtttgggtttttcggcggttaccggtacccgtaggtactcggacttcgttaccctacgtacgttaaccgaccgtacccgaacggtccgtccgtcccccgttacggttcccg

SEQ ID NO: 300640 - DNA, 529 bp, Homo sapiens
  misc_feature: GZ8MTXP02GQP1H.21.87.H10.1.454.CMB.2.raw
  modified_base (236)..(236): a, c, t, g, unknown or other
  misc_feature (236)..(236): n is a, c, g, or t
  modified_base (296)..(296): a, c, t, g, unknown or other
  misc_feature (296)..(296): n is a, c, g, or t
tcagtcgtcgctcgcacgaccggtgctcgatttagcagtactgcgttgggtttgggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatnttggacttttaactgtctctgtatcaacacaccagacaaagccccaaaatcttaatttcnggctcaatcagcgaccctcactattcgtttccagtctattcctctgcatccaagttctggcaacacggtcctttcagacaactctctacaactccaggcctagaacgacgagtcttattacttactgtactctacatacgcaggtgactactattttcgttggttttcggcggtcggacctgtactgactcgtcctctagtctacgaccgaggtcctcgtccccgtcggtacc

SEQ ID NO: 300641 - DNA, 570 bp, Homo sapiens
  misc_feature: GZ8MTXP02H605N.21.87.H10.1.454.CMB.2.raw
  modified_base (318)..(318): a, c, t, g, unknown or other
  misc_feature (318)..(318): n is a, c, g, or t
  modified_base (338)..(338): a, c, t, g, unknown or other
  misc_feature (338)..(338): n is a, c, g, or t
  modified_base (373)..(373): a, c, t, g, unknown or other
  misc_feature (373)..(373): n is a, c, g, or t
tcagtcgtcgctcgcacgaccggtgctcgatttagcagtactgcgttgggtttgggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacgttttaaccttgtctcctggtatcaacaacacaggacaaagccccaaaatctaatttctggctcaatcagcgaccctnacatgttaccagtcattccnctgcactccaagtctggacaacaccggtcctttcngactaaatcctctacaactccaggcctagaagacgaggtcttatttatactgctacctcatacgcgaggtcgactactatttttcgtagggtttttcggccgggtacgggtacccctaggtactacggtacgttcgtcccttcgaacgttccgacgtaccccgaaacggtcctacccggtcccccgttacggtcccg

SEQ ID NO: 300642 - DNA, 527 bp, Homo sapiens
  misc_feature: GZ8MTXP02IE3RF.21.87.H10.1.454.CMB.2.raw
  modified_base (339)..(339): a, c, t, g, unknown or other
  misc_feature (339)..(339): n is a, c, g, or t
  modified_base (361)..(361): a, c, t, g, unknown or other
  misc_feature (361)..(361): n is a, c, g, or t
  modified_base (371)..(371): a, c, t, g, unknown or other
  misc_feature (371)..(371): n is a, c, g, or t
  modified_base (381)..(381): a, c, t, g, unknown or other
  misc_feature (381)..(381): n is a, c, g, or t
  modified_base (492)..(492): a, c, t, g, unknown or other
  misc_feature (492)..(492): n is a, c, g, or t
tcagtcgtcgctcgcacgaccggtgctcgatttagcagtactgcgttgggtttggggggtcacaagaggcagcgctctcgggacgtctccaccatggcctgggctctgctgctcctcactctcctcactcagggcacagggtcctgggcccagtctgccctgactcagcctgcctccgtgtctgggtcctccgggcagtcggtcaccatctcttgcgctggatccagcgatgattattggacttttaaccttgtctcctgtatcaacaacaccagacaaagccccaaaatcttaattctggctcaaatcagcgaccctcactatgtttccagtcattcnctgcatccaagttctggcaacncgtcctttcngacaatctcncactcagctagaagacgagtcttatttacttactgtcctctatacgttacgcaggtgactacttattttcgttggttttgcggtcggacctagacttacggactcgtcctntacgtcgacgaccaggcctccgccccttacggtcc

SEQ ID NO: 300643 - DNA, 537 bp, Homo sapiens
  misc_feature: GZ8MTXP02IW5YL.21.87.H10.1.454.CMB.2.raw
  modified_base (196)..(196): a, c, t, g, unknown or other
  misc_feature (196)..(196): n is a, c, g, or t
tcagtcgtcgctcgcacgaccggtgctcgatttagcagtactgcgttgggtttggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggnagtcggtcaccatctcttgcgctggatccagcgatgatattggactttactgtctctgtatcaacacaccagacaaagaccccaaaatcttaatttctgctcaatcagcgaccctcacattgttccagtcattcctctgcatccaagtctggccaaactacggtcctttctagacaatctctacaactccaggctagaagacgagactattattactgtctctacatacgacaggtgactacttatttttccgtttggttttcggacggtcggacctagtacgtagacgttcgtacctactacgtcacggacctaacggcctccgcccccgttcgtacccg

SEQ ID NO: 300644 - DNA, 637 bp, Homo sapiens
  misc_feature: GZ8MTXP02JHVMS.21.87.H10.1.454.CMB.2.raw
  modified_base (293)..(293): a, c, t, g, unknown or other
  misc_feature (293)..(293): n is a, c, g, or t
tcagtcgtcgctcgcacgaccggtgctcgatttagcagtactgcgttgggtttgggggggtcacaagaggcagcgctctcgggacgtctccaccatggcctgggctctgctgctcctcactctcctcactcagggcacagggtcctgggcccagtctgccctgactcagcctgcctccgtgtctgggtctccgggcagtcggtcaccatctcttgcgctggatccagcgatgatattggacttttactgtctctgtatcaacacacagacaaacgccccaaatcttaatttcngctcaatcagcgaccctcacatcgttccagtcattcctctgcatccaagtctggacaacaccggtcctttcacgaactaactcctactacaaaccttccaggtcctagaaacgacgtaacggtaccttaatttaatttaactcgtaccttaccctactaagttaccgacgtaacggttcgggaaccttactttaagttttttccgtttaggggtttttcgggccggggttacccgggtacccgtaaggtacttacggtaaccgttcgttcccgttacctaacgttccgaaccggtaccccgaaacggggtccctttacccggaccccccgttcggttaaccccg

SEQ ID NO: 300645 - DNA, 500 bp, Homo sapiens
  misc_feature: GZ8MTXP02FP2ZP.21.87.H10.1.454.CMB.2.raw
  modified_base (417)..(417): a, c, t, g, unknown or other
  misc_feature (417)..(417): n is a, c, g, or t
tcagtcgtcgctcgcacgaccggtgctcgatttagcagtactgcgttgggtttgggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacgttttaacctgtctctggtatcaacaacaccaggacaaagccccaaaactctaatttctggctcaatcagcgaccctcacatgtttccagtcgattcctctgcatccaagtctggcaacacggcctttctgacaatctctcaactcagctgaagacgagctattattactgctcctnatacgcaggtgcactattttcttggttttgcgtcggaccagactgactcgtcctcagtcagccaacggctcgcccctggtacc

SEQ ID NO: 300646 - DNA, 523 bp, Homo sapiens
  misc_feature: GZ8MTXP02FXPRU.21.87.H10.1.454.CMB.2.raw
  modified_base (292)..(292): a, c, t, g, unknown or other
  misc_feature (292)..(292): n is a, c, g, or t
  modified_base (363)..(363): a, c, t, g, unknown or other
  misc_feature (363)..(363): n is a, c, g, or t
tcagtcgtcgctcgcacgaccggtgctcgatttagcagtactgcgttgggtttggggggtcacaagaggcagcgctctcgggacgtctccaccatggcctgggctctgctgctcctcactctcctcactcagggcacagggtcctgggcccagtctgccctgactcagcctgcctccgtgtctgggtctccgggcagtcggtcaccatctcttgcgctggatccagcgatgatattggacttttacctgtctctggtatcaacacacagacaaagccccaaaatctaattcngctcaatcagcaccctcacattgtttccagtcgtattcctctgcatccaagtctggcaacacggtcctttntgacaatctctcactcagctagaagacgagctattattactgctctacatacgacaggtgactacttattttcgttggttttcggcggtacggacctagacgtgtacttcgtcctcgacgtaaccgacgccgaacggtcctaccgcccccgttcggtccc

SEQ ID NO: 300647 - DNA, 556 bp, Homo sapiens
  misc_feature: GZ8MTXP02H3KYG.21.87.H10.1.454.CMB.2.raw
  modified_base (195)..(195): a, c, t, g, unknown or other
  misc_feature (195)..(195): n is a, c, g, or t
  modified_base (299)..(299): a, c, t, g, unknown or other
  misc_feature (299)..(299): n is a, c, g, or t
  modified_base (305)..(305): a, c, t, g, unknown or other
  misc_feature (305)..(305): n is a, c, g, or t
  modified_base (312)..(312): a, c, t, g, unknown or other
  misc_feature (312)..(312): n is a, c, g, or t
  modified_base (332)..(332): a, c, t, g, unknown or other
  misc_feature (332)..(332): n is a, c, g, or t
  modified_base (334)..(334): a, c, t, g, unknown or other
  misc_feature (334)..(334): n is a, c, g, or t
  modified_base (344)..(344): a, c, t, g, unknown or other
  misc_feature (344)..(344): n is a, c, g, or t
  modified_base (352)..(352): a, c, t, g, unknown or other
  misc_feature (352)..(352): n is a, c, g, or t
  modified_base (361)..(361): a, c, t, g, unknown or other
  misc_feature (361)..(361): n is a, c, g, or t
  modified_base (375)..(375): a, c, t, g, unknown or other
  misc_feature (375)..(375): n is a, c, g, or t
  modified_base (422)..(422): a, c, t, g, unknown or other
  misc_feature (422)..(422): n is a, c, g, or t
  modified_base (429)..(429): a, c, t, g, unknown or other
  misc_feature (429)..(429): n is a, c, g, or t
  modified_base (436)..(436): a, c, t, g, unknown or other
  misc_feature (436)..(436): n is a, c, g, or t
tcagtcgtcgctcgcacgaccggtgctcgatttagcagtactgcgttgggtttggggggtcacaagaggcagcgctctcgggacgtctccaccatggcctgggctctgctgctcctcactctcctcactcagggcacagggtcctgggcccagtctgccctgactcagcctgcctcgtgtctgggtcctccgggnagtcggtcaccatctcttgcgctggatccagcgatgattattggacttttactgtctcctgtatcaacacacagacaaagccccaaaatcttaattctggctanaatcancgacctnacatgttccagtcattcccntncatcaattcngacaaacncgtcctttnagactaatcctacnctaactccaggctaggaagcgaagtcttatttatactgtactcctanactacgngtaggtntacttactttacgtttttcgtttagggtttacggcggtacggtacctagtactcggtacttcgtaccgtcgacgtcgaccggtaccgtacggtcccgttcccggtaccccgtttacgtcc

SEQ ID NO: 300648 - DNA, 540 bp, Homo sapiens
  misc_feature: GZ8MTXP02F0GPE.21.87.H10.1.454.CMB.2.raw
  modified_base (504)..(504): a, c, t, g, unknown or other
  misc_feature (504)..(504): n is a, c, g, or t
tcagtcgtcgctcgcacgaccggtgctcgatttagcagtactgcgttgggtttggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacttttactgtctctgtatcaacacacagacaaacgcccaaactcttaatttctggctcaatcagccaccctcacatcgtttccagtcgtattccctctgcactccaagttctcggacaactacggtcctttcagaccaaccctctaccaacctccaaggcctagaaagccgagtcttatttaactactgactcctacatacgcaggtcgactactatttttcgtggttttgcggtacggtaccagtagtcgtactcgttccctnacgtcaacgtcccaagcctcgccccctggtcctacc

SEQ ID NO: 300649 - DNA, 510 bp, Homo sapiens
  misc_feature: GZ8MTXP02I2AZB.21.87.H10.1.454.CMB.2.raw
  modified_base (301)..(301): a, c, t, g, unknown or other
  misc_feature (301)..(301): n is a, c, g, or t
  modified_base (374)..(374): a, c, t, g, unknown or other
  misc_feature (374)..(374): n is a, c, g, or t
  modified_base (396)..(396): a, c, t, g, unknown or other
  misc_feature (396)..(396): n is a, c, g, or t
  modified_base (419)..(419): a, c, t, g, unknown or other
  misc_feature (419)..(419): n is a, c, g, or t
tcagtcgtcgctcgcacgaccggtgctcgatttagcagtactgcgttgggtttggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacgttttaacctgtctcctggtatcaacaacaccaggacaaagccccaaaatcttaatttcnggcgtcaatcagcgaccctcacattgtttccagtcattcctctgcatccaagtctgggcaacacggcctttcngactatctctcactcagctganacgagctattattactgctcctnactacgcaggtgctactatttttcttggtttttgcggtcggaccagtatgacttcgtcctcagtcacgcctaacggcctcgcccctggtcc

SEQ ID NO: 300650 - DNA, 527 bp, Homo sapiens
  misc_feature: GZ8MTXP02JZD2G.21.87.H10.1.454.CMB.2.raw
  modified_base (196)..(196): a, c, t, g, unknown or other
  misc_feature (196)..(196): n is a, c, g, or t
  modified_base (295)..(295): a, c, t, g, unknown or other
  misc_feature (295)..(295): n is a, c, g, or t
  modified_base (311)..(311): a, c, t, g, unknown or other
  misc_feature (311)..(311): n is a, c, g, or t
  modified_base (362)..(362): a, c, t, g, unknown or other
  misc_feature (362)..(362): n is a, c, g, or t
tcagtcgtcgctcgcacgaccggtgctcgatttagcagtactgcgttgggtttgggggggtcacaagaggcagcgctctcgggacgtctccaccatggcctgggctctgctgctcctcactctcctcactcagggcacagggtcctgggcccagtctgccctgactcagcctgcctccgtgtctgggtctccgggnagtcggtcaccatctcttgcgctggatccagcatgatattggtacttttaactgtctctgtatcaacacaccaggacaaagccccaaaatcttaattcnggctcatcagcacctnactatgtttccagtcgattcctctgcatcaagtctgcaacacgtccttacngacaatctctacactcagctagaagtcgtaagtttattacgtactgcttacctcatacgcgtagtgtctattgttttcgttggttttcggcgtcggtaccgtagacgtcgtacttcgtccctcgacggtcaacgtcccgagtcctccgtcccttcggacttcccg

SEQ ID NO: 300651 - DNA, 567 bp, Homo sapiens
  misc_feature: GZ8MTXP02F1TAC.21.87.H10.1.454.CMB.2.raw
  modified_base (370)..(370): a, c, t, g, unknown or other
  misc_feature (370)..(370): n is a, c, g, or t
tcagtcgtcgctcgcacgaccggtgctcgatttagcagtactgcgttgggtttgggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggactttactgtctctgtatcaacaacacagacaaacgccccaaaactcttaatttctggctcaatcagcgaccctcacattcgtttccagtcgattcctctgcatccaagtctgaccaactcgtccctttnagacaatctctacactcgagctagacgacgagtactatttattactgtctacctctacttacgctaggtcgtactactttatttttcgtttgggtttttcgggacgggtaccgggtacctaggtactcggtacttcgttccctacgtacgtaacgtacgacccgtaaacggtcctaccgtcccccgttcggtacccg

SEQ ID NO: 300652 - DNA, 547 bp, Homo sapiens
  misc_feature: GZ8MTXP02GCMS0.21.87.H10.1.454.CMB.2.raw
  modified_base (294)..(294): a, c, t, g, unknown or other
  misc_feature (294)..(294): n is a, c, g, or t
  modified_base (314)..(314): a, c, t, g, unknown or other
  misc_feature (314)..(314): n is a, c, g, or t
  modified_base (372)..(372): a, c, t, g, unknown or other
  misc_feature (372)..(372): n is a, c, g, or t
tcagtcgtcgctcgcacgaccggtgctcgatttagcagtactgcgttgggtttgggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggtacttttactgtctctgtatcaacacacagacaaacgaccccaaaatcttaattcnggctacaatcagccaccctnactattcgtttccagtcgtattccctctgcatccaatctggacaacacgtcctttacngactaatctactacaactccagctagaagacgagtctatttattactcgcttcctacatacgtcaggtgctacttattttcgtttaggtttcggtcggtacgggtaccctagtactcgtacgttcgtcctcgacgtaacacgacccgaacggtcctaccgtcccccgtcggtacc

SEQ ID NO: 300653 - DNA, 512 bp, Homo sapiens
  misc_feature: GZ8MTXP02JCKZH.21.87.H10.1.454.CMB.2.raw
  modified_base (197)..(197): a, c, t, g, unknown or other
  misc_feature (197)..(197): n is a, c, g, or t
  modified_base (298)..(298): a, c, t, g, unknown or other
  misc_feature (298)..(298): n is a, c, g, or t
  modified_base (359)..(359): a, c, t, g, unknown or other
  misc_feature (359)..(359): n is a, c, g, or t
  modified_base (369)..(369): a, c, t, g, unknown or other
  misc_feature (369)..(369): n is a, c, g, or t
  modified_base (419)..(419): a, c, t, g, unknown or other
  misc_feature (419)..(419): n is a, c, g, or t
tcagtcgtcgctcgcacgaccggtgctcgatttagcagtactgcgttgggtttggggggtcacaagaggcagcgctctcgggacgtctccaccatggcctgggctctgctgctcctcactctcctcactcagggcacagggtcctgggcccagtctgccctgactcagcctgcctccgtgtctgggtcctcccgggnagtcggtcaccatctcttgcgctggatccagcgatgatattggacttttactgtctcctggtatcaacacaccaggacaaagccccaaaatcttaatttcnggctcaatcagcaccctcacatgtttccagtcgattcctctgcatccaagttctggcaacncggcctttcngacaatctctacaactccaggctagaagacgagctattattactgctctnatacgcagtgacacttattttcttggttttggcggtcgggacccaggtactgactcgtcctcagtcacgcccaaggcctacgcccctggtacc

SEQ ID NO: 300654 - DNA, 701 bp, Homo sapiens
  misc_feature: GZ8MTXP02JW2TI.21.87.H10.1.454.CMB.2.raw
  modified_base (197)..(197): a, c, t, g, unknown or other
  misc_feature (197)..(197): n is a, c, g, or t
  modified_base (295)..(295): a, c, t, g, unknown or other
  misc_feature (295)..(295): n is a, c, g, or t
  modified_base (387)..(387): a, c, t, g, unknown or other
  misc_feature (387)..(387): n is a, c, g, or t
tcagtcgtcgctcgcacgaccggtgctcgatttagcagtactgcgttgggtttgggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggnagtcggtcaccatctcttgcgctggactccagcatgatagttggtacttttactgtctctgtatcaacacacagacaacgacccaaactcttaattcnggctacaatcagccgaccctcactattcgttaccagtcgtattccctactgactactcctaagtctgggaccaaacgtccggtccttttacncgtaaacctaacttcctacctaccaaaccttcccgaggtcgtacggaaacgtacggtaacggtacctttattttaacttaaccgttcgtaccctttccctaacctacgttaccggtacgtaacgggttcggtaccttaaacgttttcgtttttttccggtttacggggttttttacggggcccggggttacccggggtaaccccgtaggtacgttaccggttaaccgttacggttcccttaccgtaacggttccgaaccggtaccccggtaaaccggtcccgttacccggtcccccccggttggtttacccccg

SEQ ID NO: 300655 - DNA, 649 bp, Homo sapiens
  misc_feature: GZ8MTXP02IMQY7.21.87.H10.1.454.CMB.2.raw
  modified_base (496)..(496): a, c, t, g, unknown or other
  misc_feature (496)..(496): n is a, c, g, or t
tcagtcgtcgctcgcacgaccggtgctcgatttagcagtactgcgttgggtttgggggggtcacaagaggcagcgctctcgggacgtctccaccatggcctgggctctgctgctcctcactctcctcactcagggcacagggtcctgggcccagtctgccctgactcagcctgcctccgtgtctgggtcctccgggcagtcggtcaccatctcttgcgctggatccagcgatgattattggtacttttaaccttgtctctggtatcaacaacaccaggaacaaacgccccaaaactcttaatttctggcgtcaatcagccgacccctcactatcgtttccagtcgtattccctctcgctatccaaagttctcgggtaccaaacctaccggtcccttttcgtacgaaacctaaactccttactaccctaaactccagggtccttaagaaacgtaccgaaggtacttaaatttactttaactcgtccttacccgttanaacgttacgaccgaggtgacctactttatttttccgtttgggttttacgggcgggtaccggtacccgtaggtacgttacgtaccgtttcgtacccttagtacgttaaccgaccgacccgtaacggccttcccggtacccccttcggttacccc

SEQ ID NO: 300656 - DNA, 653 bp, Homo sapiens
  misc_feature: GZ8MTXP02JQQVR.21.87.H10.1.454.CMB.2.raw
  modified_base (196)..(196): a, c, t, g, unknown or other
  misc_feature (196)..(196): n is a, c, g, or t
  modified_base (302)..(302): a, c, t, g, unknown or other
  misc_feature (302)..(302): n is a, c, g, or t
  modified_base (322)..(322): a, c, t, g, unknown or other
  misc_feature (322)..(322): n is a, c, g, or t
tcagtcgtcgctcgcacgaccggtgctcgatttagcagtactgcgttgggtttgggggggtcacaagaggcagcgctctcgggacgtctccaccatggcctgggctctgctgctcctcactctcctcactcagggcacagggtcctgggcccagtctgccctgactcagcctgcctccgtgtctgggtctccgggnagtcgtcaccatctctgcgctggatccagcgtatgattattggtacttttaccttgtctcctggtatcaacaacaccaggacaaacgcccctaaaatcttaattcnggctacaatcagcgaccctnactatgtttaccagtcgtattcctactgactactccaaagttctcgggtaccaaaccgtaccggtcctttactacgaactaaactccttcctacaacctccgaagtcctagaaacgacgtaacgtacttatttaacttaactcgtaccttacctactacgtaacgtcgtaaggtcggacttaacttagtttttcgtttcggggtttttcggaccgggtaccgggtaacccgtaggtaacgttccggtacgttcggtacccttcgtaacgttccgaaccggttacccgaaacgggtccccttacccggtccccccgttacggtttacccccg

SEQ ID NO: 300657 - DNA, 655 bp, Homo sapiens
  misc_feature: GZ8MTXP02JA037.21.87.H10.1.454.CMB.2.raw
  modified_base (296)..(296): a, c, t, g, unknown or other
  misc_feature (296)..(296): n is a, c, g, or t
  modified_base (301)..(301): a, c, t, g, unknown or other
  misc_feature (301)..(301): n is a, c, g, or t
  modified_base (308)..(308): a, c, t, g, unknown or other
  misc_feature (308)..(308): n is a, c, g, or t
tcagtcgtcgctcgcacgaccggtgctcgatttagcagtactgcgttgggtttgggggggtcacaagaggcagcgctctcgggacgtctccaccatggcctgggctctgctgctcctcactctcctcactcagggcacagggtcctgggcccagtctgccctgactcagcctgcctcgtgtctgggtctccgggcagtcggtcaccatctcttgcgctggactcagcgatgatgttggtacttttactgtctctgtatcaaacacaccagacaaacgacccctaaatcttaattcngctanaatcacnccgaccctacactattcgttaccagtcgtacttcctctgctatccaagttctcgactaactaccggtcctttacacgtaacacttcctactacctaacctccgagtcctagaacgacgtagtctttaagtttacttacgtcgtcccttacgtacaacgttacgactaaggggttcctactttacgtttacttttttcgggttacggggtttttcggacccggggttaccgggtaaccctagggtacgttacggaacctttccgtaacccgtttcggaacgttaacccggacgtaacccccggttaagggcccctttaccccgggtcccccgttacggtttaaccccg

SEQ ID NO: 300658 - DNA, 544 bp, Homo sapiens
  misc_feature: GZ8MTXP02JXBYQ.21.87.H10.1.454.CMB.2.raw
  modified_base (441)..(441): a, c, t, g, unknown or other
  misc_feature (441)..(441): n is a, c, g, or t
  modified_base (511)..(511): a, c, t, g, unknown or other
  misc_feature (511)..(511): n is a, c, g, or t
tcagtcgtcgctcgcacgaccggtgctcgatttagcagtactgcgttgggtttgggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacgttttaaccttgtctcctggtatcaacaacacaggacaaacgccccaaaactcttaatttctggcgtcaatcagcgacccctcacatgtttccagtcgtattcctctgcatccaagtctggacaacaccggtcctttctgactaatcctctaccaactccaggctagaacgacgaggtcttatttattactgtctcctnatacgctaggtgactacttatttttcgttggttttcggcggtcgggtaccagacgttcgacttcgtcctnacgtcacgccgacggcctccgccccgtcggtcc

SEQ ID NO: 300659 - DNA, 548 bp, Homo sapiens
  misc_feature: GZ8MTXP02IQSVF.21.87.H10.1.454.CMB.2.raw
  modified_base (291)..(291): a, c, t, g, unknown or other
  misc_feature (291)..(291): n is a, c, g, or t
  modified_base (363)..(363): a, c, t, g, unknown or other
  misc_feature (363)..(363): n is a, c, g, or t
tcagtcgtcgctcgcacgaccggtgctcgatttagcagtactgcgttgggtttgggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacttttacctgtctctgtatcaacacacagacaaagcccaaatctaattcngctcaatcagcaccctcactatcgtttccagtcgattcctctgcatccaagttctggacacacggtcctttngacatctctacaactccagctagaacgacgaggcttattattactgtccttcctactactacgaccgtaggtcgactacgttatttttcgtttgggttttggcggtacggtaccctagtacgttgacgttcgtacctcgtacgtcacggacccgtaacggtcctaccggtcccccgtacggtccc

SEQ ID NO: 300660 - DNA, 655 bp, Homo sapiens
  misc_feature: GZ8MTXP02HA5QX.21.87.H10.1.454.CMB.2.raw
  modified_base (295)..(295): a, c, t, g, unknown or other
  misc_feature (295)..(295): n is a, c, g, or t
  modified_base (318)..(318): a, c, t, g, unknown or other
  misc_feature (318)..(318): n is a, c, g, or t
tcagtcgtcgctcgcacgaccggtgctcgatttagcagtactgcgttgggtttgggggggtcacaagaggcagcgctctcgggacgtctccaccatggcctgggctctgctgctcctcactctcctcactcagggcacagggtcctgggcccagtctgccctgactcagcctgcctccgtgtctgggtcctcccgggcagtcggtcaccatctcttgcgctggatccagcatgatattggacttttactgtctcctgtatcaacacaccagacaaagccccaaatcttaatttcnggctacaatcagccacctcactntcgtttccagtctattcctctgcactaccaagtctggacctaactaccggtcctttctacgaactaaacttcctaccttaccaaccttccgaacggtcttaacggaaacgacgtaacggtacctttaaatttacttaaaccgttgtacccttaccctactaacgttaccggacgtaagggtacggtaccttacgtttaagtttttttccgtttaggggtttttacggccggggttaccgggtaaccccgtaggttacgtacggttacgttcgttccctacgtacggtaacctacggtacccctaacgggtcctcccggtacccccttcggttacccg

SEQ ID NO: 300661 - DNA, 636 bp, Homo sapiens
  misc_feature: GZ8MTXP02F4G0V.21.87.H10.1.454.CMB.2.raw
  modified_base (219)..(219): a, c, t, g, unknown or other
  misc_feature (219)..(219): n is a, c, g, or t
  modified_base (294)..(294): a, c, t, g, unknown or other
  misc_feature (294)..(294): n is a, c, g, or t
tcagtcgtcgctcgcacgaccggtgctcgatttagcagtactgcgttgggtttgggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgntggatccagcgatgatattggtacttttactgtctctgtatcaacacacagacaaagccccaaaatcttaattcngctacaatcagcgaccctcactattcgttaccagtcgtattcctctcgactactccaaagtctggaccaaacgtaccggtcctttcgtacgaactaaacttcctacttaccaaaccttccgaaggtccttaagaaacgtaaccggtaaggttaccttaaattttaacttaaaccgttcgtacccttaccccttactaaccgtttaaccggaccgtaaacgggtcggtaccttaacgtttacgttttttcgttaggggtttttcgggccggtacgggtaccctaggtactgtacctcgtcctagacgtccgacgaccacggtcctccgtccccgtcggtaccc

SEQ ID NO: 300662 - DNA, 539 bp, Homo sapiens
  misc_feature: GZ8MTXP02IW6XZ.21.87.H10.1.454.CMB.2.raw
  modified_base (197)..(197): a, c, t, g, unknown or other
  misc_feature (197)..(197): n is a, c, g, or t
  modified_base (291)..(291): a, c, t, g, unknown or other
  misc_feature (291)..(291): n is a, c, g, or t
  modified_base (308)..(308): a, c, t, g, unknown or other
  misc_feature (308)..(308): n is a, c, g, or t
  modified_base (350)..(350): a, c, t, g, unknown or other
  misc_feature (350)..(350): n is a, c, g, or t
  modified_base (359)..(359): a, c, t, g, unknown or other
  misc_feature (359)..(359): n is a, c, g, or t
  modified_base (411)..(411): a, c, t, g, unknown or other
  misc_feature (411)..(411): n is a, c, g, or t
tcagtcgtcgctcgcacgaccggtgctcgatttagcagtactgcgttgggtttggggggtcacaagaggcagcgctctcgggacgtctccaccatggcctgggctctgctgctcctcactctcctcactcagggcacagggtcctgggcccagtctgccctgactcagcctgcctccgtgtctgggtcctcccgggnagtcggtcaccatctcttgcgctggatccagcgatgatattggacttttactgtctctgtatcaacacacagacaaagcccaaatcttaattcnggctcaatcagcacctnacatgtttccagtcgattcctctgcatccaagtctggcaacncgtcctttngactatctctcactcagctagaagacgagtcttattattactgtacctcctnatacgacaggtgtactacgttatttttcgttgggttttcggcggtcgggaccctaggtactacgtacttcgtcctacgagttccgacgtacccgaacgggtcccttccggtcccccgttcggttaccc

SEQ ID NO: 300663 - DNA, 698 bp, Homo sapiens
  misc_feature: GZ8MTXP02GZF24.21.87.H10.1.454.CMB.2.raw
  modified_base (197)..(197): a, c, t, g, unknown or other
  misc_feature (197)..(197): n is a, c, g, or t
  modified_base (298)..(298): a, c, t, g, unknown or other
  misc_feature (298)..(298): n is a, c, g, or t
tcagtcgtcgctcgcacgaccggtgctcgatttagcagtactgcgttgggtttgggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggnagtcggtcaccatctcttgcgctggatccagcgatgatattggactttttaactgtctctgtatcaacacaccagacaaacgccccaaaatcttaatttcngctacaatcagccgaccctcactattcgtttccagtcgtattccctctgctatcccaaagttcctggaccaaaccgtccggtcccttttcacgaaacctaaacttcctaccttacccaaaccttacccgaaggtcctaggaaacgtaacggtaacggtacctttaaacttttaacttaaccgttcgtacccttacccttactaacgttaaccggacgtaacgggttcggtaccttaacgtttttaacgttttttccgttttaggggttttttcggggacccggggttaccgggtaccccgtaaggtaacgttacggtaaccgttcggttaccctcgtaacgttaaccgaaccggtaccccgtaaacggtccctaccggtccccccgtcggtttaaccccg

SEQ ID NO: 300664 - DNA, 561 bp, Homo sapiens
  misc_feature: GZ8MTXP02HNN24.21.87.H10.1.454.CMB.2.raw
  modified_base (320)..(320): a, c, t, g, unknown or other
  misc_feature (320)..(320): n is a, c, g, or t
  modified_base (369)..(369): a, c, t, g, unknown or other
  misc_feature (369)..(369): n is a, c, g, or t
  modified_base (431)..(431): a, c, t, g, unknown or other
  misc_feature (431)..(431): n is a, c, g, or t
  modified_base (438)..(438): a, c, t, g, unknown or other
  misc_feature (438)..(438): n is a, c, g, or t
tcagtcgtcgctcgcacgaccggtgctcgatttagcagtactgcgttgggtttgggggggtcacaagaggcagcgctctcgggacgtctccaccatggcctgggctctgctgctcctcactctcctcactcagggcacagggtcctgggcccagtctgccctgactcagcctgcctccgtgtctgggtcctcccgggcagtcggtcaccatctcttgcgctggatccagcgatgatattggacttttactgtctctgtatcaacaacacaggacaaacgaccccaaaatcttaatttctggctacaatcacgcgaccctnactattcgttccagtcgattccctctgcatccaagttctggaccaaacnccgtcctttctagaactaatctactccaaactcagtctagaaagcgagtcttattattacgntctctanatacgtcgaggtgctaatttgttttcgtttgggttttcgcgggttaccggacctagtacttcgtacgtcgtcccttagacgtccgacggtaccctacgggtcctccgcccccgttaggtcccc

SEQ ID NO: 300665 - DNA, 656 bp, Homo sapiens
  misc_feature: GZ8MTXP02IO9QU.21.87.H10.1.454.CMB.2.raw
  modified_base (195)..(195): a, c, t, g, unknown or other
  misc_feature (195)..(195): n is a, c, g, or t
  modified_base (290)..(290): a, c, t, g, unknown or other
  misc_feature (290)..(290): n is a, c, g, or t
  modified_base (311)..(311): a, c, t, g, unknown or other
  misc_feature (311)..(311): n is a, c, g, or t
tcagtcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctcgtgtctggtctccgggnagtcgtcacatctcttgcgctggatccagcgatgattattggtacttttactgtctctgtatcaacacacagacaagacccaaactcttaattcnggactcaatcagccgaccctnactattcgtttccagtcgtattcctctgcatccaagtctggacctaaaccgtaccggtcccttttacacgtaacctaaacttcctacctacctaaacctccgaaggtacctaggaaacgacggtaacggtacctttattttaacttaaccttcgtaccttacccttactaacttaccgggactaacggggtcggtaccttaaacgtttcgttttttaccgttttggggtttttcgggccggggtaccgggtacccttaggtacttacgggtaccttcgttaccctacgtacggtaaccgacggtacccgtaacggtcccgttcccggtcccccgttcggtacccg

SEQ ID NO: 300666 - DNA, 557 bp, Homo sapiens
  misc_feature: GZ8MTXP02ICR4L.21.87.H10.1.454.CMB.2.raw
  modified_base (296)..(296): a, c, t, g, unknown or other
  misc_feature (296)..(296): n is a, c, g, or t
  modified_base (453)..(453): a, c, t, g, unknown or other
  misc_feature (453)..(453): n is a, c, g, or t
  modified_base (495)..(495): a, c, t, g, unknown or other
  misc_feature (495)..(495): n is a, c, g, or t
tcagtcgtcgctcgcacgaccggtgctcgatttagcagtactgcgttgggtttgggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacgttttacctgtctctgtatcaacacacagacaaagccccaaaatcttaatttcnggctcaatcagcacccctcactatcgtttccagtcgtatttccctctgcactccaagttcctggccaaaccgaccggttcccttttcgagaacctaaactcctctacctaactccgagactgaagacgagtctattactactgctcctcacttacgnacggtgctactacttttcgttaggtttcgcggtcggtacccnggtactgacctgtacctcgtacgtcgacggacccaacgggtcctccggtcccctcggtaccc

SEQ ID NO: 300667 - DNA, 570 bp, Homo sapiens
  misc_feature: GZ8MTXP02F4M7V.21.87.H10.1.454.CMB.2.raw
  modified_base (260)..(260): a, c, t, g, unknown or other
  misc_feature (260)..(260): n is a, c, g, or t
  modified_base (293)..(293): a, c, t, g, unknown or other
  misc_feature (293)..(293): n is a, c, g, or t
  modified_base (357)..(357): a, c, t, g, unknown or other
  misc_feature (357)..(357): n is a, c, g, or t
  modified_base (434)..(434): a, c, t, g, unknown or other
  misc_feature (434)..(434): n is a, c, g, or t
tcagtcgtcgctcgcacgaccggtgctcgatttagcagtactgcgttgggtttgggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacttttactgtctctgtatnaacacacagacaaagccccaaaatcttaattcngctacaatcagcgaccctcacatcgtttccagtcgtattcctctgcatccaagtctggacaacncgtcctttcacgacaaattcctctaccaactccaggcctagaagaccgagtcttaatttacttacgtctcttccctnactacgctaggtgctacttactttttgttacgggttttggccggtacgggtaccctaggtattacggacttcgttaccctcgtaacgttccgaaccgtacccgaacggttccctccggtccccccgttaggtcccc

SEQ ID NO: 300668 - DNA, 528 bp, Homo sapiens
  misc_feature: GZ8MTXP02HYZGW.21.87.H10.1.454.CMB.2.raw
  modified_base (195)..(195): a, c, t, g, unknown or other
  misc_feature (195)..(195): n is a, c, g, or t
  modified_base (317)..(317): a, c, t, g, unknown or other
  misc_feature (317)..(317): n is a, c, g, or t
  modified_base (344)..(344): a, c, t, g, unknown or other
  misc_feature (344)..(344): n is a, c, g, or t
  modified_base (375)..(375): a, c, t, g, unknown or other
  misc_feature (375)..(375): n is a, c, g, or t
  modified_base (404)..(404): a, c, t, g, unknown or other
  misc_feature (404)..(404): n is a, c, g, or t
  modified_base (421)..(421): a, c, t, g, unknown or other
  misc_feature (421)..(421): n is a, c, g, or t
  modified_base (434)..(434): a, c, t, g, unknown or other
  misc_feature (434)..(434): n is a, c, g, or t
tcagtcgtcgctcgcacgaccggtgctcgatttagcagtactgcgttgggtttgggggggtcacaagaggcagcgctctcgggacgtctccaccatggcctgggctctgctgctcctcactctcctcactcagggcacagggtcctgggcccagtctgccctgactcagcctgcctccgtgtctgggtctccggnagtcgtcaccatctcttgcgctggactccagcgatgatattggtacttttactgtctctgtatcaacaacacaagacaaacgccccaaaatctttaattctggctacaatcagtccaccctnactattgtttccagtcgtattcctctncatcaagttctggccaacgtacgtcctttangactatctctaccaactcaggctagaagngagcttatttatacgtntctctcattacgngtaggtcgctacttagtttttcgttggttttcggcgtacgggacctagtctagctcgtcctacagtccgcgaccgacgcctccgccctggtccc

SEQ ID NO: 300669 - DNA, 624 bp, Homo sapiens
  misc_feature: GZ8MTXP02IZEZY.21.87.H10.1.454.CMB.2.raw
  modified_base (195)..(195): a, c, t, g, unknown or other
  misc_feature (195)..(195): n is a, c, g, or t
  modified_base (298)..(298): a, c, t, g, unknown or other
  misc_feature (298)..(298): n is a, c, g, or t
  modified_base (444)..(444): a, c, t, g, unknown or other
  misc_feature (444)..(444): n is a, c, g, or t
  modified_base (472)..(472): a, c, t, g, unknown or other
  misc_feature (472)..(472): n is a, c, g, or t
tcagtcgtcgctcgcacgaccggtgctcgatttagcagtactgcgttgggtttgggggggtcacaagaggcagcgctctcgggacgtctccaccatggcctgggctctgctgctcctcactctcctcactcagggcacagggtcctgggcccagtctgccctgactcagcctgcctcgtgtctgggtctccgggnagtcggtcaccatctcttgcgctggatccagcgatgattattggacttttaacctgtctctggtatcaacacacagacaaagccccaaaactctttaatttcnggctcaatcagcgacctcacatcgtttccagtcgattcctctgctatccaagttctggccaactaccggtcctttcagactaatcctactaccaaacgttccagggtacctagaaacgtacgacggtaacttatttattaaccgtntccttcttcaacttacggctaacgggtnacttattaacgttttttcgttaggggtttttcgggcccgggtaccggggtaccctaaagggtacttacggtaccttcggttaccccttgtaacggttccaaacggtaccctaaaacggggtccttacccggtccccccgttcgggttaaccc

SEQ ID NO: 300670 - DNA, 528 bp, Homo sapiens
  misc_feature: GZ8MTXP02FF21P.21.87.H10.1.454.CMB.2.raw
  modified_base (197)..(197): a, c, t, g, unknown or other
  misc_feature (197)..(197): n is a, c, g, or t
  modified_base (295)..(295): a, c, t, g, unknown or other
  misc_feature (295)..(295): n is a, c, g, or t
  modified_base (311)..(311): a, c, t, g, unknown or other
  misc_feature (311)..(311): n is a, c, g, or t
  modified_base (362)..(362): a, c, t, g, unknown or other
  misc_feature (362)..(362): n is a, c, g, or t
tcagtcgtcgctcgcacgaccggtgctcgatttagcagtactgcgttgggtttgggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggnagtcggtcaccatctcttgcgctggatccagcgatgatattggacttttaactgtctctgtatcaacacacagacaaagccccaaaatcttaatttcngctcaatcagcacctnacatcgttccagtcattcctctgcatccaagtctggcaacacggtcctttngacaatctctaccaactccagctagaacgacgagtcttatttacttactcgcttcctcactacgcaggtgactacttacttttcgttgggttttggccggtcggtacccgagtatcgtactcgtcctcgagtcgacgtcccgaacggcctccgcccctcggtaccc

SEQ ID NO: 300671 - DNA, 535 bp, Homo sapiens
  misc_feature: GZ8MTXP02FOKJR.21.87.H10.1.454.CMB.2.raw
  modified_base (302)..(302): a, c, t, g, unknown or other
  misc_feature (302)..(302): n is a, c, g, or t
  modified_base (321)..(321): a, c, t, g, unknown or other
  misc_feature (321)..(321): n is a, c, g, or t
  modified_base (326)..(326): a, c, t, g, unknown or other
  misc_feature (326)..(326): n is a, c, g, or t
tcagtcgtcgctcgcacgaccggtgctcgatttagcagtactgcgttgggtttgggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacgttttaacctgtctcctggtatcaacaacaccaggacaaagccccaaaactctaatttcnggctcaatcagcgaccctnacatntttccagtcgattcctctgcataccaagtctcggcaacacggtccctttctgacaatctctccaactcagctagaagacgagctatttattactgctcctcatacgcacggtgactactatttttcgttggtttttcggacggtcggacccagtactagacgtcgtacctcacgtcgtacgcccaaggtcctacggcccccttcggtcc

SEQ ID NO: 300672 - DNA, 561 bp, Homo sapiens
  misc_feature: GZ8MTXP02F5Q4A.21.87.H10.1.454.CMB.2.raw
  modified_base (299)..(299): a, c, t, g, unknown or other
  misc_feature (299)..(299): n is a, c, g, or t
  modified_base (373)..(373): a, c, t, g, unknown or other
  misc_feature (373)..(373): n is a, c, g, or t
tcagtcgtcgctcgcacgaccggtgctcgatttagcagtactgcgttgggtttggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacttttactgtctcctggtatcaacaacaccaggacaaagccccaaaactcttaatttcnggcgtcaatcagcgaccctcacattgtttccagtcgtattcctctgcatccaagttctggcaacacggtccttnagacaatctctcaactccagctagaagacgagtcttagtttattactcgctcctcattacgcaggtcgactacttacttttcgttagggtttttcggacggtacgggtaccctaggtacttcgacgttcgtccttacgtacgtccgtacgacccgtaacggtcctaccggtcccccgttcggttaccc

SEQ ID NO: 300673 - DNA, 620 bp, Homo sapiens
  misc_feature: GZ8MTXP02JVEXH.21.87.H10.1.454.CMB.2.raw
  modified_base (195)..(195): a, c, t, g, unknown or other
  misc_feature (195)..(195): n is a, c, g, or t
  modified_base (207)..(207): a, c, t, g, unknown or other
  misc_feature (207)..(207): n is a, c, g, or t
  modified_base (291)..(291): a, c, t, g, unknown or other
  misc_feature (291)..(291): n is a, c, g, or t
  modified_base (315)..(315): a, c, t, g, unknown or other
  misc_feature (315)..(315): n is a, c, g, or t
  modified_base (319)..(319): a, c, t, g, unknown or other
  misc_feature (319)..(319): n is a, c, g, or t
  modified_base (340)..(340): a, c, t, g, unknown or other
  misc_feature (340)..(340): n is a, c, g, or t
tcagtcgtcgctcgcacgaccggtgctcgatttagcagtactgcgttgggtttgggggggtcacaagaggcagcgctctcgggacgtctccaccatggcctgggctctgctgctcctcactctcctcactcagggcacagggtcctgggcccagtctgccctgactcagcctgcctcgtgtctgggtctccgggnagtcggtcaccntctctgcgctggatccagcgatgatattggtacttttacctgtctctgtatcaacacacagacaacgacccaaatcttaattcnggactacaatcacgtccaaccctnactntcgtttccagtcattcccgtntcgctaactccgaagtctcggaccaaacgtccggttacctttcagactaatcctactacactccgaagtctagaacgacgtagtctttaatttacgtactcgtaccttactacgtaacgtaccggacgttacggggtcgtacctacgtttttacgtttttccggttttacggggtttcgggaccgggtaccggtacccgtagtacgtaccgtacgttcgtccctacgacgtaacgtaaccggacccgtacggtccctcccggtaccccgtacggttaccc

SEQ ID NO: 300674 - DNA, 590 bp, Homo sapiens
  misc_feature: GZ8MTXP02FOX8X.21.87.H10.1.454.CMB.2.raw
  modified_base (296)..(296): a, c, t, g, unknown or other
  misc_feature (296)..(296): n is a, c, g, or t
tcagtcgtcgctcgcacgaccggtgctcgatttagcagtactgcgttgggtttgggggggtcacaagaggcagcgctctcgggacgtctccaccatggcctgggctctgctgctcctcactctcctcactcagggcacagggtcctgggcccagtctgccctgactcagcctgcctccgtgtctgggtctccgggcagtcggtcactatctcttgcgctggatccagcgatgatattggtacttttactgtctctgtatcaacacaccaggacaaagccccaaaatcttaatttcnggcgtacaatcagccgaccctcacatcgtttccagtcgtacttcctactgctagtccctaagtctcgggacaacgtacggtcctttctagactaaactcctctacaactccaggctagaacgacgagtctatttacttactcgctacctacacttacgctacggtggtactaacgtttttcgtttttcggtttcgggtttcgggtccggtaccggtaccgtagtacgtacgtacgttcgtactacgtacgtaacgtaccgaccgtacgtccgtacccgtaccccgtaccgtacc

SEQ ID NO: 300675 - DNA, 664 bp, Homo sapiens
  misc_feature: GZ8MTXP02HNTBV.21.87.H10.1.454.CMB.2.raw
  modified_base (195)..(195): a, c, t, g, unknown or other
  misc_feature (195)..(195): n is a, c, g, or t
  modified_base (205)..(205): a, c, t, g, unknown or other
  misc_feature (205)..(205): n is a, c, g, or t
  modified_base (209)..(209): a, c, t, g, unknown or other
  misc_feature (209)..(209): n is a, c, g, or t
  modified_base (288)..(288): a, c, t, g, unknown or other
  misc_feature (288)..(288): n is a, c, g, or t
  modified_base (292)..(292): a, c, t, g, unknown or other
  misc_feature (292)..(292): n is a, c, g, or t
  modified_base (305)..(305): a, c, t, g, unknown or other
  misc_feature (305)..(305): n is a, c, g, or t
  modified_base (349)..(349): a, c, t, g, unknown or other
  misc_feature (349)..(349): n is a, c, g, or t
tcagtcgtcgctcgcacgaccggtgctcgatttagcagtactgcgttgggtttgggggggtcacaagaggcagcgctctcgggacgtctccaccatggcctgggctctgctgctcctcactctcctcactcagggcacagggtcctgggcccagtctgccctgactcagcctgcctcgtgtctgggtctccgggnagtcgtcacntctnttgcgctggatccagcgatgatagttggtacgttttactgtctctgatcaacacacagacaagcccaaatcttaattcngctnaatcagccacctnactattcgttaccagtcgattcctctgacacttaccaagttccngggacctaaactccgggtcccttttagagaactaacttcctaccttaccaacttccgaggtctaaggaaacgtacgacgttaccttaattttactacctccgtaccccttacgtaacgtacgtaccggtaggttacggtacctttaacgtttaacgtttttttcggtttttggggtttttccgggggtacgggaccccggggtttacccggaaacgtttcgtacggtttaccgttaccgtttcccgtacccgtagttacccgaaacgcccgtaaaccggtccgtccccgtacccccggtcccggtttactacccg

SEQ ID NO: 300676 - DNA, 589 bp, Homo sapiens
  misc_feature: GZ8MTXP02FS6LF.21.87.H10.1.454.CMB.2.raw
  modified_base (298)..(298): a, c, t, g, unknown or other
  misc_feature (298)..(298): n is a, c, g, or t
  modified_base (454)..(454): a, c, t, g, unknown or other
  misc_feature (454)..(454): n is a, c, g, or t
tcagtcgtcgctcgcacgaccggtgctcgatttagcagtactgcgttgggtttgggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacgttttaactgtctctgtatcaacacaccaggacaaacgccccaaatcttaatttcnggctacaatcagccgaccctcacattcgtttccagtcgattcctctgactactccaagttctggaccaaacgtacggtccctttactagactaacttctctacaactccaggctagaacgacgagtcttaattattactgctcctacacttaccgntacggtcgtactactttacgtttttcgtttagggtttttcgggccgggtaccgggtaccctaggtacgttacggtacttcgttaccctcgtagtccgacgtacccgaacgggtcctccgcccccgttcggtaccc

SEQ ID NO: 300677 - DNA, 620 bp, Homo sapiens
  misc_feature: GZ8MTXP02FVE2I.21.87.H10.1.454.CMB.2.raw
  modified_base (271)..(271): a, c, t, g, unknown or other
  misc_feature (271)..(271): n is a, c, g, or t
  modified_base (304)..(304): a, c, t, g, unknown or other
  misc_feature (304)..(304): n is a, c, g, or t
  modified_base (324)..(324): a, c, t, g, unknown or other
  misc_feature (324)..(324): n is a, c, g, or t
  modified_base (479)..(479): a, c, t, g, unknown or other
  misc_feature (479)..(479): n is a, c, g, or t
tcagtcgtcgctcgcacgaccggtgctcgatttagcagtactgcgttgggtttgggggggtcacaagaggcagcgctctcgggacgtctccaccatggcctgggctctgctgctcctcactctcctcactcagggcacagggtcctgggcccagtctgccctgactcagcctgcctccgtgtctgggtcctcccgggcagtcggtcaccatctcttgcgctggatccagcgatgatattggtacttttacctgtctctggtatcaacaacnccaggaacaaacgcccccaaaatcttaatttcnggactacatcacgcaccctnactattcgttaccagtcgtattcctctgcatccaagtcgtggaccaaacgtaccggtcctttacagaacctaaattccttaccttaccaaaccttcccgaacggtcttaggaaacgaacgtacggtacttatttacttaactcgtaccttccctntaactacgacgtacggtacgacttaaccgtttatttttcggtttacggtttttggggacccggttacgggacccctagtacgtcgtaacgtctacccgtcacgtccgacgtcccaacggtcctcggcccccttcggtaccc

SEQ ID NO: 300678 - DNA, 608 bp, Homo sapiens
  misc_feature: GZ8MTXP02G0NIM.21.87.H10.1.454.CMB.2.raw
  modified_base (296)..(296): a, c, t, g, unknown or other
  misc_feature (296)..(296): n is a, c, g, or t
tcagtcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctccgtgtctggtcctccggcagtcggtcaccatctcttgcgctggactccagcgatgattattggtacttttactgtctctgtatcaacacacagacaaacgaccccaaatcttaattcnggctacaatcagccaccctcactattcgttccagtcgtattccctctcgactactacctaagttctggacccaaacgtccggtcccttttagacgtaaactaacttcctacctaccctaacctccgaggtacgtagaacgtacggtagtacttatttattactcgtaccttcgtactactacggactacggtgtacttactttagtttttccgttagggttttcgggcggtaccgtaccgtagtacgtacgtcgttcgtaccgtctacggtaaccgacgacccgtaacgtcctcccgtccccgtacgttccc

SEQ ID NO: 300679 - DNA, 561 bp, Homo sapiens
  misc_feature: GZ8MTXP02GUCZY.21.87.H10.1.454.CMB.2.raw
  modified_base (318)..(318): a, c, t, g, unknown or other
  misc_feature (318)..(318): n is a, c, g, or t
tcagtcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctccgtgtctgggtcctccgggcagtcggtcaccatctcttgcgctggatccagcgatgatattggtacttttactgtctctgtatcaacaacacagaacaaacgaccccaaaatcttaattctgctacaatcagccaccctnactattcgttaccagtcgtattcctctgcatccaagttctgcaacgacgtccttcagactaatctctacaactcagctagagacgagtctattattactgctctacagtacagtagtcgtactacttatttttcgttgggttttcggacgggtaccggaccctaggtacgtacgtaccgttcggtaccctcgtaacgtccgaccgtaacccgtacggccgtcccggcccccgttcggttaccc

SEQ ID NO: 300680 - DNA, 667 bp, Homo sapiens
  misc_feature: GZ8MTXP02IENHP.21.87.H10.1.454.CMB.2.raw
  modified_base (197)..(197): a, c, t, g, unknown or other
  misc_feature (197)..(197): n is a, c, g, or t
  modified_base (216)..(216): a, c, t, g, unknown or other
  misc_feature (216)..(216): n is a, c, g, or t
  modified_base (300)..(300): a, c, t, g, unknown or other
  misc_feature (300)..(300): n is a, c, g, or t
  modified_base (310)..(310): a, c, t, g, unknown or other
  misc_feature (310)..(310): n is a, c, g, or t
  modified_base (334)..(334): a, c, t, g, unknown or other
  misc_feature (334)..(334): n is a, c, g, or t
  modified_base (337)..(337): a, c, t, g, unknown or other
  misc_feature (337)..(337): n is a, c, g, or t
tcagtcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctcgtgtctgggtcctccgggnagtcggtcacatctctgcnctgactccagcgatgattagttggtaacttttacttgtctctgtatcaacacacagacaacaccaaatctaattctgctacaancacgcacctnactattcgttccagtcgtattccnctncatctaacgtctcggacaaacgtcgttaccttttcgacgtaaactaactccttacctacctaaaccgttccgaacggtacttacggaacggtaacgtaacggtacctttacttttaacttaccgttacgtaccttccgttacaaccgttacgacgtacgggttacggtacctttacgttttacgtttttttaccggttttcggggtttttacggggacccgggtttaaccgggacccgttagggttaacttcggttaaccgtttcggtacctttacgacgttaaccgaccgaccggttaaccgccgttcccgtccccgtttacgtacccg

SEQ ID NO: 300681 - DNA, 661 bp, Homo sapiens
  misc_feature: GZ8MTXP02JI7XH.21.87.H10.1.454.CMB.2.raw
  modified_base (196)..(196): a, c, t, g, unknown or other
  misc_feature (196)..(196): n is a, c, g, or t
  modified_base (258)..(258): a, c, t, g, unknown or other
  misc_feature (258)..(258): n is a, c, g, or t
  modified_base (308)..(308): a, c, t, g, unknown or other
  misc_feature (308)..(308): n is a, c, g, or t
tcagtcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctcgtgtctgggtctccgggnagtcgtcaccatctcttgcgctggactccagcgatgatagttggtactttactgtctctgtntcaacacacagacaacacccaaatcttaattctgctacatcagccacctnacattgttaccagtctacttcctctgactactcctaaagttcctggacctaaacgtaccggttcctttactacgtaacctaacttccctactaccctacctaccgtacgtacgtacgaaacggacgtaacggtacttaactttacgtttactacgtccttacccttacacgttaccgacgtagggtacgactttaacgtttaacgttttttcggtttacggggtttttcggggaccgggttaccgggtacccgtaaggttacgtcggttaaccttcggtacccgttacgtacggtccgtaaacccggtacccgtaacgggtccctaccccggtacccccgttcggtaaccccc

SEQ ID NO: 300682 - DNA, 556 bp, Homo sapiens
  misc_feature: GZ8MTXP02JSR7I.21.87.H10.1.454.CMB.2.raw
  modified_base (296)..(296): a, c, t, g, unknown or other
  misc_feature (296)..(296): n is a, c, g, or t
  modified_base (359)..(359): a, c, t, g, unknown or other
  misc_feature (359)..(359): n is a, c, g, or t
  modified_base (368)..(368): a, c, t, g, unknown or other
  misc_feature (368)..(368): n is a, c, g, or t
tcagtcgtcgctcgcacgaccggtgctcgatttagcagtactgcgttgggtttgggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcatgattattggtacttttacctgtctcctgtatcaacacacagacaaacgccccaaatcttaattcngctacaatcagcaccctcactatcgtttccagtcgtattcctctgcatccaagtctggcaacncgtcctttncgacatctctcaactccagctagaacgacgagtcttatttacttactgtccttcctactatacgacgtaggtcggactacgttactttttcgtttgggtttttggccggttacggacccaggtactacgtacgttcgtcctcgtacgtcgtacgacccgtacggtcctccggtcccccgtcggtcccg

SEQ ID NO: 300683 - DNA, 589 bp, Homo sapiens
  misc_feature: GZ8MTXP02HXBPC.21.87.H10.1.454.CMB.2.raw
  modified_base (387)..(387): a, c, t, g, unknown or other
  misc_feature (387)..(387): n is a, c, g, or t
tcagtcgtcgctcgcacgaccggtgctcgatttagcagtactgcgttgggtttgggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacttttaaccttgtctcctggtatcaacaacacaaggacaaacgacccccaaaatcttaattctaggctacaatcagccgaccctcacatgttccagtcgattcctctcgcactccaaagtctggaccaaacgtccggtcctttacncgaactaatcctctaccaactccaggtctagaacgacgagcttattattactgtaccttctacagtacgctaggtcgactacttatttttccgtttagggtttttcggaccgggtaccgggtaccctaggtaacgttcgaacgttcgttacccgtcacgtccgacgacccgaacggtcctacccgtcccccgttcggtaccc

SEQ ID NO: 300684 - DNA, 627 bp, Homo sapiens
  misc_feature: GZ8MTXP02GAPHQ.21.87.H10.1.454.CMB.2.raw
  modified_base (198)..(198): a, c, t, g, unknown or other
  misc_feature (198)..(198): n is a, c, g, or t
tcagtcgtcgctcgcacgaccggtgctcgatttagcagtactgcgttggggtttggggggggtcacaagaggcagcgctctcgggacgtctccaccatggcctgggctctgctgctcctcactctcctcactcagggcacagggtcctgggcccagtctgccctgactcagcctgcctccgtgtctgggtctccgggnagtcgtcaccatctcttgcgctggactccagcgatgatattggtacttttactgtctctgtatcaacacacagacaaacgaccccaaaatcttaattctggctacaatcagccgaccctacacattcgttccagtcgtattcctctcgacactaccaagtctggccaaacgacgtccctttactagaacctaaatccctactacctaaaccgtacccagggtacctaggaaacgaacgtaaggttaccttaaatttaacttaactcgtaccttaccctcaactaccgagtacggtacgacttacgtttacgtttttcgttggggtttttacgggccgggtaccgggtaccctaaggtactacgtacgttcgttacctcgacgttaaccgacgtaccggtacgtcctccggtcccccgttacggttaccc

SEQ ID NO: 300685 - DNA, 516 bp, Homo sapiens
  misc_feature: GZ8MTXP02FQWL2.21.87.H10.1.454.CMB.2.raw
  modified_base (236)..(236): a, c, t, g, unknown or other
  misc_feature (236)..(236): n is a, c, g, or t
  modified_base (298)..(298): a, c, t, g, unknown or other
  misc_feature (298)..(298): n is a, c, g, or t
  modified_base (367)..(367): a, c, t, g, unknown or other
  misc_feature (367)..(367): n is a, c, g, or t
  modified_base (418)..(418): a, c, t, g, unknown or other
  misc_feature (418)..(418): n is a, c, g, or t
  modified_base (424)..(424): a, c, t, g, unknown or other
  misc_feature (424)..(424): n is a, c, g, or t
tcagtcgtcgctcgcacgaccggtgctcgatttagcagtactgcgttgggtttgggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatnttggacttttaactgtctctgtatcaacaacacaggacaaagaccccaaaatcttaatttcngctcaatcagcgaccctcacatgtttccagtcattcctctgcatccaagtctggcaaacacgtcctttngacaatctctcaactcagctagaagacgagtcttatttattactgctcctnatacgnaggtgactacttatttttcgttggttttcggcggtcggaccctagactgactcgtacctctagtcacgcccgaacggctcgccccctggtcc

SEQ ID NO: 300686 - DNA, 560 bp, Homo sapiens
  misc_feature: GZ8MTXP02GAVC2.21.87.H10.1.454.CMB.2.raw
  modified_base (298)..(298): a, c, t, g, unknown or other
  misc_feature (298)..(298): n is a, c, g, or t
  modified_base (346)..(346): a, c, t, g, unknown or other
  misc_feature (346)..(346): n is a, c, g, or t
  modified_base (361)..(361): a, c, t, g, unknown or other
  misc_feature (361)..(361): n is a, c, g, or t
  modified_base (388)..(388): a, c, t, g, unknown or other
  misc_feature (388)..(388): n is a, c, g, or t
  modified_base (437)..(437): a, c, t, g, unknown or other
  misc_feature (437)..(437): n is a, c, g, or t
  modified_base (444)..(444): a, c, t, g, unknown or other
  misc_feature (444)..(444): n is a, c, g, or t
  modified_base (450)..(450): a, c, t, g, unknown or other
  misc_feature (450)..(450): n is a, c, g, or t
  modified_base (453)..(453): a, c, t, g, unknown or other
  misc_feature (453)..(453): n is a, c, g, or t
tcagtcgtcgctcgcacgaccggtgctcgatttagcagtactgcgttggggtttgggggggggtcacaagaggcagcgctctcgggacgtctccaccatggcctgggctctgctgctcctcactctcctcactcagggcacagggtcctgggcccagtctgccctgactcagcctgcctccgtgtctgggtcctccgggcagtcgtcaccatctcttgcgctggactccagcgatgatattggtacttttactgtctctgtatcaacacacagacaaacgacccaaatcttaatttcnggctcaatcacgcgaccctcactattcgttaccagtcgtattcctctnactactcaacgttcnggaccaacgtaccggtccttttacganaactaatcactaccaactccagctagaacacgagtcttagttattactncctactnatacgnagngactacttattttcgttaggtttcggcggtacggtaccagtacgtcgtacttcgtaccgtcaggtaaccacgaccgtaacggtcctccggtcccccgttggtaaccc

SEQ ID NO: 300687 - DNA, 503 bp, Homo sapiens
  misc_feature: GZ8MTXP02F5KFP.21.87.H10.1.454.CMB.2.raw
  modified_base (321)..(321): a, c, t, g, unknown or other
  misc_feature (321)..(321): n is a, c, g, or t
  modified_base (338)..(338): a, c, t, g, unknown or other
  misc_feature (338)..(338): n is a, c, g, or t
  modified_base (355)..(355): a, c, t, g, unknown or other
  misc_feature (355)..(355): n is a, c, g, or t
  modified_base (366)..(366): a, c, t, g, unknown or other
  misc_feature (366)..(366): n is a, c, g, or t
tcagtcgtcgctcgcacgaccggtgctcgatttagcagtactgcgttgggtttgggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacttttaacctgtctctgtatcaacaacacaggacaaagccccaaaatcttaattctggcgtcaatcagcgaccctcacattnttccagtcattcctctncatcaagtctggcaacncggtcctttcngacaatctctcaactccagctagaagacgagcttattattactgcctctcatcgacaggtgcatacttttgttggttttgcggtcggaccctagactgacttcgtcctcagtcacgacccaggctcgcccctcgtcc

SEQ ID NO: 300688 - DNA, 809 bp, Homo sapiens
  misc_feature: GZ8MTXP02F3Z8B.21.87.H10.1.454.CMB.2.raw
  modified_base (300)..(300): a, c, t, g, unknown or other
  misc_feature (300)..(300): n is a, c, g, or t
  modified_base (307)..(307): a, c, t, g, unknown or other
  misc_feature (307)..(307): n is a, c, g, or t
tcagtcgtcgctcgcacgaccggtgctcgatttagcagtactgcgttgggtttgggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggtacttttactgtctctgtatcaacaacacaggacaaacgaccccaaaactcttaatttcnggtctanaatcagcaccctcactattcgtttccagttccgtatttccctacgtgacactaccaagttcctggacctaaacctaaccgggtccctttttacgtacggtaaacctaacttacccttaccttaacccgtaaaccttaccccgtaaaggggttacccttacggggtaaaaaccggaacccgggtaaacgggggttaccctttaaaacgtttttaaacgttttaaaccccttaccggtcccctttaaccccgttaccctaaaaccgtttaacccgggacggttaaacggggttccgggtaaacccttaacgtttttaaacggtttttttccggttttaacgggggttttttcggggaacccgggggttaccccggggtaaacccccgtaggttaaacgtttcccggtaaccgtttaccggtccccgttaccgttaaggtaaccctaccggaacccccggtaaacggtcccgtcccccgttacccccggttacgggtttaccccc

SEQ ID NO: 300689 - DNA, 565 bp, Homo sapiens
  misc_feature: GZ8MTXP02G3KXM.21.87.H10.1.454.CMB.2.raw
  modified_base (198)..(198): a, c, t, g, unknown or other
  misc_feature (198)..(198): n is a, c, g, or t
  modified_base (301)..(301): a, c, t, g, unknown or other
  misc_feature (301)..(301): n is a, c, g, or t
  modified_base (375)..(375): a, c, t, g, unknown or other
  misc_feature (375)..(375): n is a, c, g, or t
  modified_base (385)..(385): a, c, t, g, unknown or other
  misc_feature (385)..(385): n is a, c, g, or t
  modified_base (449)..(449): a, c, t, g, unknown or other
  misc_feature (449)..(449): n is a, c, g, or t
  modified_base (457)..(457): a, c, t, g, unknown or other
  misc_feature (457)..(457): n is a, c, g, or t
tcagtcgtcgctcgcacgaccggtgctcgatttagcagtactgcgttgggtttgggggggtcacaagaggcagcgctctcgggacgtctccaccatggcctgggctctgctgctcctcactctcctcactcagggcacagggtcctgggcccagtctgccctgactcagcctgcctccgtgtctgggtcctcccgggnagtcggtcaccatctcttgcgctggatccagcgatgatagttggacttttaacctgtctcctgtatcaacaacacagaacaaagccccaaaatcttaaattcnggctacaatcagccgaccctacacattgtttaccagtcgtaattccctctgcatccaaagttctggaccaaacncggtcctttntagaactaaactctactacaactccagctagaagacgaaggtcttatttactactgcttcctanagttacgngagtgactattagtttttcgttaggttttgccggtacggtacccagtactgtaacttcgtcctacgtagtcgacgacccgaacggtcctcccgaccccgttcggtacc

SEQ ID NO: 300690 - DNA, 601 bp, Homo sapiens
  misc_feature: GZ8MTXP02FZIVC.21.87.H10.1.454.CMB.2.raw
  modified_base (197)..(197): a, c, t, g, unknown or other
  misc_feature (197)..(197): n is a, c, g, or t
  modified_base (296)..(296): a, c, t, g, unknown or other
  misc_feature (296)..(296): n is a, c, g, or t
  modified_base (312)..(312): a, c, t, g, unknown or other
  misc_feature (312)..(312): n is a, c, g, or t
tcagtcgtcgctcgcacgaccggtgctcgatttagcagtactgcgttgggtttggggggggtcacaagaggcagcgctctcgggacgtctccaccatggcctgggctctgctgctcctcactctcctcactcaggcacagggtcctgggcccagtctgccctgactcagcctgcctccgtgtctgggtcctccgggnagtcgtcaccatctcttgcgctggactccgagcgatgatattggtacttttaactgtctctgtatcaacacacagacaaacgaccccaaatctaattcngctcaatcagcacctnactattcgttaccagtcgtattcctactcgacacgtccaagttcgcggaccaaacgtaccggtccctttagactaaactaacttcctaactacctaaccgtaccaggtacctagaaacgtacgacgtacttaagtttactactctaccttctatacgtacgacgtaggtcgtacctactttacgttttcgtttagggttttcggcgggtaccgtaacctggtaacttcggtacttcgtaccctgtacgtccgaacgaccgtacggtccctaccgtcccccgtgttaccc

SEQ ID NO: 300691 - DNA, 713 bp, Homo sapiens
  misc_feature: GZ8MTXP02JX8Y1.21.87.H10.1.454.CMB.2.raw
  modified_base (196)..(196): a, c, t, g, unknown or other
  misc_feature (196)..(196): n is a, c, g, or t
  modified_base (207)..(207): a, c, t, g, unknown or other
  misc_feature (207)..(207): n is a, c, g, or t
  modified_base (291)..(291): a, c, t, g, unknown or other
  misc_feature (291)..(291): n is a, c, g, or t
  modified_base (297)..(297): a, c, t, g, unknown or other
  misc_feature (297)..(297): n is a, c, g, or t
  modified_base (299)..(299): a, c, t, g, unknown or other
  misc_feature (299)..(299): n is a, c, g, or t
  modified_base (307)..(307): a, c, t, g, unknown or other
  misc_feature (307)..(307): n is a, c, g, or t
  modified_base (311)..(311): a, c, t, g, unknown or other
  misc_feature (311)..(311): n is a, c, g, or t
  modified_base (330)..(330): a, c, t, g, unknown or other
  misc_feature (330)..(330): n is a, c, g, or t
tcagtcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctcgtgtctggtcctcccggnagtcgtcaccntctctgcgctggatccagcgatgattagttggtactttacctgtctctgtatacaacacacagacaacaccctaaatcttatcngctcancncgcacctnactntcgtacagtcgtattcctngtactactacgtacgttcgtcggactaactaccggttccttacgtacgtaactaactccgttacctactaaccgtccgaaggctacggaaacggtacgtaacgttacgttaactttactacgtccgtccttaccgtacgtaacgtaccggtacgtacgggttaccgtaccttaaccgtttttacgttttttccgggtttacgggggtttttacccggggacccgggggttaccccggggttaaaccgtaaacgggtttacgttaacccggtttaacccgtttaccggtcccttaaccggtaacggttaaccccgtaccccggtaacccgttaacggggtcccccgtttcccccgggttaaccccggttccgtttaaacccccg

SEQ ID NO: 300692 - DNA, 703 bp, Homo sapiens
  misc_feature: GZ8MTXP02HCJAQ.21.87.H10.1.454.CMB.2.raw
  modified_base (195)..(195): a, c, t, g, unknown or other
  misc_feature (195)..(195): n is a, c, g, or t
  modified_base (303)..(303): a, c, t, g, unknown or other
  misc_feature (303)..(303): n is a, c, g, or t
  modified_base (345)..(345): a, c, t, g, unknown or other
  misc_feature (345)..(345): n is a, c, g, or t
tcagtcgtcgctcgcacgaccggtgctcgatttagcagtactgcgttgggtttgggggggtcacaagaggcagcgctctcgggacgtctccaccatggcctgggctctgctgctcctcactctcctcactcagggcacagggtcctgggcccagtctgccctgactcagcctgcctcgtgtctgggtctcccggnagtcggtcaccatctcttgcgctggactccagcgatgattagttggtacttttactgtctcctgtatcaacaacacagaacaaacacccaaactcttaatctggctanaatcagccgacctacactattcgttaccagtccgtatcctcngtctacgtacaagtctacggacctaaacgccgttacctttacgataaacctaaacttcctcctaaaccgtaaaccttcccgaaacgggtacttaacggaaaaccggacggtaaaccggttatttaaacttttaaacgttaaaccttcccggttaccttacccccgtttaaacgtaaaccgttacggaacggttacgggtaccgttaacctttaacgtttttacggttttttccgggtttacggggtttcgggacccggggtaccgtaaacgttagtaacgtacgtaccgttcgtaccgttacgtacgtaaccgaaccgtacccggaacgtcccgtaccccggtaccccgtacgtaccc

SEQ ID NO: 300693 - DNA, 633 bp, Homo sapiens
  misc_feature: GZ8MTXP02FIXPQ.21.87.H10.1.454.CMB.2.raw
  modified_base (180)..(180): a, c, t, g, unknown or other
  misc_feature (180)..(180): n is a, c, g, or t
  modified_base (195)..(195): a, c, t, g, unknown or other
  misc_feature (195)..(195): n is a, c, g, or t
  modified_base (206)..(206): a, c, t, g, unknown or other
  misc_feature (206)..(206): n is a, c, g, or t
  modified_base (301)..(301): a, c, t, g, unknown or other
  misc_feature (301)..(301): n is a, c, g, or t
  modified_base (385)..(385): a, c, t, g, unknown or other
  misc_feature (385)..(385): n is a, c, g, or t
tcagtcgtcgctcgcacgaccggtgctcgatttagcagtactgcgttgggtttggggggtcacaagaggcagcgctctcgggacgtctccaccatggcctgggctctgctgctcctcactctcctcactcagggcacagggtcctgggcccagtctgccctgactcagcctgcctccgtntctgggtctccgggnagtcgtcaccntctcttgcgctggatccagcgatgatattggacttttaactgtctcctggtatcaacacaccaggacaaacgcccccaaaactctttaaatttcnggtcgtacaatcgagccgaacccctcacagttcgtttccagttccgtattcccctctgcaacttccaaggttctggaccaaacncggtcctttacagacctaatcctacctacccgaaaccccaggtctacgaacgaacggaggtactttaactttacttaccgtcgtcccttaccctactactaccgtcgacggtcggacctacttagtttttcgttagggttttcgggccgggtccgggtaaccctaggtactcggtaccgttacgtacccttcgaacgtccgaacgtcccgaaacggtccgtacccgtcccccgttacggtcctacccg

SEQ ID NO: 300694 - DNA, 709 bp, Homo sapiens
  misc_feature: GZ8MTXP02GQ19Q.21.87.H10.1.454.CMB.2.raw
  modified_base (195)..(195): a, c, t, g, unknown or other
  misc_feature (195)..(195): n is a, c, g, or t
  modified_base (296)..(296): a, c, t, g, unknown or other
  misc_feature (296)..(296): n is a, c, g, or t
tcagtcgtcgctcgcacgaccggtgctcgatttagcagtactgcgttgggtttgggggggtcacaagaggcagcgctctcgggacgtctccaccatggcctgggctctgctgctcctcactctcctcactcagggcacagggtcctgggcccagtctgccctgactcagcctgcctcgtgtctgggtctccgggnagtcgtcaccatctcttgcgctggatccagcgatgatattggacttttaacctgtctccgtgtatcaacacaccagacaaacgccccaaaatcttaattcngcgtacaatcagcgaccctcactattcgtttaccagtcgtatttccctctagacacttccgaagttccgtgggacctaaacgtaccgggtacccttttcgacgtaacctaaacttcctacctaccgtaaaaccttccccgaaggtacccgttaagaaacggaccggtaacggtacctttacgtttaactttaaaccgtcggtcccttaccttacgtaaacgttaccgggtacgtacgggttacgggtacctaacgttttaacgttttttccgtttagggggtttttaccgggcgggtaccggggtaacccctagggttaactcggtaaccgtttccggtaaccccttggtaaaccgtccgttaaccggacccgtaacgggtccgttcccgtacccccgtttcgggttaacccc

SEQ ID NO: 300695 - DNA, 694 bp, Homo sapiens
  misc_feature: GZ8MTXP02IUBN7.21.87.H10.1.454.CMB.2.raw
  modified_base (345)..(345): a, c, t, g, unknown or other
  misc_feature (345)..(345): n is a, c, g, or t
  modified_base (427)..(427): a, c, t, g, unknown or other
  misc_feature (427)..(427): n is a, c, g, or t
tcagtcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctcgccctgactcacgcctgcccttccgtgtcgtcgggtccgtcccgggcaggtcggtcacctatcttcttcgcgtcgtggactccagcgtatcgtattagttacggttaccgttttaaccttgtcctcgttaggtatacaaaccaacaccgaagaacaaaccgacccctaaaacttctttaatttcgnggtcgtacaactcacgtccaccctcactattccgttacacgttacgtactttccgtctacgtcaacttacccgtaagttccngggtaaccaaaccggtccgttacctttcgaacaactaactccttacctacctaacgtcgacgtactacggaacgtacgtacgttacttaagttcttactccgtctcgtactacgtacgacgtaggtcgtactttacgtttacgtttttggtttcgggtttcgggaccgggttacggtacccgttaagtcgttacggacctttcggtaacctcggtactcgaaccggtacccgtacggtcccgttacccgtcccccggttcgtacccg

SEQ ID NO: 300696 - DNA, 493 bp, Homo sapiens
  misc_feature: GZ8MTXP01BBVLG.51.75.G09.1.454.CMB.2.raw
  modified_base (226)..(226): a, c, t, g, unknown or other
  misc_feature (226)..(226): n is a, c, g, or t
  modified_base (305)..(305): a, c, t, g, unknown or other
  misc_feature (305)..(305): n is a, c, g, or t
  modified_base (353)..(353): a, c, t, g, unknown or other
  misc_feature (353)..(353): n is a, c, g, or t
  modified_base (424)..(424): a, c, t, g, unknown or other
  misc_feature (424)..(424): n is a, c, g, or t
tcagcgatcgtatacacgaccggtgctcgatttagtatagacatcaggggcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggancagctccaacagtcggggcaggaatgatgtacactggtaccagcagcttccaggaacacgtccccaaatcctcatttangactaacaccaatccccggccctcgacggggtcccctgccccgattcnctggcctccaggtctggccacctcacgccctcctgcccatcactgggctcgggctgagatgaggctgattntactgaccagtcccatgacaagcagccttgagtgttgcttggtcggcggaaggaccagctcgccgtccg

SEQ ID NO: 300697 - DNA, 739 bp, Homo sapiens
  misc_feature: GZ8MTXP01D06M3.51.75.G09.1.454.CMB.2.raw
  modified_base (225)..(225): a, c, t, g, unknown or other
  misc_feature (225)..(225): n is a, c, g, or t
  modified_base (310)..(310): a, c, t, g, unknown or other
  misc_feature (310)..(310): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagaggtcaccatctctgcactgggancagctccaacagtcggggcaggtaatgatgtacactggtaccagcagcttccaggaacacgtaccccaaactcctactaatttancgacctaaacaccctaaacgtccccggcccctacgacgggggttcccctcgacccccgtatttcctcgtcgggtccctcccgagggtctcgggaccctaccccttcgaccggtcccctccccgttcggaccctacgttccgaccgttcggggcccgttcccgggggcttagggaacggaggttcgggaacggggtccttaggtaacttttaacgtttaaccgtccggtaaccccgtacggttccccctaaagttacggaacccgtaacggcccgttaaacgggtccccgtttagggtaaccggtttcgggttacgggttcccggtttccgggggttttaaccccgggggaccgggggtaaaaccgggggtaaccccgaaaccggggttcccggttaaccccgggttaaacccccggtttaacccccggg

SEQ ID NO: 300698 - DNA, 534 bp, Homo sapiens
  misc_feature: GZ8MTXP01A314W.51.75.G09.1.454.CMB.2.raw
  modified_base (318)..(318): a, c, t, g, unknown or other
  misc_feature (318)..(318): n is a, c, g, or t
  modified_base (439)..(439): a, c, t, g, unknown or other
  misc_feature (439)..(439): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtcgtggggccccagggcagaggtcaccatctcctgcacgtggggagcagctccaacagcggggacaggtaatgatgtacactggtaccagcagcttaccaggaacacgtaccccaaactcctactatttangactaaccaccaatccggccctcgaacgggtccctgcccgtattcctcgtggcctcgacggtctcggccacctcacgccctcccgtcggccactccacgtcgggcctccggggctggaggntggaggtctgtattatactgccctagtcccaatcgacagcgaggtccttggcgttgtcgcgttcgggttcgggcgggaacgggaaccaaggtccg

SEQ ID NO: 300699 - DNA, 560 bp, Homo sapiens
  misc_feature: GZ8MTXP01A6XAX.51.75.G09.1.454.CMB.2.raw
  modified_base (227)..(227): a, c, t, g, unknown or other
  misc_feature (227)..(227): n is a, c, g, or t
  modified_base (311)..(311): a, c, t, g, unknown or other
  misc_feature (311)..(311): n is a, c, g, or t
  modified_base (446)..(446): a, c, t, g, unknown or other
  misc_feature (446)..(446): n is a, c, g, or t
  modified_base (472)..(472): a, c, t, g, unknown or other
  misc_feature (472)..(472): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggancagctcaacagtcggggcaggtaatgatgtacactggtaccagcagcttaccaggaacacgtaccccaaatcctactatttacngtactaaacaccaaatccccggcccctacgacggggtcccctgaccccgtatttccctcgtcgggcctccgtaggtctcgggccaccctcacgccctcccgtggccatcacgtcgggcgtaccgggctggacggngtgaggtctagtattatacgtgaccngtcccagtcgacaacgcagtccttggcgtggttcgttcgttcgggttcgggcgggaacgggccaagggttctaacgcccgttaacccg

SEQ ID NO: 300700 - DNA, 596 bp, Homo sapiens
  misc_feature: GZ8MTXP01DOWHJ.51.75.G09.1.454.CMB.2.raw
  modified_base (231)..(231): a, c, t, g, unknown or other
  misc_feature (231)..(231): n is a, c, g, or t
  modified_base (315)..(315): a, c, t, g, unknown or other
  misc_feature (315)..(315): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagaggtcaccatctcctgcactggggancagctccaacagtcggggcaggtaatgatgtacactggtaccagcagcttaccaggaacacgtacccccaaatcctatatttangacctaaccaccaatccggccctcgaacggggtccctgcccgtattcctctcggctcgagtctcgccacctcacgtccctcccgtggcctactccacgtcgggcctcccggggctcggacggtatggacggtcttaggtactttaagttacctcggtaccctacggtcccctaagtcggacacggccaacggtcccgttaggttacggttggttcgtaccggtttcggggtttacccggggaccggggttaacgggggaaccccgttaaagggtccccggg

SEQ ID NO: 300701 - DNA, 701 bp, Homo sapiens
  misc_feature: GZ8MTXP01AXL2P.51.75.G09.1.454.CMB.2.raw
  modified_base (309)..(309): a, c, t, g, unknown or other
  misc_feature (309)..(309): n is a, c, g, or t
  modified_base (379)..(379): a, c, t, g, unknown or other
  misc_feature (379)..(379): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacagtcggggcagggtaatgatgtacactggtaccagcagcttccaggacacgtccccaaactcctacatttangactaacaccaactcccggccctcgacggggtcccctggccccgtattctctcgggccttccgaggttcncggccacccttcacggtccctcccgtcgggccctaactccgtaacgttcgggggcccttacccgggggccttacgggaacggggtaagttgggaaacgggggtccttacgggtaagttttaacgttaaccttcgggtaacccctaacggtttcccccaagttaccgggaaccctaagggtccccttaagggccccgtttgggaaacgggtttcgggttgggcccggttttacgggggtttccccgggggaccggggtaaacggggggtaaaccccctaaagggcccggttaacccgggttaaacccccggtttaaccccggg

SEQ ID NO: 300702 - DNA, 520 bp, Homo sapiens
  misc_feature: GZ8MTXP01CHX06.51.75.G09.1.454.CMB.2.raw
  modified_base (229)..(229): a, c, t, g, unknown or other
  misc_feature (229)..(229): n is a, c, g, or t
  modified_base (411)..(411): a, c, t, g, unknown or other
  misc_feature (411)..(411): n is a, c, g, or t
  modified_base (417)..(417): a, c, t, g, unknown or other
  misc_feature (417)..(417): n is a, c, g, or t
  modified_base (420)..(420): a, c, t, g, unknown or other
  misc_feature (420)..(420): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagaggtcacatctcctgcactgggancagctccaacatcggggcaggtaatgatgtacactggtaccagcagcttccaggaacacgtaccccaaactcctcatttatgactaacccaccaatccggccctcgaacggggtccctgccccgtattctctggctcaggtctggcactcacgcctccctagccatcactgggctcccgggngtgagntgngtctgtattactactcgaccacgtcccaatcgacacgcgacggtcgttaggttcgttcggtcgtcgttcgggttcgggacgggaacggtaaccgaagtcg

SEQ ID NO: 300703 - DNA, 558 bp, Homo sapiens
  misc_feature: GZ8MTXP01EMFRY.51.75.G09.1.454.CMB.2.raw
  modified_base (183)..(183): a, c, t, g, unknown or other
  misc_feature (183)..(183): n is a, c, g, or t
  modified_base (232)..(232): a, c, t, g, unknown or other
  misc_feature (232)..(232): n is a, c, g, or t
  modified_base (320)..(320): a, c, t, g, unknown or other
  misc_feature (320)..(320): n is a, c, g, or t
  modified_base (496)..(496): a, c, t, g, unknown or other
  misc_feature (496)..(496): n is a, c, g, or t
  modified_base (511)..(511): a, c, t, g, unknown or other
  misc_feature (511)..(511): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcccagtctgtgctgacgcagccgccctnagtgtcgtggggccccagggcagaggtcaccatctcctgcacgtgggancagctccaacagcggggcaggtaatgatgtacacgtggtaccagcagcttaccaaggaccacgtacccccaaactcctactatttacncgacctaaacccacctaatccggcccctcgaaccggggtccctcgcccgtattcctcgtcggcctcgtacggtctcggcacctcacgtccctcccgtcggccatccacgtcgggcctccgggcgtggaggtactggacgctagtattagttacctcgtcccacgtcccaatcgacngaccgacgtcgttgngttcggtgtcgttcgggtcggggacgggacggtaaccgaacggtccg

SEQ ID NO: 300704 - DNA, 521 bp, Homo sapiens
  misc_feature: GZ8MTXP01DLJ2H.51.75.G09.1.454.CMB.2.raw
  modified_base (231)..(231): a, c, t, g, unknown or other
  misc_feature (231)..(231): n is a, c, g, or t
  modified_base (317)..(317): a, c, t, g, unknown or other
  misc_feature (317)..(317): n is a, c, g, or t
  modified_base (489)..(489): a, c, t, g, unknown or other
  misc_feature (489)..(489): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagaggtcaccatctcctgcacgtgggancagctccaacagcggggcaggtaatgatgtacacgtggtaccagcagcttaccaggaacacgtacccccaaactcctactatttancgactaaacccaccaatccggcccctgaacggggtcccctgcccgtattcctcgtcggcctccgaggtcctggccacctcacgccctccgtcggcccatccgacgtcgggccgtccgggcgtggacggatggaggctgtattatctgccagtcccaatgacagcagccttgngttgtgcgtggtcggcggacggtaacaagtcg

SEQ ID NO: 300705 - DNA, 499 bp, Homo sapiens
  misc_feature: GZ8MTXP01DR68K.51.75.G09.1.454.CMB.2.raw
  modified_base (244)..(244): a, c, t, g, unknown or other
  misc_feature (244)..(244): n is a, c, g, or t
  modified_base (302)..(302): a, c, t, g, unknown or other
  misc_feature (302)..(302): n is a, c, g, or t
  modified_base (308)..(308): a, c, t, g, unknown or other
  misc_feature (308)..(308): n is a, c, g, or t
  modified_base (373)..(373): a, c, t, g, unknown or other
  misc_feature (373)..(373): n is a, c, g, or t
  modified_base (404)..(404): a, c, t, g, unknown or other
  misc_feature (404)..(404): n is a, c, g, or t
  modified_base (461)..(461): a, c, t, g, unknown or other
  misc_feature (461)..(461): n is a, c, g, or t
tcagcgatcgtatacacgaccggtgctcgatttagtatagacatcagggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagaggtcaccatctcctgcacgtgggagcagctccaacancgggcaggtaatgatgtacactggtaccagcagctccaggacagtccccaaatcctanatttangactaaaccaccaatccggccctcgaacgggtccctgcccgtattctctggctcaggtctgcacncacgcctcctcgccatcacgtggctccgggngtcgaggatggagctgtattatactcgtccacgtcccaatcgacagcgacgccttgngttcgtgcgtggttcgggcggacggaaccgaaggtccg

SEQ ID NO: 300706 - DNA, 618 bp, Homo sapiens
  misc_feature: GZ8MTXP01BRW0Z.51.75.G09.1.454.CMB.2.raw
  modified_base (562)..(562): a, c, t, g, unknown or other
  misc_feature (562)..(562): n is a, c, g, or t
tcagcgatcgtatacacgaccggtgctcgatttagtatagacatcagggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagaggtcaccatctcctgcacgtgggagcagctccaacagtcgggcaggtaatgatgtacacgtggtaccagcagcttaccgaggaaccacgtacccccaaactcctactaatttactcgacctaaacccaccctaaagtcccggcccctcgaaccgggggttccccctggccccgtatttcctcgtcgggcctccgaggttctcggcctacctcacgtccctccccgtcggccctagtccacgtcgggccgtcccggggcgttcgggacggacgttcggacggtcctaggtactttacgttaccgtcggtaccctacggttccccaagttcgaaccgacgccgacgtcccgttaggnggttcggtcgtcgttcgggttccgggacggggttacgggtaacccgaaggtcccgg

SEQ ID NO: 300707 - DNA, 618 bp, Homo sapiens
  misc_feature: GZ8MTXP01EIPDH.51.75.G09.1.454.CMB.2.raw
  modified_base (229)..(229): a, c, t, g, unknown or other
  misc_feature (229)..(229): n is a, c, g, or t
  modified_base (316)..(316): a, c, t, g, unknown or other
  misc_feature (316)..(316): n is a, c, g, or t
  modified_base (449)..(449): a, c, t, g, unknown or other
  misc_feature (449)..(449): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcagccgccctcagtgtcgtggggccccagggcagagggtcaccatctcctgcacgtgggancagcctaccaacagtcgggacaggtaatgatgtacactggtaccagcagcttaccaggaacacgtaccccaaactcctactatttangacctaacaccaacgtccccggccctacgacggggtccctcgaccccgtattccgtcgtcggcctccgacgggtctcgggccaccctcacgcccctcccgtcggccctacgtccacgtcggggcctcccgggngtaggagtaggtcggacgtctagttactttacgttacgtcgacctaccgtaccagtcgaacgaacgcgacgtccgttggtacggttggttcgttccggttcgggttaaccggggaccgggtaacgggaacccgtacggttcccgttaacccggttaacccgttaacccg

SEQ ID NO: 300708 - DNA, 549 bp, Homo sapiens
  misc_feature: GZ8MTXP01DPNWA.51.75.G09.1.454.CMB.2.raw
  modified_base (319)..(319): a, c, t, g, unknown or other
  misc_feature (319)..(319): n is a, c, g, or t
  modified_base (429)..(429): a, c, t, g, unknown or other
  misc_feature (429)..(429): n is a, c, g, or t
  modified_base (437)..(437): a, c, t, g, unknown or other
  misc_feature (437)..(437): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctcggggccccagggcagaggtcaccatctcctgcacgtgggagcagctaccaacagcgggcaggtaatgatgtacactggtaccagcagccttaccaaggaaccacgtacccccaaatcctactatttangacctaaaccaccaatccggccctacgaacgggtccctgcccgtattccgtctcggccttcgacggtctgccacctcacgccctccgtgccatcacgtcggctaccgggngtgaggtntgagtctagtattactcgtcgacctacgtccaagtcgacgacgcgacgtcgttagttcggttcgtcgtcggttcgggtaccggggacgggttaacgggaaccgaacggtccg

SEQ ID NO: 300709 - DNA, 545 bp, Homo sapiens
  misc_feature: GZ8MTXP01DQFJT.51.75.G09.1.454.CMB.2.raw
  modified_base (227)..(227): a, c, t, g, unknown or other
  misc_feature (227)..(227): n is a, c, g, or t
  modified_base (326)..(326): a, c, t, g, unknown or other
  misc_feature (326)..(326): n is a, c, g, or t
  modified_base (460)..(460): a, c, t, g, unknown or other
  misc_feature (460)..(460): n is a, c, g, or t
  modified_base (513)..(513): a, c, t, g, unknown or other
  misc_feature (513)..(513): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggancagctccaacagtcgggggcaaggtaaatgattgtaacacgtggtaccagcaagccttaccaaggaaaccacgtacccccaaactcctactaatttacngacctaaacaccaaactccccggccctcgacggggtcccctgaccccgtatttcctcgtcgggcctccgagggtctcgggaccaccctcacgtccctcccgtggccctatccacgtgggcctccgggctagagngtgaggtctagtattatactgacctacgtcccatcgacaagcagcttgagtgngcttggtcggcgaaggaccagctcgccgtccg

SEQ ID NO: 300710 - DNA, 609 bp, Homo sapiens
  misc_feature: GZ8MTXP01C3WSZ.51.75.G09.1.454.CMB.2.raw
  modified_base (230)..(230): a, c, t, g, unknown or other
  misc_feature (230)..(230): n is a, c, g, or t
  modified_base (318)..(318): a, c, t, g, unknown or other
  misc_feature (318)..(318): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcagcccgccctcagtgtctcggggccccagggcagagggtcaccatctcctgcacgtgggancagctaccaacagtcggggcaggtaatgatgtaacacgtggtaccagcagcttccaaggaacacgtaccccaaactcctactatttangactaaacaccaacgtccccggccctacgacggggtcccctcggaccccgtatttcctcgtcgggccttcccgaggtcctacggcctacccttcacgtccctaccctcggaccattccgacgtcgggccgttccgggctacggagggtagtacgggaggtcttaggtactttaagttccgtcgaccctacgtcccagtcgaacaacgcaggtccttggtagtcgttacggttcgttcggttccggggacgggaaccgggaaccaggttccgtcggttaacccgttaacccg

SEQ ID NO: 300711 - DNA, 690 bp, Homo sapiens
  misc_feature: GZ8MTXP01B7GH2.51.75.G09.1.454.CMB.2.raw
  modified_base (184)..(184): a, c, t, g, unknown or other
  misc_feature (184)..(184): n is a, c, g, or t
  modified_base (219)..(219): a, c, t, g, unknown or other
  misc_feature (219)..(219): n is a, c, g, or t
  modified_base (237)..(237): a, c, t, g, unknown or other
  misc_feature (237)..(237): n is a, c, g, or t
  modified_base (249)..(249): a, c, t, g, unknown or other
  misc_feature (249)..(249): n is a, c, g, or t
  modified_base (332)..(332): a, c, t, g, unknown or other
  misc_feature (332)..(332): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcccagtctgtgctgacgcacgccgccctnagtgtcgtcggggccccagggcaggaggtccaccntctcctgcacgtggggancagctaccaacngtcggggcaaggtaatgatgtacacgtggtaccagcagtcttaccgaaggaaccacgtacccccaaacttcctactatttacncgacctaaccacctaagtcccggcccctcggaaccggggttcccctcggtaccccgttatttcccgtcgtcgggtcctccgtacggttcctcggacctacccgtccgaccggtccccttccccggtcggccctacgtccgtaccggtcggggtcccgttcccgggggtcgttggggaacgggtacgttcgggaacgggtccgttaggttaacttttaacgttaccgtccgtacccgtaaccggttccccaagttcggaacgacgttaccgacggtcccgttaggttcggttcgggtcggttccggttcggggtttccggggaccgggggttaacgggtaacccgttaaacggtcccgg

SEQ ID NO: 300712 - DNA, 674 bp, Homo sapiens
  misc_feature: GZ8MTXP01AUX6V.51.75.G09.1.454.CMB.2.raw
  modified_base (228)..(228): a, c, t, g, unknown or other
  misc_feature (228)..(228): n is a, c, g, or t
  modified_base (309)..(309): a, c, t, g, unknown or other
  misc_feature (309)..(309): n is a, c, g, or t
  modified_base (356)..(356): a, c, t, g, unknown or other
  misc_feature (356)..(356): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcacgtgggancagctccaacagtcggggcaggtaatgatgtacactggtaccagcagcttccaggaacacgtccccaaactcctcatttancgactaacacaactcccggcctcgacggggtccctgacccgtattcnctggcctccaggtcctggccacctcacgtccctcccgtggcccactccgacgtcggggcctcccggggctaggacggtaggttcgggaaggtccgttaggtaaactttacgttaaccgtcggtaccccgtaacggtccccctaaggttaccggaaccgtaacggtacccgaaacggggtccccgttagggtaaggtttcggggttcggttcccggttttacgggggtttccccgggggacccgggggttaaacggggggtaacccccaaaggggttccccgtttaacccggggttaacccccgggtttaacccccggg

SEQ ID NO: 300713 - DNA, 596 bp, Homo sapiens
  misc_feature: GZ8MTXP01DBMCX.51.75.G09.1.454.CMB.2.raw
  modified_base (233)..(233): a, c, t, g, unknown or other
  misc_feature (233)..(233): n is a, c, g, or t
  modified_base (322)..(322): a, c, t, g, unknown or other
  misc_feature (322)..(322): n is a, c, g, or t
  modified_base (544)..(544): a, c, t, g, unknown or other
  misc_feature (544)..(544): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcccagtctgtgctgacgcacgccgccctcagtgtcgtcggggccccagggcagaggtcacatctcctgcacgtgggancagctaccaacagcggggcaggtaatgatcgtacactggaaccagcagcctaccaaggaaccacgtacccccaaactcctatatttacncgactaaacccaccagtccggccctacgaacgggtccctgcccgtattcctcgtcggacctcgagggtctcggtccacctcgaccgtccctccgtcggcctaactccgaccgtcgggcccgtcccggggtgtacggggtacggatacgggacggtcttaggtaatttaacttccgtcgaccctacgtacccaagtacgaacgtacggcctaaggccttaggnggttcggtgtcggtcgggttacgggaccgggaacggtaaccgaacggtcccg

SEQ ID NO: 300714 - DNA, 578 bp, Homo sapiens
  misc_feature: GZ8MTXP01AVFGW.51.75.G09.1.454.CMB.2.raw
  modified_base (227)..(227): a, c, t, g, unknown or other
  misc_feature (227)..(227): n is a, c, g, or t
  modified_base (313)..(313): a, c, t, g, unknown or other
  misc_feature (313)..(313): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacaaggtcctgggcccagtctgtgctgacgcagccgccctcagtgtctggggccccagggcagaggtcaccatctcctgcacgtgggancagctccaacagtcggggcaggtaatgatgtacacgtggtaccagcagcttaccgaggaacacgtaccccaaactcctacatttangactaaacaccaatccccggccctcgacgggggtcccctcgaccccgtattcctcgtcgggtcctccgagggttcacgggcccacctcacgcccctccgtcggcccactccacgtcgggccgtccgggctggaggagtggaggtctagtattatacgtcgaccacgtcccatcgacgaacgcgacgtccttggtagttcggttgttccgttgggttccggggacgggaacgggaccaaggttcctaacggttaaccccgttcccg

SEQ ID NO: 300715 - DNA, 724 bp, Homo sapiens
  misc_feature: GZ8MTXP01AF57B.51.75.G09.1.454.CMB.2.raw
  modified_base (237)..(237): a, c, t, g, unknown or other
  misc_feature (237)..(237): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcccagtctgtgctgacgcacgcccgccctcagtgtcgtcggggccccagggcagaggtcaccatctcctgcacgtggggacncacgcctaccaacgacggcgggactaaggtaatgtatacgtacacgtacggaccagcacgtcctaccgaacgaacctaccgtaacccctaaactcctacttaactttactacgtaacctaaacccacctacgtcccggtcccgtaccggtaacccggggttcccctcggtacccgttacttcccgtccgtccgggtcccttaccggtacgggttcctaccggtaccctacccgtccgtacccgtccccgttaccccggtacggtaccctaccgtacccggaccgggttccggggtcccggttacccggggcggtaacggggtacgggtacgtacgggacggttcttagttaactttacgttaccgtcgtaccctaccgtaccctaagtacgaacctcggaccgtacggtcgttacggttcggttcggtcgggtccggtttaacggggtaccgggggaccgggttaacggtaaccgttaacggtcccg

SEQ ID NO: 300716 - DNA, 609 bp, Homo sapiens
  misc_feature: GZ8MTXP01DZ7I9.51.75.G09.1.454.CMB.2.raw
  modified_base (243)..(243): a, c, t, g, unknown or other
  misc_feature (243)..(243): n is a, c, g, or t
  modified_base (316)..(316): a, c, t, g, unknown or other
  misc_feature (316)..(316): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtcgtggggccccagggcagaggtcaccatctcctgcacgtgggagcagctccaacngcggggcaggtaatgatgtacactggtaccagcagcttaccaggaacacgtaccccaaactcctactatttancgactaaaccaccaagtccggaccctcgaaaccgggggttccctcggccccgtattcctcctgggcctcgacgtctacggcctaccgtcacgtccctccccgtcggcctactccgacgtcggggccgtcccggggtcgtgggaaggtacgttaggaacgggtcttacggtaatttacgttaccgtggtaccctacgttccccaagtcggacaacggcaacggtcccgttggagttccgggtgtccgttcggggttaccggggacgggttaacgggtaacccgaacggtcccgg

SEQ ID NO: 300717 - DNA, 596 bp, Homo sapiens
  misc_feature: GZ8MTXP01CAI7D.51.75.G09.1.454.CMB.2.raw
  modified_base (226)..(226): a, c, t, g, unknown or other
  misc_feature (226)..(226): n is a, c, g, or t
  modified_base (237)..(237): a, c, t, g, unknown or other
  misc_feature (237)..(237): n is a, c, g, or t
  modified_base (306)..(306): a, c, t, g, unknown or other
  misc_feature (306)..(306): n is a, c, g, or t
  modified_base (506)..(506): a, c, t, g, unknown or other
  misc_feature (506)..(506): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagaggtcaccatctcctgcactgggancagctccaacngtcggggcaggtaatgatgtacactggtaccagcagcttccaggacacgtccccaaactcctcatttangactaaacaccaactccccggccctcgacggggtcccctgccccgtattcctcgtcgggcctccgagggttcctgggccctacccgtcaccgtcccctcccgtcggcccacgtccgacgtcggggccttccggggctggacggtagtggacgggtccttagtactttacgttacgtcgtccctacgtcccaagtcgaacncggcacggtccttggtacggtgttcggttcgttcgggttccgggacgggaacgggaccctacgggttccgtaacggaaccccgtttcccg

SEQ ID NO: 300718 - DNA, 619 bp, Homo sapiens
  misc_feature: GZ8MTXP01A18UZ.51.75.G09.1.454.CMB.2.raw
  modified_base (328)..(328): a, c, t, g, unknown or other
  misc_feature (328)..(328): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcccagtctgtgctgacgcagcccgccctcagtgtctcggggccccagggcagaggtcaccatctcctgcactgggagcagctaccaacagtcggggcaggtaatgatgtacactggtaccagcagccttaccaaggaaccacgtaccccccaaaacttcctactaattttacncgtaccttaaaccaccctaaacgtcccgggacccctcggtaaaccgggggtcccctcggccccgtatttcctcgtcggtcctaccgtagggttccctggccctaccctcgaccggtcccctcccgtcggacccacgttccgaccgtcggggccgttccccgggggtctgggacgggtattcgggacggtccttaggtatttacgttacgtgaccctacggtcccaagtcgacagttccgagtccttaggcgttgtgtcgtgggttccgggcgggacggaaccgttgtcccg

SEQ ID NO: 300719 - DNA, 537 bp, Homo sapiens
  misc_feature: GZ8MTXP01DCAYD.51.75.G09.1.454.CMB.2.raw
  modified_base (227)..(227): a, c, t, g, unknown or other
  misc_feature (227)..(227): n is a, c, g, or t
  modified_base (310)..(310): a, c, t, g, unknown or other
  misc_feature (310)..(310): n is a, c, g, or t
  modified_base (443)..(443): a, c, t, g, unknown or other
  misc_feature (443)..(443): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggancagctccaacagtcgggcaggtaatgatgtacacgtggtaccagcagctccaggaacacgtaccccaaactcctataatttancgactaaacaccaactccccggccctcgacggggtcccctgacccgtattctctggcctccgaggtctgccacctcacgccctcctgccatcacgtgggctccgggctgaggagtgaggtctagattagtacncgacctcgtccagtcgacaacgcagtcgttgtacgtgttcgttcgttcgggtcggacgggaacggaccacgttccgtaaccgttcccgtaaccg

SEQ ID NO: 300720 - DNA, 711 bp, Homo sapiens
  misc_feature: GZ8MTXP01A4BM6.51.75.G09.1.454.CMB.2.raw
  modified_base (229)..(229): a, c, t, g, unknown or other
  misc_feature (229)..(229): n is a, c, g, or t
  modified_base (240)..(240): a, c, t, g, unknown or other
  misc_feature (240)..(240): n is a, c, g, or t
  modified_base (318)..(318): a, c, t, g, unknown or other
  misc_feature (318)..(318): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcagccgccctcagtgtcgtcggggccccagggcagaggtcaccatctcctgcacgtgggancagctccaacngtcggggcaggtaatgatcgacacgtggtaccagcagctaccgaaggaaccacgtaccccaaactcctactatttacncgacctaaacacctaacgtccccggacccctacggaccgggggtcccctcggtaccccgtatttccgtccgtcgggtcccttacccgagggttccgtcgggaccctaccctcgaccgtcccctcccgtcggccctacgtccgacggttccggggcccgttcccggggacgttacgggaacgggtacggttcggggtaacggtccgttaaggttaactttacgttaacccgtcggtaccccgtaacggtacccctaagttcggaaccgtaacgccgttacggtcccgttagggtaacggttcggttacggttccggtttacggggttcccggggacgggtaaccggggacccctaagggttcccgttaaccgggttaaccccggtttaacccgg

SEQ ID NO: 300721 - DNA, 679 bp, Homo sapiens
  misc_feature: GZ8MTXP01EN3C4.51.75.G09.1.454.CMB.2.raw
  modified_base (229)..(229): a, c, t, g, unknown or other
  misc_feature (229)..(229): n is a, c, g, or t
  modified_base (242)..(242): a, c, t, g, unknown or other
  misc_feature (242)..(242): n is a, c, g, or t
  modified_base (327)..(327): a, c, t, g, unknown or other
  misc_feature (327)..(327): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcagcccgccctcagtgtcgtcggggccccagggcagagggtcacatctctgcacgtgggancagcctacaacgngtcggggacaaggtaatgatgtacacgtcggtaccagcagccttaccgaaggaacctaccgtaccccaaacttcctactatttangacctaaacaccaactccccggccctacgacggggtcccctcgacccgtattcctcgtcggtacctccgtacggttcgtcggaccctacccgtcgaccgtccccgtccgtcgggaccctaacgtccgaccggttcggggacccgtccggggtactagggtaacgggtcggtacgggacggggttaccttaggtttaaactttacgttaacccgtcgtacccgtaacgtcccctaatcggaaaccgtcgaccgacgggtccttgggtcgttggttcggttccggtttggggtaacccgggggacggtaacggggacctaacggttccgttaaccgggttaaccccgttaaccg

SEQ ID NO: 300722 - DNA, 575 bp, Homo sapiens
  misc_feature: GZ8MTXP01ATTQY.51.75.G09.1.454.CMB.2.raw
  modified_base (227)..(227): a, c, t, g, unknown or other
  misc_feature (227)..(227): n is a, c, g, or t
  modified_base (309)..(309): a, c, t, g, unknown or other
  misc_feature (309)..(309): n is a, c, g, or t
  modified_base (344)..(344): a, c, t, g, unknown or other
  misc_feature (344)..(344): n is a, c, g, or t
  modified_base (485)..(485): a, c, t, g, unknown or other
  misc_feature (485)..(485): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggancagctccaacagtcggggcaggtaatgatgtacactggtaccagcagctccaggaacacgtaccccaaactcctacatttangactaacaccaactcccggccctcgacgggtcccngcccctattcctctgggcctccaggtctggccaccgtcacgtccctcccgtcggcccactccacgttcggggcctccgggctaggaggacgtggagggtcctaggtaatttacgttactcggccacgttccccaatcgacncggcacgtccgttggtagtggttcgttcgttcgggttccggggccgggggaaccaacggtccgttaccggtaacccgttcccgtaaccgg

SEQ ID NO: 300723 - DNA, 662 bp, Homo sapiens
  misc_feature: GZ8MTXP01B774H.51.75.G09.1.454.CMB.2.raw
  modified_base (232)..(232): a, c, t, g, unknown or other
  misc_feature (232)..(232): n is a, c, g, or t
  modified_base (319)..(319): a, c, t, g, unknown or other
  misc_feature (319)..(319): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcagcccgccctcagtgtcgtcggggccccagggcaggagggtcaccatctcctgcacgtgggancagctccaacagtcggggacaggtaatgatgtacactggtaccagcagcttaccaaggaacacgtaccccaaactcctactatttancgactaaacaccaacgtccccggaccctcgacggggtccctcgaccccgtatttccgcgtcgggccttccgtacggtcctcggaccaccctcaccgtccctcccgtggccctaacgtccgaccgtcggggccgttccggggctgggtaacggacggtgggaacggtccttaggttaactttaacgttaccgttcggaaccctacgttccccgaagtccggaacgtaacggcgttacggtcccgttgggtaacggtttggttccggttcggtttcggggttaaccggggacggggtaacggggaccccaagggttcccgttaacgggttaaccccgtttcccgg

SEQ ID NO: 300724 - DNA, 612 bp, Homo sapiens
  misc_feature: GZ8MTXP01CBHKQ.51.75.G09.1.454.CMB.2.raw
  modified_base (183)..(183): a, c, t, g, unknown or other
  misc_feature (183)..(183): n is a, c, g, or t
  modified_base (235)..(235): a, c, t, g, unknown or other
  misc_feature (235)..(235): n is a, c, g, or t
  modified_base (256)..(256): a, c, t, g, unknown or other
  misc_feature (256)..(256): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcccagtctgtgctgacgcacgccgcctnagtgtcgtcggggccccagggcaggaggtcaccatcctcctgcacgtgggancagcctaccaacagtcggganaggtaatgatcgacacgtggtaccagcagcctaccgaaggtaaccaccgtaccccaaactcctataatttatacgaactaaacccaccgtaactcccggtccctacggaaccggggttccctcggcccgtatttcctcgtacggcccttaccgagggttccctcggaccctaccgtcgaccgtcccctcccggtcgccctagtcccgacggttcgggccgtccgggcgtaggacggtagtcggaggtctaggtattacgttactcgacctacgccctaagcacgcgttcgacgtccgttggttacgttcgtcggtcgtttggggacgggacgggttaaggaaccccgaaggtcccg

SEQ ID NO: 300725 - DNA, 669 bp, Homo sapiens
  misc_feature: GZ8MTXP01D6UV3.51.75.G09.1.454.CMB.2.raw
  modified_base (228)..(228): a, c, t, g, unknown or other
  misc_feature (228)..(228): n is a, c, g, or t
  modified_base (321)..(321): a, c, t, g, unknown or other
  misc_feature (321)..(321): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcagcccgccctcagtgtctggggccccagggcagagggtcaccatctcctgcactgggancagcctccaacagtcggggcaaggtaatgatgtaacacgtggtaccagcagcttaccaaggaacacgtaccccaaacttcctactaattttanacgaacctaaaccacctaacgtcccccggaccccgtacggtaccggggtcccctacgtacccgttactttccgtcgtcggtccctaccgtacgggtccgtcggaccctacctaccgaccgtcccctcccgtacggaccctacgtccgtacggtcgggcccgtccgggcgtacggaggtacggtcgggacggtcttagtaactttaacgttaccgtacgtacccgtacgttaccctaagtcgaacgaacgcttacggtccgttaggtacgttcggttcggttccggttacggggtccgggacgggtaaccgggaaccgtacggttccgttaaccggaacccgttaaccg

SEQ ID NO: 300726 - DNA, 652 bp, Homo sapiens
  misc_feature: GZ8MTXP01DMVZQ.51.75.G09.1.454.CMB.2.raw
  modified_base (230)..(230): a, c, t, g, unknown or other
  misc_feature (230)..(230): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcagccgccctcagtgtcgtcggggccccagggcagagggtcaccatctcctgcacgtgggancagcctaccaacagtcggggacagggtaatgatgtacacgtggtaccagcagtcttaccgaggaaccacgtaccccaaactcctactaatttactacgacctaaaccacctaacgttcccccggcccctacggaccggggttcccctcggaccccgtattccgtcgtcgggcctcgtacggtctcgggcctaccctcgacgtccctcccgtcggaccctaacgtccgtacggttcggggcccgttcccggggcttagggacgggtacgtacgggtaacgggtcttaggttaactttaacgttccgtcgaccccgtacgttccccagtaccgaacaacgcgttacgtccgttggtacgtgttcggttcgttacggggttccgggacgggtaacggaaccgagccgtcgaacccgtttaacccg

SEQ ID NO: 300727 - DNA, 690 bp, Homo sapiens
  misc_feature: GZ8MTXP01D20ZO.51.75.G09.1.454.CMB.2.raw
  modified_base (184)..(184): a, c, t, g, unknown or other
  misc_feature (184)..(184): n is a, c, g, or t
  modified_base (235)..(235): a, c, t, g, unknown or other
  misc_feature (235)..(235): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcccagtctgtgctgacgcacgccgccctnagtcgtcgtcgggccccagggcagacggtccaccatctcctgcacgtggancacgcctaccaacgaggtcgggacaaggtaatgatcgaccacgtcggaccagaccagtccttaccgaaggaacctaccgtaccccctaaaacttcctattaatttacgactaacctaaaccccaacccgtaacgtcccggtaccccgttaccggtaaacccggggttccccctccggtaccccgttactttcccgtccgtccgggtccttacccggtacggtccgtacggaccctaacccgtcacccgtccccgttacccgtcggtaccctacgttaccgccggttcgggtacccgtccgggtcggttagggaacgggttatacgggaggtaccttagttactttaacgttaccgtcctacccgtaccggtcccaagttacgacgacgcgacgtccgttggttcgttcgttggtcgttcgggtacgggacgggttacgaacgttaacggtccccg

SEQ ID NO: 300728 - DNA, 615 bp, Homo sapiens
  misc_feature: GZ8MTXP01DRREM.51.75.G09.1.454.CMB.2.raw
  modified_base (230)..(230): a, c, t, g, unknown or other
  misc_feature (230)..(230): n is a, c, g, or t
  modified_base (327)..(327): a, c, t, g, unknown or other
  misc_feature (327)..(327): n is a, c, g, or t
  modified_base (459)..(459): a, c, t, g, unknown or other
  misc_feature (459)..(459): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcagcccgccctcagtgtcgtcggggccccagggcaggaggtcaccatctctgcacgtgggancagcctaccaacagtcggggacaggtaatgatgtacacgtcggtaccagcagtccttacgaaggaaccaccgtaccccaaacttcctactaatttanacgacctaaacacctaacgtccccgcccctagacgggtccctcgccctattccgcgtcgcctccgacggtcgtcggcccaccctcgaccgtcccctccgtcggccctacgtccgacgtcgggccgtccgggntaggacggtaggtggaagtctagtatttactaccgtcgaccctacgtaccctagtacggactaacgcgttacgtcccgttggtacgttgttcggttcgttcgggtccggggacggaacggaccgtaggttccgtaacggttaacccgttaacccgg

SEQ ID NO: 300729 - DNA, 657 bp, Homo sapiens
  misc_feature: GZ8MTXP01EC4Y2.51.75.G09.1.454.CMB.2.raw
  modified_base (229)..(229): a, c, t, g, unknown or other
  misc_feature (229)..(229): n is a, c, g, or t
  modified_base (324)..(324): a, c, t, g, unknown or other
  misc_feature (324)..(324): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcagccgccctcagtgtcgtcggggccccagggcagaggtcaccatctcctgcacgtgggancagcctaccaacagtcggggacaggtaatgatgtaacacgtggtaccagcagtcctaccgaaggaaccacgtaccccaaactcctactatttacncgacctaaacacctaacgtccccggccctacgacggggtccctcggaccccgtattccgtcgtcggtcctccgaggtctcgggccctaccctcgaccgtcccctcccgtcggccctaacgttcccgtaccggtcggggtcccgtcccgggggtacttagggaacgggtaggtacgggtacggtaccgttagtaacgtttaacttaccgttcggaccctaacggttcccaagttcgaaccgaacgccgacgtccgttaggtacgttggttcggttcgttcgggtccggggacgggaacggaccaggttccgtaaccggttaacccgttaacccg

SEQ ID NO: 300730 - DNA, 684 bp, Homo sapiens
  misc_feature: GZ8MTXP01EJZ3K.51.75.G09.1.454.CMB.2.raw
  modified_base (65)..(65): a, c, t, g, unknown or other
  misc_feature (65)..(65): n is a, c, g, or t
  modified_base (315)..(315): a, c, t, g, unknown or other
  misc_feature (315)..(315): n is a, c, g, or t
  modified_base (369)..(369): a, c, t, g, unknown or other
  misc_feature (369)..(369): n is a, c, g, or t
  modified_base (464)..(464): a, c, t, g, unknown or other
  misc_feature (464)..(464): n is a, c, g, or t
tcagcgatcgtatacacgaccggtgctcgatttagtatagacatcaggggcttcagctgtgggcncaagaggcagcactcaggacaatctccagcatggcctggtctcctctcctcctcactctcctcgctcactgcacagggtcctgggcccagtctgtgctgacgcacgcctccctcattgtcgtggccccgaggcaggtcggtcaccatcctccgtgcacgtgggacgcagccgtaccaactaggtcgggggacaaggtaatgtaagtgtacacgttcggtaaccgagacgacgtccttacaacgggtaacnccccgtaaccccaaaacccttcctttacaaattttacgtacgtactaaaccccncccgtaaccgtacccccggtaccccggtaccggtaccgggtccccgtccgtaacccgttaccgtttccgttccgtcgtaccgtccgtcggtcgtntccgtcctaccgccgtccccttccgtccgaccgtaccgtctcggtcggtccgggtccggtcggtacggtaggtacggtcggtacgttcgtacgtacgtttaacgttacgtaccgaccgtaccgtacctacgtacgaacgtaacgtacgacgtcgttggtcggtgttcgttcggttcgggtcgggcgggaaccggaacgacgttcgtccgttccgtaaccg

SEQ ID NO: 300731 - DNA, 583 bp, Homo sapiens
  misc_feature: GZ8MTXP01BDFCO.51.75.G09.1.454.CMB.2.raw
  modified_base (313)..(313): a, c, t, g, unknown or other
  misc_feature (313)..(313): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacagtcggggcaggtaatgatgtacactggtaccagcagcttaccgaggaaccacgtaccccaaactcctacatttancgactaaacacctaactccccggccctagacggggtccctgaccccgtattcctctcgggcctccgaggtcctgggccaccctcacgtccctcccgtggccctactccacgtcgggccgttccgggctgggacggagtcggagggtctggtaatttacttacgtcgaccctacgttccccagttcgacaacgccacggtccttggtacggtgttcgttcgttacgggtcgggcgggaacgggaccgtaacgccgtcggaacccgttcccg

SEQ ID NO: 300732 - DNA, 627 bp, Homo sapiens
  misc_feature: GZ8MTXP01B26JX.51.75.G09.1.454.CMB.2.raw
  modified_base (183)..(183): a, c, t, g, unknown or other
  misc_feature (183)..(183): n is a, c, g, or t
  modified_base (320)..(320): a, c, t, g, unknown or other
  misc_feature (320)..(320): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcccagtctgtgctgacgcagccgccctnagtgtcgtcgggccccagggcagaggtcacatctctgcacgtgggagcagctaccaacagtcggggacaggtaatgatgtacactggtaccagcagcttaccgaaggaacacgtacccccaaactcctactatttangactaaaccaccaaagtccgccctcgaacgggtccctcggccctattcctcgtcgtacctcgtacgtctcggcacctcgactccctcccgtcgaccctactccgacgtcgggccgttcccgggcgtcggtaagggactcggtaacggtccgttaggtaactttaacgttacgttccgacccgtacggttccccaagttaccgaaccgtacggccaacggtcccgttaggttccggttggttcgtccgggttttaacgggtcccgggggtaccggggaaccggggtaacccgttaacgggttccccgg

SEQ ID NO: 300733 - DNA, 561 bp, Homo sapiens
  misc_feature: GZ8MTXP01D3IQG.51.75.G09.1.454.CMB.2.raw
  modified_base (230)..(230): a, c, t, g, unknown or other
  misc_feature (230)..(230): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcagccgccctcagtgtcgtcggggccccagggcagagggtcaccatctcctgcacgtgggancagctaccaacagtcggggacaaggtaatgatgtaacacgtggtaccagcagccttaccgaaggaaccacgtaccccaaactcctactaatttacacgacctaaacaccaaactccccggaccctacgacggggtccctcgacccgtattcgtctcggccctccgaggtctcggaccctaccgtcaccgtccctcccgtcgaccctactcgacgtcgggccgtccgggctggacgtgtggacgtctagtacttactacgcgacccacgtccatcgaacaacgcagcttgagtgttgcgttggtcggcggaacggaccagcctcgccgtccg

SEQ ID NO: 300734 - DNA, 581 bp, Homo sapiens
  misc_feature: GZ8MTXP01A4CVQ.51.75.G09.1.454.CMB.2.raw
  modified_base (234)..(234): a, c, t, g, unknown or other
  misc_feature (234)..(234): n is a, c, g, or t
  modified_base (319)..(319): a, c, t, g, unknown or other
  misc_feature (319)..(319): n is a, c, g, or t
  modified_base (371)..(371): a, c, t, g, unknown or other
  misc_feature (371)..(371): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtcgtcggggccccagggcaggaggtcaccatctcctgcacgtgggancacgctccaacagcgggacaggtaatgatgtacagtggtaccagcagcttaccgaaggacacgtaccccaaactcctatatttancgactaacccacctaagtccgccctcgaacgggtccctcgacccgtattccncgtcggccttcgacggtctcgcacctcgacgtccctcccgtggccatccgacgttcgggccgtccggggctcgggaggatcggaggtctgtaactttacttacgtcgacccgtacgtccctaatcggaacctcgacgtacggtcgttggttcggttcggtcggtcggttaacggggtcgggacgggaaccggtaaccgttaacggtcccg

SEQ ID NO: 300735 - DNA, 649 bp, Homo sapiens
  misc_feature: GZ8MTXP01DX0PF.51.75.G09.1.454.CMB.2.raw
  modified_base (226)..(226): a, c, t, g, unknown or other
  misc_feature (226)..(226): n is a, c, g, or t
  modified_base (314)..(314): a, c, t, g, unknown or other
  misc_feature (314)..(314): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagaggtcacatctcctgcacgtgggancagctccaacagtcggggcaggtaatgatgtacacgtggtaccagcagtcttaccgaggaaccacgtaccccaaactcctatatttancgactaacaccaacgtccccggccctacggaccggggtccctcggtaccccgtatttccgtcgtcgggtccctccgtacgggttccgtcgggaccctacccgttccgaccggtccccttcccgtcggaccctaacgttcccgtaacggtcggggtcccgtccccgggggtattacgggaacggtagggttacgggaacggtccgttaggtaacttttaaccgttaccgtacggtacccctaccggttccccaagtccggaactaacggcacggtccgttagtacgtgttcgttcgttcggtcgggacggaacggaccagccgtcgaaccgttccg

SEQ ID NO: 300736 - DNA, 684 bp, Homo sapiens
  misc_feature: GZ8MTXP01D76H1.51.75.G09.1.454.CMB.2.raw
  modified_base (233)..(233): a, c, t, g, unknown or other
  misc_feature (233)..(233): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcacgcccgccctcagtcgtcgtcggggccccagggcagagggtcaccatctcctgcacgtgggancacgcctaccaacgagtcggggacaaggtaatgatgtaacacgtcggtaccagcacgtccttaccgaaggaacctacgtacccccaaactcctactaatttactacgacctaaacacctaacgtcccccggtacccctacggaccggggtcccctcggtaaccccgttacttccgtcgtcgggtccctcccgtagggttccgtcgggaccctacccgttcaccggtcccctcccgtcggaccctacgtccgacggttcggggcccgttcccggggcgtaggaggtacggtcggtacggtcttagttaactttacgtaccgtcgacctacgtccagtacgacgtaacgtcgttcggtcgttaggtcggttcgttcggttccggttcggggtaaccggggaaccggggtaacggaccgtacggttaccgttaacccggttaacccgttaaccg

SEQ ID NO: 300737 - DNA, 534 bp, Homo sapiens
  misc_feature: GZ8MTXP01DMC8S.51.75.G09.1.454.CMB.2.raw
  modified_base (230)..(230): a, c, t, g, unknown or other
  misc_feature (230)..(230): n is a, c, g, or t
  modified_base (316)..(316): a, c, t, g, unknown or other
  misc_feature (316)..(316): n is a, c, g, or t
  modified_base (426)..(426): a, c, t, g, unknown or other
  misc_feature (426)..(426): n is a, c, g, or t
  modified_base (476)..(476): a, c, t, g, unknown or other
  misc_feature (476)..(476): n is a, c, g, or t
  modified_base (491)..(491): a, c, t, g, unknown or other
  misc_feature (491)..(491): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagaggtcaccatctcctgcactgggancagctccaacagtcggggacaggtaatgatgtacactggtaccagcagcttaccgaggaacacgtcccccaaactcctatatttangacctaaaccaccaatccggccctacgaacgggtccctgcccgtattctctcggctcgagtctggccacctcacgccctcccgtggccatccacgtcgggcctcccgggngtggaggtatggaggctagtatttactacgtgacccagtcccaatcgacncgcaggtccttaggngttgtcgtgtcggttcgggacgggacgggaacccaaggtcccg

SEQ ID NO: 300738 - DNA, 612 bp, Homo sapiens
  misc_feature: GZ8MTXP01EWFHM.51.75.G09.1.454.CMB.2.raw
  modified_base (230)..(230): a, c, t, g, unknown or other
  misc_feature (230)..(230): n is a, c, g, or t
  modified_base (242)..(242): a, c, t, g, unknown or other
  misc_feature (242)..(242): n is a, c, g, or t
  modified_base (268)..(268): a, c, t, g, unknown or other
  misc_feature (268)..(268): n is a, c, g, or t
  modified_base (327)..(327): a, c, t, g, unknown or other
  misc_feature (327)..(327): n is a, c, g, or t
  modified_base (534)..(534): a, c, t, g, unknown or other
  misc_feature (534)..(534): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcagccgccctcagtgtcgtggggccccagggcaggagggtcaccatctcctgcacgtgggancagctccaaacngtcggggacaaggtaatgatgtaacncgtcggtaaccagcagtccttccgaaggaacacgtaccccaaactcctacgtattttancgactaaccgactaacgtccccggccctgacggggtccctcgacccgtattcgtcgtcggtcctccgaggttcctcggcccaccgttcaccggtccctcccgtcggaccctaactccgtaccggtcggggcccgttaccgggctaggacggtacggttcggaacggtccttaggtactttacttacgtcgcctacgtccatcgacgngcagtccgttagtacgtgttcgttcgttcgggtccgggacgggtaacggaccaggttccgtaacggttaacccgtccg

SEQ ID NO: 300739 - DNA, 627 bp, Homo sapiens
  misc_feature: GZ8MTXP01DQ6SU.51.75.G09.1.454.CMB.2.raw
  modified_base (234)..(234): a, c, t, g, unknown or other
  misc_feature (234)..(234): n is a, c, g, or t
  modified_base (244)..(244): a, c, t, g, unknown or other
  misc_feature (244)..(244): n is a, c, g, or t
  modified_base (315)..(315): a, c, t, g, unknown or other
  misc_feature (315)..(315): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcccagtctgtgctgacgcacgccgccctcagtgtcgtcggggccccagggcagaggtcaccatctcctgcacgtgggancagctccaangcgggcaggtatgatgtacagtggaccagcagcctaccaaggaacacgtaccccaaactcctactatttancgactaaacccacctaatcccggccctcgaaccggggtccctcgcccgtattccgtcgtcgctccgaggtctcggacctaccctaccgtaaccctcccgtcggaccctagtccgacgttcggggcccgttccggggccttagggggaacgggtatcgggaacggtcttacggttaactttacgttaccgtcggtacctaccgtcccgtagtaacgaacgacgccgaacggtccgtggacgttcggttcggtcggtttacggggtaaccggggaccgggaacggggaaccctaacggttcccgttaacccggg

SEQ ID NO: 300740 - DNA, 688 bp, Homo sapiens
  misc_feature: GZ8MTXP01CQRZJ.51.75.G09.1.454.CMB.2.raw
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcagcccgccctcagtgtcgtggggccccagggcaggagggtcaccatcctcctgcactgggagcagctaccaacagtcggggcaggtaatgatgtacacgtggtaccagcagcttccgaggaaccacgtacccccaaactccctactaatttactcgacctaaaccacccaaacgtcccccggccccctacgacgggggttccccctcggacccccgtatttccctcgtcgggccttccgacgggtctcgggcccaccctcacgtcccctcccgtcggcccatccgacgtcgggccgtccgggctggacggagtgggacggtcgttagtatttacgttaccgtcgtacccgtacgttccccagttccggaacgtaacggacgttaacgggtcccgttgggtaacggtttcggttcgggttccggtttcgggggtttccccgggggaaccgggggttaacgggggaaccccgtaaacgggttcccggttaacccgggttaacccccggttttaaccccggg

SEQ ID NO: 300741 - DNA, 678 bp, Homo sapiens
  misc_feature: GZ8MTXP01EKNMG.51.75.G09.1.454.CMB.2.raw
  modified_base (234)..(234): a, c, t, g, unknown or other
  misc_feature (234)..(234): n is a, c, g, or t
  modified_base (246)..(246): a, c, t, g, unknown or other
  misc_feature (246)..(246): n is a, c, g, or t
  modified_base (330)..(330): a, c, t, g, unknown or other
  misc_feature (330)..(330): n is a, c, g, or t
  modified_base (377)..(377): a, c, t, g, unknown or other
  misc_feature (377)..(377): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcccagtctgtgctgacgcacgccgccctcagtgtcgtcggggccccagggcagaggtcaccatctcctgcacgtgggancagcctccaacngtcggggacaggtaatgatgtacacgtggtaccagcaggtccttaccgaaggaaccacgtacccccaaacttcctactatttancgtacctaaaccaccaagtcccggcccctcggaaccggggttccccncggtcccgtacttccgtcgtcggtcctccgtacggtctcggaccctaccgtccgaccgtccccgttcccgtcggacccctaactcccgtaccggttccggggacccggttcccgggtccggggttagggaaggggtaacttcggggaacgggtccttaaggttaaaccttttaacgttccgtcggaccccgtaccggtacccctaagttaccgacgtacggacctacggtccgttaggttacggttggtcggtccgttcgggttacccggggacgggttaccgggaaccgaaggttccccg

SEQ ID NO: 300742 - DNA, 574 bp, Homo sapiens
  misc_feature: GZ8MTXP01EPAXV.51.75.G09.1.454.CMB.2.raw
  modified_base (229)..(229): a, c, t, g, unknown or other
  misc_feature (229)..(229): n is a, c, g, or t
  modified_base (319)..(319): a, c, t, g, unknown or other
  misc_feature (319)..(319): n is a, c, g, or t
  modified_base (479)..(479): a, c, t, g, unknown or other
  misc_feature (479)..(479): n is a, c, g, or t
  modified_base (547)..(547): a, c, t, g, unknown or other
  misc_feature (547)..(547): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcagccgccctcagtgtcgtcggggccccagggcagagggtcaccatctcctgcactgggancagctaccaacagtcgggcaggtaatgatgtaacacgtggtaccagcagcttccgaaggaacacgtaccccaaactcctactaattttanacgaccttaaacaccaacgttccccggacccctacggaccggggttcccctacgaccccgtacttccgtcgtcggtccctacccgtagggtcctcgggccctaaccctcacgtccctcctggccctatccgacgtcgggccttccgggctagacggtagngtaaggctaggattactactgacccagtcccaagtgacaaggcagccttagcgtgttgcttggtcggnggaacgggacaggctcgcccgtaaccg

SEQ ID NO: 300743 - DNA, 730 bp, Homo sapiens
  misc_feature: GZ8MTXP01DK3ES.51.75.G09.1.454.CMB.2.raw
  modified_base (284)..(284): a, c, t, g, unknown or other
  misc_feature (284)..(284): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcagtccgccctcagtgtcgtcggggccccagggcaggaggtcaccatctctgcacgtgggagcagcctaccaacgagtcggggacaagggtaatgatgtaacacgtcggtaacccngccagccttaccgaaggaacctaccgtaccccaaaactcctactaattttacgcgacctaaacacctaacgtcccccggacccctcggacggggttcccctacggaccccgttatttcccgtcgtcgggtcctaccgtagggttcctcgggaccctaccctcgaccgtccccgtcccgtcggccctaacgtccgtacggttccggggcccgttcccggggtactacggggaacggtacgggttacggggaacggggtaccttaggttaacgtttaaccgtttaccgtacggtaccccgtaccgttaccccgaagttacggaaccgtaacggtaccacgggtcccttagggtaacgttcggttacgggttccgtttacggggtccggggaccggggtaacgggtaaccctaacggttccgttaacccggttaacccgtttaacccgg

SEQ ID NO: 300744 - DNA, 588 bp, Homo sapiens
  misc_feature: GZ8MTXP01EY2LD.51.75.G09.1.454.CMB.2.raw
  modified_base (228)..(228): a, c, t, g, unknown or other
  misc_feature (228)..(228): n is a, c, g, or t
  modified_base (237)..(237): a, c, t, g, unknown or other
  misc_feature (237)..(237): n is a, c, g, or t
  modified_base (311)..(311): a, c, t, g, unknown or other
  misc_feature (311)..(311): n is a, c, g, or t
  modified_base (354)..(354): a, c, t, g, unknown or other
  misc_feature (354)..(354): n is a, c, g, or t
  modified_base (445)..(445): a, c, t, g, unknown or other
  misc_feature (445)..(445): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcacgtgggancagctcaangtcgggcaggaatgatgacacgtggtaccagcagcttaccaggaaccacgtaccccaaactcctactaatttanacgactaaacacctaacgtccccggccctacgacggggtcccncggacccgtattcctcgtcggcctcgaggtcctggccacctcacggtcccctccgtcggccctactcgtaccgtcggggccgtcccgggtntacggagggacgtggtaacggtctaggtaactttacgtacgtcggtaccgtacgtccctagtacgcaaggcacgcgttaggacggtgttacgttcgttacgggtcgggacggtaacggactaggcctaacgttcccgtaaccg

SEQ ID NO: 300745 - DNA, 568 bp, Homo sapiens
  misc_feature: GZ8MTXP01BKKUQ.51.75.G09.1.454.CMB.2.raw
  modified_base (232)..(232): a, c, t, g, unknown or other
  misc_feature (232)..(232): n is a, c, g, or t
  modified_base (311)..(311): a, c, t, g, unknown or other
  misc_feature (311)..(311): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcccagtctgtgctgacgcagcccgccctcagtgtcgtggggccccagggcagaggtcacatctcctgcacgtgggancagctcaacagcgggcaggtaatgatgtacactgtaccagcagcttccaaggacacgtaccccaaatcctactatttancgacctaacccaccaatccgcccctcgaacggggtccctgcccgtattcctcgtcggcctcgacgtctcggccacctcaccgcctccctcggacctctccgacgttgggccgttcccggggcgtaggaggtacgtcggtacgtcgttagtaactttacgtacgtccgtaccctacgtacccaagtacgacgagcgacggtccttaggttcgttcgtcgtcggtcgggtcgggacgggaacggtaaccgttaacgtcg

SEQ ID NO: 300746 - DNA, 587 bp, Homo sapiens
  misc_feature: GZ8MTXP01D742B.51.75.G09.1.454.CMB.2.raw
  modified_base (184)..(184): a, c, t, g, unknown or other
  misc_feature (184)..(184): n is a, c, g, or t
  modified_base (230)..(230): a, c, t, g, unknown or other
  misc_feature (230)..(230): n is a, c, g, or t
  modified_base (242)..(242): a, c, t, g, unknown or other
  misc_feature (242)..(242): n is a, c, g, or t
  modified_base (257)..(257): a, c, t, g, unknown or other
  misc_feature (257)..(257): n is a, c, g, or t
  modified_base (320)..(320): a, c, t, g, unknown or other
  misc_feature (320)..(320): n is a, c, g, or t
  modified_base (436)..(436): a, c, t, g, unknown or other
  misc_feature (436)..(436): n is a, c, g, or t
  modified_base (466)..(466): a, c, t, g, unknown or other
  misc_feature (466)..(466): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcccagtctgtgctgacgcacgccgccctnagtgtcgtcgggcccagggcagaggtcacatctctgcacgtgggancagctaccaaangtcgggacaggtaangatgtacacgtggtaccagcagtcctacgaaggaaccacgtaccccaaactcctataatttancgaccttaaacccaccgtaacgtcccggaccctcggaaacccggggttccctcggacccgtactttccgccgtcggctcgtacggtcctggcctaccgtcctacgcccttacccgngccctagtccacgtcgggaccgttccgggngtaggagtcgaggagtctagttacttactcgtcgtacctacgtccaagtcgactacgcgacgtcgttaggttcgttcggtcgtcggtcgggtccgggacgggacggtaaccgttcggtccg

SEQ ID NO: 300747 - DNA, 624 bp, Homo sapiens
  misc_feature: GZ8MTXP01AXLB3.51.75.G09.1.454.CMB.2.raw
  modified_base (236)..(236): a, c, t, g, unknown or other
  misc_feature (236)..(236): n is a, c, g, or t
  modified_base (246)..(246): a, c, t, g, unknown or other
  misc_feature (246)..(246): n is a, c, g, or t
  modified_base (269)..(269): a, c, t, g, unknown or other
  misc_feature (269)..(269): n is a, c, g, or t
  modified_base (320)..(320): a, c, t, g, unknown or other
  misc_feature (320)..(320): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtcgtcggggccccagggcaggaggtccaccatctcctgcacgtgggacncagctcaacngtcgggacaggtaatgatgtacnctggaccagcagctacgaaggaacacgtaccccaaactcctactatttacngacctaaaccacctaacgtccggccctacggaaccgggttccctcgcccgtattccgtcgtcgggtcctacgacggttctcggaccctaaccctcgaccgtccccttacccgtcggaccctactccgacggttcgggccgttcccggggcgtcgggtaggtacgtcgggaacgtcgttacggttaactttacgtaaccttcgaccctacgttcccaagtcgaccgaacggcgtaacgtcccgttaggttacgttggtaacgtcgttaacggtcggggacgggaacggaaccgttaacgtcccgg

SEQ ID NO: 300748 - DNA, 648 bp, Homo sapiens
  misc_feature: GZ8MTXP01AWETB.51.75.G09.1.454.CMB.2.raw
  modified_base (230)..(230): a, c, t, g, unknown or other
  misc_feature (230)..(230): n is a, c, g, or t
  modified_base (327)..(327): a, c, t, g, unknown or other
  misc_feature (327)..(327): n is a, c, g, or t
  modified_base (368)..(368): a, c, t, g, unknown or other
  misc_feature (368)..(368): n is a, c, g, or t
  modified_base (381)..(381): a, c, t, g, unknown or other
  misc_feature (381)..(381): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcacgccgccctcagtgtcgtcggggccccagggcaggaggtcacatctcctgcacgtgggancacgctaccaacgagtcgggacaaggtaatgatcgtacacgtacggaccagcacgtctaccgaagaaccacgtaccccaaacttcctactatttacnacctaaacaccgtaactccccggccctcgaccggggtcccncgacccgtcttcnccgtgcctcgacggtctcgacctaccgtcaccgtccctccgtcgaccctactccgtacgtccgggccggtccgggcgtacggtacgggtaggtcggtacggtcgttacggttaactttacgttaccgtcgtaaccccgtacgtacccctaagtccgaacgcggtaccgacgtccgttaggtacggttcggttcggttcgttacgggttccggggacgggtaacgggaaccgtacggttccgttaaccggttaaccccgttaacccgg

SEQ ID NO: 300749 - DNA, 601 bp, Homo sapiens
  misc_feature: GZ8MTXP01DUNFH.51.75.G09.1.454.CMB.2.raw
  modified_base (235)..(235): a, c, t, g, unknown or other
  misc_feature (235)..(235): n is a, c, g, or t
  modified_base (328)..(328): a, c, t, g, unknown or other
  misc_feature (328)..(328): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcccagtctgtgctgacgcacgcccgcctcagtcgtcgtcggggccccagggcaggaggtcaccatctctgcacgtgggancagctaccaacagtcggggacaaggtaatgatgtacacgtggaccagcagccttacgaaggaaccacgtaccccaaactcctactaatttacncgtaacctaaacccaacctaacgtcccggaccctacggaaccgggtccctcggcccgtattcctcgtcggcctacgacggtctcgcctacctcaccgtccctcccgtacggccctacgtccgacgtcgggtaccgttcccggggcggtaggacggtagtacgggacgtctagttactttaacgtcgtccgaccctacgtccaagtcgacgacgcgtacgtcgttgttcgttcggtcgtcgtcgggtcgggacggacggtaaccgaacggtccg

SEQ ID NO: 300750 - DNA, 590 bp, Homo sapiens
  misc_feature: GZ8MTXP01BHHXF.51.75.G09.1.454.CMB.2.raw
  modified_base (231)..(231): a, c, t, g, unknown or other
  misc_feature (231)..(231): n is a, c, g, or t
  modified_base (319)..(319): a, c, t, g, unknown or other
  misc_feature (319)..(319): n is a, c, g, or t
  modified_base (455)..(455): a, c, t, g, unknown or other
  misc_feature (455)..(455): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcagcccgccctcagtgtcgtcggggccccagggcaggaggtcaccatctcctgcacgtgggancagctaccaacagtcggggacaggtaatgatgtacacgtggtaccagcagctaccaggaccacgtaccccaaactcctactaatttancgacctaaacacctaacgtcccccggccctacgaccggggtccctcgaccccgtattcctcgtcggcctccgaggtcctcggccctaccctcacgtccctcccgtcggccactccgtacgtcgggccgtcccgggntacgggaggtacgtggtacggtctagtactttactacgtcgcctagtcccatcgacaacgtcacgtccttaggtacgtgttcgttcgttcgggtcgggaccgggaacggaccgtagccgtcgttaacccgttccg

SEQ ID NO: 300751 - DNA, 656 bp, Homo sapiens
  misc_feature: GZ8MTXP01BQ8IA.51.75.G09.1.454.CMB.2.raw
  modified_base (228)..(228): a, c, t, g, unknown or other
  misc_feature (228)..(228): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcagcccgcctcagtgtcgtcggggccccagggcagaggtcaccatctctgcacgtgggancacgctaccaacgacgtcggggacaaggtaatgatgtacacgtcggtaaccagtcacgtctaccgaaggaaacaccgtaccccaaacttcctacgtaattttacacgaccttaaaccaccgtaacgtcccccggtcccctacgacgggggtcccctcggtaccccgtatttccgtccgtcgggacccttaccgtagggtcctacgggacccctacctccgaccgtccccgtacccgtggccctaacgtccgtacggtcgggtacccgccggggtctagggaacggaggtacggtacggggtccttaggtaatttacgttaccgtcgacccgtacgtaccctagtccgaacgaacgcgacgtcttggtagtcgttacgttcgttcgggtccgggacggtaacggaccgtagccgtcgttcccgtaaccg

SEQ ID NO: 300752 - DNA, 711 bp, Homo sapiens
  misc_feature: GZ8MTXP01ANIH4.51.75.G09.1.454.CMB.2.raw
  modified_base (247)..(247): a, c, t, g, unknown or other
  misc_feature (247)..(247): n is a, c, g, or t
  modified_base (282)..(282): a, c, t, g, unknown or other
  misc_feature (282)..(282): n is a, c, g, or t
  modified_base (326)..(326): a, c, t, g, unknown or other
  misc_feature (326)..(326): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtcgtcggggccccagggcaggaggtcaccatctcctgcacgtgggagcagcctaccaacngtcggggacaggtaatgatcgtacactggtaaccngcagcttaccgaaggaccacgtaccccaaactcctatatttacncgactaaacccaccaacgtccggacccctcgaaccgggggttcccctcggaccccgtatttcctcgtcggtccctaccgtaggtccttacgggaccctaccctacgaccgtccccttaccccgtcgggtacccaacgttcccgaccgtccggggtacccgttccccgggggtacgtacggggtaacggggtacgtacgggtaacggtcgtttacggttaaacttttaacgttaccgtccggtacccctaaccggtcccctaacgttacggaaccgacggttaccgaaccggtcccgttagggttcggtttcgggtccggttcggttcgggggtttacccgggggacggggttaaccggggtaacccgttaacgggtaaccccggg

SEQ ID NO: 300753 - DNA, 681 bp, Homo sapiens
  misc_feature: GZ8MTXP01ES9HY.51.75.G09.1.454.CMB.2.raw
  modified_base (185)..(185): a, c, t, g, unknown or other
  misc_feature (185)..(185): n is a, c, g, or t
  modified_base (238)..(238): a, c, t, g, unknown or other
  misc_feature (238)..(238): n is a, c, g, or t
  modified_base (253)..(253): a, c, t, g, unknown or other
  misc_feature (253)..(253): n is a, c, g, or t
  modified_base (345)..(345): a, c, t, g, unknown or other
  misc_feature (345)..(345): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcccagtctgtgctgacgcacgcccgccctnagtcgtcgtcggggccccagggcaggaggtcaccatctcctgcacgtgggacncacgcctaccaaacnggtcggggacaaggtaatgaatcgtacacgtggtaaccagcacggtctaccgaaaggaaccacgtaacccccaaacttcctactaatttacncgaacctaaaccccacctaacgtcccggtaccctaccggaacccggggttcccctcggtaccccgttactttcccgtccggtccggtcccgtacccgtacgggttcctccgggaccctaccccgtcgacccgtccccgttaccccgtggacccctacgtccgacggtccggggacctccgggggctacgggtaggtacgtcggaacggtcttagtaactttactacgtccgacctacggtccaagtccgaacgtacgccgtagtccgttggttcgttcggtcggtccggtttcggggaccggggacgggttacccgggtaaccgaacggttcccgg

SEQ ID NO: 300754 - DNA, 618 bp, Homo sapiens
  misc_feature: GZ8MTXP01AP78T.51.75.G09.1.454.CMB.2.raw
  modified_base (229)..(229): a, c, t, g, unknown or other
  misc_feature (229)..(229): n is a, c, g, or t
  modified_base (317)..(317): a, c, t, g, unknown or other
  misc_feature (317)..(317): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcagccgccctcagtgtcgtggggccccagggcagagggtcaccatctcctgcacgtgggancagcctaccaacagtcggggcaggaatgatgtacacgtggtaccagcagtcttaccgaaggaacacgtaccccaaatcctatatttancgactaacaccaacgtccccggccctcgacggggtcccctggaccccgtattcctcgtcggcctccgaggttctggacccaccttcaccggtccctcccgtggccctagtccgtacgtcggggcctccggggctaggacggagtggacggtctagtacttacgtacgcgtacctacgtcccaagttcgaccgaacgcgaacggtccgttggtacgttcggttcggttccggttacggggttccgggacggggtaaaccgggtacccgaacggttcccgtaaccgggttaaccccgttccgg

SEQ ID NO: 300755 - DNA, 712 bp, Homo sapiens
  misc_feature: GZ8MTXP01COJJA.51.75.G09.1.454.CMB.2.raw
  modified_base (229)..(229): a, c, t, g, unknown or other
  misc_feature (229)..(229): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcagcccgccctcagtgtcgtcggggccccagggcagaggtcaccatctctgcacgtgggancagcctaccaacagtcgggggactaaggtaatgaatgtaacacgtcggtacccaggcagccgttaccaacggaacctaccgtaccccctaaactcctactaactttagtacaacctaaacaccgtaacgtcccccccgggacccctacggtacccgggggtcccctaccggtccccgttaactttccgtcgtcgggcccttaccggacggtccgtcggaccctacccgtcgtaccgtccccgtacccgtcggcccaacgtccgtaccggtcggggcccggttccgggcgttagggacgggtagttacggggacggttaccttacggtaattttaccgtaaccgttcggaacccctacggttaccccagttccgaaccgtaacgtccgaggtcccgttgggtacggttgttccgggacgtttcgggggtaaccgggacggggtaacggaacccgacgttccggttaaccggttaacccgttccg

SEQ ID NO: 300756 - DNA, 591 bp, Homo sapiens
  misc_feature: GZ8MTXP01D44U1.51.75.G09.1.454.CMB.2.raw
  modified_base (234)..(234): a, c, t, g, unknown or other
  misc_feature (234)..(234): n is a, c, g, or t
  modified_base (245)..(245): a, c, t, g, unknown or other
  misc_feature (245)..(245): n is a, c, g, or t
  modified_base (322)..(322): a, c, t, g, unknown or other
  misc_feature (322)..(322): n is a, c, g, or t
  modified_base (449)..(449): a, c, t, g, unknown or other
  misc_feature (449)..(449): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtcgtggggccccagggcagacgggtcaccatctcctgcacgtgggancagctccaacngtcggggcaaggtaatgatgtacacgtggtaccagcagtctaccaaggaaccacgtacccccaaatcctatatttangacctaacccaccaatcccggccctcgaaccgggttccctcgcccgtattcctcgtcggcctacgtacggtctggcctacctcaccgtccctcccgtgccactccgacgtcgggccgttcccggggngtaggaggtagtacggacgtcgtagttactttacgttccgtccgacctacgtccctaagtacgacgtacgcgtacgtcgttaggttcggttcggtcgtcggttcggggtccgggacgggttaccgggtaaccgaacggtccg

SEQ ID NO: 300757 - DNA, 667 bp, Homo sapiens
  misc_feature: GZ8MTXP01D5NHL.51.75.G09.1.454.CMB.2.raw
  modified_base (184)..(184): a, c, t, g, unknown or other
  misc_feature (184)..(184): n is a, c, g, or t
  modified_base (237)..(237): a, c, t, g, unknown or other
  misc_feature (237)..(237): n is a, c, g, or t
  modified_base (248)..(248): a, c, t, g, unknown or other
  misc_feature (248)..(248): n is a, c, g, or t
  modified_base (270)..(270): a, c, t, g, unknown or other
  misc_feature (270)..(270): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcccagtctgtgctgacgcacgccgccctnagtcgtcgtcggggccccagggcaggacggtcacatctcctgcacgtgggacncagctacaacngtcgggacaggtatgatgtacncgtagaccaggacagtccttacgaaggaacctacgtacccccaaattcctattaacgtttacacgtaccttaaacccacccgtaaacgtcccggtacccctacgggtaaccggggttcccctcggtacccgtctttcccgtcggtccggtccgtacccggtacgggttcccgtacgggtacccctacccgttaccgaccccgtccccgtttaccccggccggtaccctaacgttaccgacccgttcgggggacccgtttccggggcggttaggaacgggtagttacggacggtcttaggtaactttaacggtcctacgaccgtacctccaatcgaacgtcgacgtcgtcgttggttacgttgtcgtgtcggtcgggacgggacgaacgaaggtcccg

SEQ ID NO: 300758 - DNA, 540 bp, Homo sapiens
  misc_feature: GZ8MTXP01AEGES.51.75.G09.1.454.CMB.2.raw
  modified_base (313)..(313): a, c, t, g, unknown or other
  misc_feature (313)..(313): n is a, c, g, or t
  modified_base (436)..(436): a, c, t, g, unknown or other
  misc_feature (436)..(436): n is a, c, g, or t
  modified_base (451)..(451): a, c, t, g, unknown or other
  misc_feature (451)..(451): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcacgtgggagcagctccaacagtcggggcaggtaatgatgtacactggtaccagcagcttaccaggaacacgtacccccaaactcctacatttancgacctaaacaccaactccccggaccctcgacggggtcccctgaccccgtattcctcgtcgggcctccgaggtctcggcctacctcacgccctcccgtggccatcacgtcggctcggctgagngtggagtctgtattntacgcgccacgtcccagtcgacaagcagccttggtacgtgttgttcgttggttccgggcggaacgggacaggctaacggccgtaacccg

SEQ ID NO: 300759 - DNA, 562 bp, Homo sapiens
  misc_feature: GZ8MTXP01AMKCO.51.75.G09.1.454.CMB.2.raw
  modified_base (230)..(230): a, c, t, g, unknown or other
  misc_feature (230)..(230): n is a, c, g, or t
  modified_base (241)..(241): a, c, t, g, unknown or other
  misc_feature (241)..(241): n is a, c, g, or t
  modified_base (254)..(254): a, c, t, g, unknown or other
  misc_feature (254)..(254): n is a, c, g, or t
  modified_base (270)..(270): a, c, t, g, unknown or other
  misc_feature (270)..(270): n is a, c, g, or t
  modified_base (309)..(309): a, c, t, g, unknown or other
  misc_feature (309)..(309): n is a, c, g, or t
  modified_base (346)..(346): a, c, t, g, unknown or other
  misc_feature (346)..(346): n is a, c, g, or t
  modified_base (364)..(364): a, c, t, g, unknown or other
  misc_feature (364)..(364): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcccagtctgtgctgacgcagccgcctcagtgtctggggcccagggcagaggtcaccatctcctgcactggggacncacgcacacgngcgggacaggtangatgtacacgtcgacngcacgtctacgaacgaccacgtacccaactctatattanacactaaccacacgtccgcctcgacggtcctcgcctntctcgtcgtctcgcgtcncgccaccgtcgaccgtccctccgtcgcctacgtccgtacgtcgggtaccgtccgggacgtacggacggtcgtacggtacgtcgttagttaacgtttacgtaccgtccgacccgtaccgtacctaacgtcgacgcgcgtacgtcggttgttcgttcgtcgtcggtcgggtacgggacgggttacggtaaccgcggtccg

SEQ ID NO: 300760 - DNA, 683 bp, Homo sapiens
  misc_feature: GZ8MTXP01D610Q.51.75.G09.1.454.CMB.2.raw
  modified_base (183)..(183): a, c, t, g, unknown or other
  misc_feature (183)..(183): n is a, c, g, or t
  modified_base (229)..(229): a, c, t, g, unknown or other
  misc_feature (229)..(229): n is a, c, g, or t
  modified_base (238)..(238): a, c, t, g, unknown or other
  misc_feature (238)..(238): n is a, c, g, or t
  modified_base (251)..(251): a, c, t, g, unknown or other
  misc_feature (251)..(251): n is a, c, g, or t
  modified_base (315)..(315): a, c, t, g, unknown or other
  misc_feature (315)..(315): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcccagtctgtgctgacgcagccgccctnagtgtcgtgggccccagggcagaggtcaccatctcctgcatgggancagctcaangtcgggcaggtangatgtacacgtggtacagcagccttaccgaaggaaccacgtacccccaaactcctactatttancgtacctaaaccacctaagtcccggcccctcggaaccggggttccctgggcccctaatttccctcgtcgggtccttccgacgggttcctcggacctaaccctcgaccgtccccgttccccgtcgggaccctaacgttccgaacccgggtcggggtacccgttcccgggggtcgtacggggtaaaggggtcgttacggggaacggtcccgttaggtaaacttttaacggttacctccggtacccgtacgttaccccggaaattcccgggaaacgtaacgggcctaaacggtcccgttagggttcggttggtccggttacggttcgggtttccggggacggggaccggggaacccgttaaggttccccgg

SEQ ID NO: 300761 - DNA, 688 bp, Homo sapiens
  misc_feature: GZ8MTXP01ETPVE.51.75.G09.1.454.CMB.2.raw
  modified_base (236)..(236): a, c, t, g, unknown or other
  misc_feature (236)..(236): n is a, c, g, or t
  modified_base (251)..(251): a, c, t, g, unknown or other
  misc_feature (251)..(251): n is a, c, g, or t
  modified_base (346)..(346): a, c, t, g, unknown or other
  misc_feature (346)..(346): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcacagtctgtgctgacgcagcccgcctcagtgtcgtcggggccccgagggcaggacggtcaccatctcctgcacgtgggancacgcctaccaacgngtcggggactagggtaatgagtcgtaacacgtacggtaccagcagtccttaccgaaggaaaccaccgtaccccctaaacttcctactaatttacncgtaacccctaaaccacctaacgtcccggtcccctacgggtaccggggttcccctacggaccccgtatttccgtcgtcgggtccttacccggaggttccgccggtaccctaccgtccgaacccgtccccgttccccgtacggaccctaactccgaccggttcgggggacccgtcccgggggtatacggggaggtacgcggtacgtcgttaagttaacgtttacttaccgcgtacccgtaccgttaaccgaacgttcgacgacgtccgaacggttccgttggttacggtggtacgtccggtttaggggtacccgggacgggtaaccggttaaccgtaaccggg

SEQ ID NO: 300762 - DNA, 732 bp, Homo sapiens
  misc_feature: GZ8MTXP01BE3FK.51.75.G09.1.454.CMB.2.raw
  modified_base (216)..(216): a, c, t, g, unknown or other
  misc_feature (216)..(216): n is a, c, g, or t
  modified_base (232)..(232): a, c, t, g, unknown or other
  misc_feature (232)..(232): n is a, c, g, or t
  modified_base (275)..(275): a, c, t, g, unknown or other
  misc_feature (275)..(275): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcccagtctgtgctgacgcacgccgcctcagtgtcgtcggggcccagggcaggacggtcacntctctgcacgtgggancagctaccaacagtcgggacaggtaatgatgtacactggaccngcagtctacgaagaacacgtaccccaaatcctactatttacacgacctaaacccacctaagtcccggtaccctacggtaaccggggttccctcggccccgtattcccgtcgtcggtacctccgtacggtccgtcggccctaacctccgaaccgtcccgttaccccgtcggtaccctaacgtcccgtacgggttccgggggtacccgttccccggggggtacgggttaacggggtaacgggggtaacggttacggggtaccggttacgttaacgtttaaaccgttttaaccgttaccgtacccggtacccgtaacccggttacccgtaaggtaccgaaccggtaacgcccggtaacggtcccggttagggttcggttccgggttccgggttccgggtttccgggggtacccgggggaccgggggttaaaccggtaaccccggttaacgggttccccgg

SEQ ID NO: 300763 - DNA, 778 bp, Homo sapiens
  misc_feature: GZ8MTXP01DZ5NK.51.75.G09.1.454.CMB.2.raw
  modified_base (184)..(184): a, c, t, g, unknown or other
  misc_feature (184)..(184): n is a, c, g, or t
  modified_base (239)..(239): a, c, t, g, unknown or other
  misc_feature (239)..(239): n is a, c, g, or t
  modified_base (300)..(300): a, c, t, g, unknown or other
  misc_feature (300)..(300): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcccagtctgtgctgacgcacgccgccctnagtcgtcgtcggggccccagggcaggacggtcaccatcctcctgcacgtgggacncacgcctaccaacgagtcggggactaagggttatagatgtaaccgacgttacgggtaaccnggactacggtcccctttaaccgaaacgggtaacctaccggttaaccccccctaaaactttcccgttacctttaaacgtttttacgtacggtaacccctttaaaacccgaccccgttaaacggttccccgggtcccccgttaacgggtaaccccggggggtttccccctcgggtaccccggttaacttttcccgttccgtccgggtacccttcccgggtaacggttccggttccggaccctacccgtccgtacccggtcccttaccccgtcggtaaccctccgtccgacccgggtcggggtaccgttccccggggtgttacgggagggtaccgtgggtacggtcgttaggttaactttacgttaccgtcgtacccgtaaccggttcccaagttcgacgacgttacgtacgtccggttaggttgttcggtcggttacgttcgggttacgggacgggttaacggtccgaacgtttcccggg

SEQ ID NO: 300764 - DNA, 587 bp, Homo sapiens
  misc_feature: GZ8MTXP01BJHP4.51.75.G09.1.454.CMB.2.raw
  modified_base (229)..(229): a, c, t, g, unknown or other
  misc_feature (229)..(229): n is a, c, g, or t
  modified_base (255)..(255): a, c, t, g, unknown or other
  misc_feature (255)..(255): n is a, c, g, or t
  modified_base (318)..(318): a, c, t, g, unknown or other
  misc_feature (318)..(318): n is a, c, g, or t
  modified_base (391)..(391): a, c, t, g, unknown or other
  misc_feature (391)..(391): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcagccgccctcagtgtcgtggggccccagggcagagggtcaccatctcctgcacgtgggancagctccaacagtcggggcaggtaangatgtacacgtggtaccagcagccttaccgaaggaccacgtaccccaaactcctactatttancgacctaacaccaagtccccggccctcgacggggtccctcggcccgtattcctcgtcggcctccgaggttccncggaccctaccctcgaccgtcccctcccgtcggccctacgtaccgccgttcgggcccgttccggggctaggacggacgtggacggtcttagtactttacgtaccgtcgaccctcgtaccccatcgacaacgcacgccttggagtcgttcggcgttcgggtcgggcgggaacggacctaggccgtccgaaccgtccg

SEQ ID NO: 300765 - DNA, 731 bp, Homo sapiens
  misc_feature: GZ8MTXP01BE9DY.51.75.G09.1.454.CMB.2.raw
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagaggtcaccatctcctgcactgggagcagctcaacagtcgggcaggtaatgatgtacactggtaccagcagcttaccaaggaaccacgtacccccaaactcctactaatttactacgaccttaaacccaaccctaaacgtcccgggtacccctacggaaacccgggggttccccctcggacccccgtaatttccctccgtcggggtcccttaccgtacgggttcctacgggcccctaacccgttccgaaccgtccccgttcccccgttcgggacccctaacgttccccgaacgtccgggggtcccgttccccgggggcgttacggggagggtaaccttgggaacgggtccttacgggtaattttaaccgtttaccgtaccgggtacccctaaacggtttcccccgaagttccggaaacgtaaccggttccgaaacggtccccgttaagggttcgttcgggttcggtcccgttgggggtttcccggggacgggggttaaacggggaaccccgttaagggttccccggg

SEQ ID NO: 300766 - DNA, 569 bp, Homo sapiens
  misc_feature: GZ8MTXP01AFMTB.51.75.G09.1.454.CMB.2.raw
  modified_base (233)..(233): a, c, t, g, unknown or other
  misc_feature (233)..(233): n is a, c, g, or t
  modified_base (311)..(311): a, c, t, g, unknown or other
  misc_feature (311)..(311): n is a, c, g, or t
  modified_base (318)..(318): a, c, t, g, unknown or other
  misc_feature (318)..(318): n is a, c, g, or t
  modified_base (394)..(394): a, c, t, g, unknown or other
  misc_feature (394)..(394): n is a, c, g, or t
  modified_base (422)..(422): a, c, t, g, unknown or other
  misc_feature (422)..(422): n is a, c, g, or t
  modified_base (430)..(430): a, c, t, g, unknown or other
  misc_feature (430)..(430): n is a, c, g, or t
  modified_base (438)..(438): a, c, t, g, unknown or other
  misc_feature (438)..(438): n is a, c, g, or t
  modified_base (444)..(444): a, c, t, g, unknown or other
  misc_feature (444)..(444): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcagcccgccctcagtgtcgtcggggccccagggcagacgggtcacctatctcctgcacgtgggancagctaccaaacgagtcggggacaggtaatgatgtacacgtggaccagcagctacagaacacgtaccccaaactctanatttacngactaaaccacaacgtccccggcccttcgacggggtcccctgaccccgtattcgtcgtacggcttcccgaggttcncgcaccctcacgtccctccgcgccatcncgtcggcncccggggnaggagnggtcggagtctagtacttacgtcgcgtacctacgtccatcgacaacgcgttacgtcgttgtacgtgttcgttacggttcgggtaaccgggacggaacgaccacggttccgtaaccgttcccgtcc

SEQ ID NO: 300767 - DNA, 668 bp, Homo sapiens
  misc_feature: GZ8MTXP01CC5PG.51.75.G09.1.454.CMB.2.raw
  modified_base (236)..(236): a, c, t, g, unknown or other
  misc_feature (236)..(236): n is a, c, g, or t
  modified_base (343)..(343): a, c, t, g, unknown or other
  misc_feature (343)..(343): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcccagtctgtgctgacgcacgccgccctcagtgtcgtcggggccccagggcaggacggtcaccatctcctgcacgtgggancacgctaccaacagtcggggacaggtaatgatcgtacactcggtaccagcacgtccttaccgaaggtaaccaccgtaacccccaaaacttccctactaacttttacncgtaacctaaacccaccctaacgtcccgccccgtcggaccggggtcccctcgcccgtatttcctcgtcggtccctaccggacgtccgttcggaccctacccgtccgaccgtccccttcccgtcggcccctaacgtccgtaccggtcggggtccgttccccggggtaggttacggggaaggtaacgttcgggaacggtccgttaggttaactttacgttaccgtccgccgtaccgtcccgaatcgaacgtacgcgaccgttcgttaggttagttcggttcggccgtttgggtccgggacggggaacggtaaccgttaacgtcccgg

SEQ ID NO: 300768 - DNA, 598 bp, Homo sapiens
  misc_feature: GZ8MTXP01ENJ0M.51.75.G09.1.454.CMB.2.raw
  modified_base (184)..(184): a, c, t, g, unknown or other
  misc_feature (184)..(184): n is a, c, g, or t
  modified_base (233)..(233): a, c, t, g, unknown or other
  misc_feature (233)..(233): n is a, c, g, or t
  modified_base (245)..(245): a, c, t, g, unknown or other
  misc_feature (245)..(245): n is a, c, g, or t
  modified_base (323)..(323): a, c, t, g, unknown or other
  misc_feature (323)..(323): n is a, c, g, or t
  modified_base (399)..(399): a, c, t, g, unknown or other
  misc_feature (399)..(399): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcccagtctgtgctgacgcacgccgccctnagtgtcgtcggggccccagggcagaggtcaccatctctgcacgtgggancacgctaccaanagcgggacaggtaatgatgtacactggtacctagctagtctaccgaaggaacacgtacccccaaatcctactatttancgactaaacccacctaatccggaccctacgaaccgggttccctcggacccgtatttccgctcggtactcgagttcncggacctccgtcacgtccctcccgtcgcctactcgcgtcgggtccgtccgggtccgggtacggtaggtacggtaggtacggtcgtaggtacgtttaacttaacgtccggtacctaccgtaccctaacgtacgacgtacgacgacgtccgttgttggttggtgtcgtcggttcgggacgggacggaaccgaacgtaaccg

SEQ ID NO: 300769 - DNA, 572 bp, Homo sapiens
  misc_feature: GZ8MTXP01CL1PI.51.75.G09.1.454.CMB.2.raw
  modified_base (231)..(231): a, c, t, g, unknown or other
  misc_feature (231)..(231): n is a, c, g, or t
  modified_base (279)..(279): a, c, t, g, unknown or other
  misc_feature (279)..(279): n is a, c, g, or t
  modified_base (293)..(293): a, c, t, g, unknown or other
  misc_feature (293)..(293): n is a, c, g, or t
  modified_base (312)..(313): a, c, t, g, unknown or other
  misc_feature (312)..(313): n is a, c, g, or t
  modified_base (435)..(435): a, c, t, g, unknown or other
  misc_feature (435)..(435): n is a, c, g, or t
  modified_base (447)..(447): a, c, t, g, unknown or other
  misc_feature (447)..(447): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcagcccgcctcagtcgtcgtcggggccccagggcaggaggtcaccatctcctgcacgtgggancagctaccgaacacgtcggggacaaggtaatgatgtacacgtggaccngcagctacagaacncgtaccaactctatattannactaacacaagtccccgcctcgtacgggtccctcgacccgtattccgtcgtggcctaccgaggtctcgcacctcgacgtccctccgcgcccaagtccgacgtcgggcctcgggcaggaaggnggtcggtacgtntagtactttacgtcgtcgaccgtacgtacctagtacgaacgtcgtacgcggtccgttggtacgtgttcgttcgttcgggtaacgggacggaacggacgtacgttccgtaaccgttaaccgtaacg

SEQ ID NO: 300770 - DNA, 658 bp, Homo sapiens
  misc_feature: GZ8MTXP01EJXPV.51.75.G09.1.454.CMB.2.raw
  modified_base (183)..(183): a, c, t, g, unknown or other
  misc_feature (183)..(183): n is a, c, g, or t
  modified_base (234)..(234): a, c, t, g, unknown or other
  misc_feature (234)..(234): n is a, c, g, or t
  modified_base (254)..(254): a, c, t, g, unknown or other
  misc_feature (254)..(254): n is a, c, g, or t
  modified_base (259)..(259): a, c, t, g, unknown or other
  misc_feature (259)..(259): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcccagtctgtgctgacgcacgccgcctnagtcgtcgtcgggccccagggcaggacggtcacatctctgcacgtgggacncacgctacgaagcggcgganagtangatcgtacacgtacgacacgactacgtcctaacgaacgtaacctaccgtaacccctaacttcctattaattacacaacctaaccccaccgtacgtcccggtacccgtcggtaacccgggtccctcggtccttacttccgtcgtcgtccgtacgtcgtcgtcgacctaccgtctccgtcccgtaccgtcgtacctacgtcccgtacgggtccgggtcccggtcgggtacggtacgggtaacggtacgtacggtacggttacgttacgttaactttaccgtaccgtaccgtaccgtaccgtaccgtaacgtacgacgaacgttcgtacggtcgttaggttcggttcggtcggtcgggttcgggggtaccgggacgggaaccggtaaccgttaaccggtccg

SEQ ID NO: 300771 - DNA, 640 bp, Homo sapiens
  misc_feature: GZ8MTXP01C51E5.51.75.G09.1.454.CMB.2.raw
  modified_base (183)..(183): a, c, t, g, unknown or other
  misc_feature (183)..(183): n is a, c, g, or t
  modified_base (228)..(228): a, c, t, g, unknown or other
  misc_feature (228)..(228): n is a, c, g, or t
  modified_base (236)..(236): a, c, t, g, unknown or other
  misc_feature (236)..(236): n is a, c, g, or t
  modified_base (242)..(242): a, c, t, g, unknown or other
  misc_feature (242)..(242): n is a, c, g, or t
  modified_base (248)..(248): a, c, t, g, unknown or other
  misc_feature (248)..(248): n is a, c, g, or t
  modified_base (255)..(255): a, c, t, g, unknown or other
  misc_feature (255)..(255): n is a, c, g, or t
  modified_base (261)..(261): a, c, t, g, unknown or other
  misc_feature (261)..(261): n is a, c, g, or t
  modified_base (280)..(280): a, c, t, g, unknown or other
  misc_feature (280)..(280): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctgctcactgcacagggtcctgggcccagtctgtgctgacgcacgccgccctnagtgtcgtcggggccccagggcagcggtcacatctctgcagtggncagcacangtcggnaggtangatgacntgaccngcacgtctaccgaagaccncgtaccccctaaatcctacgtaatttagactaccgtaaacccaccgtaacgtcccggtccccgtacggaacccgggggttcccctcggaccccgttactttcccgtacgtccggtccctaccggtcgggttcctcggaccctaccgtccgacccgttccccgtaccgtcggccctaacgttcccgaacggtccgggtccgtccggggtacggtaggtaacgggcgtagggacggttcctaggttaactttacgttaccgcggtaccctacgttaccccaagttacgacgcgttcgtaacggtcttaggttcgttggtccacggtttcgggacgacgggttaccggaacaacggttccccg

SEQ ID NO: 300772 - DNA, 671 bp, Homo sapiens
  misc_feature: GZ8MTXP01A6XSK.51.75.G09.1.454.CMB.2.raw
  modified_base (224)..(224): a, c, t, g, unknown or other
  misc_feature (224)..(224): n is a, c, g, or t
  modified_base (236)..(236): a, c, t, g, unknown or other
  misc_feature (236)..(236): n is a, c, g, or t
  modified_base (248)..(248): a, c, t, g, unknown or other
  misc_feature (248)..(248): n is a, c, g, or t
  modified_base (263)..(263): a, c, t, g, unknown or other
  misc_feature (263)..(263): n is a, c, g, or t
  modified_base (333)..(333): a, c, t, g, unknown or other
  misc_feature (333)..(333): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacgagggtcctgggcccagtctgtgctgacgcacgccgccctcagtgtccgtggggccccagggcagaggtccaccatctcngcacgtgggacncagctaccaacngcgggctaaggtaangatgtacactcggtaccagcagccttaccgaacggtaaccaccgtaccccctaaactcctactatttacncgacttaaacccccacctacgtccggacccctgtaacccggggtccctcgccccgtattctcgtcggactccgacgtctcggccctaccgtccgaccgtccccgtcccgtcggccctaacgtcccgtaacccgtcggggtcccggttcccgggcggggttacggacggggtaccgtggggtaaccggtccttaggtaacctttaacgtttacccgtcgaccccgtaccgttccccgaagtccgggaaaccgcgttccgtaccgtccgttaggttcggttcggtcgggtaccgttcgggtaccggggaccgggttaacggtaaccgttaacgggtcccg

SEQ ID NO: 300773 - DNA, 801 bp, Homo sapiens
  misc_feature: GZ8MTXP01CX15X.51.75.G09.1.454.CMB.2.raw
  modified_base (227)..(227): a, c, t, g, unknown or other
  misc_feature (227)..(227): n is a, c, g, or t
  modified_base (778)..(778): a, c, t, g, unknown or other
  misc_feature (778)..(778): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcagcccgccctcagtgtcgtcggggcccagggcagaggtcactatctctgcacgtggancacgcctaccaacgtacggtcgggggactaagggtaactggtaattacggtaacctaacggttacggtaaccccgaggtaccgaaccggtacccgtttaaccccgaaacgggtaaaccccgtaaccccggttaacccccccctaaaaacgtttcccctttaacctttaaacgttttaacgtaccgtaacccttaaaacccaccgttaaaccgttcccccccgggtacccccgttaccgggtaccgggggttccccctacgggtaaccccccgttagtttccgtccgtacgggcccgttaccgacggggtcctcgggaccctacccgtcgcccgtcccgtaccgtacggtaccctacgtacccggtacggttcccgggggtccgttacccgggggacgttacgggaacggggtacgtaggggtaacggggtacctttaggtaaacttttacgtaccgtaccggtacctaacccggttaccagtccgaacgtcggcttacggtccgaggttcgtggttcgttacgggttcgggtcgggacgcggggtaacccnggttccgtaaccggttcccgtcg

SEQ ID NO: 300774 - DNA, 697 bp, Homo sapiens
  misc_feature: GZ8MTXP01DF3NJ.51.75.G09.1.454.CMB.2.raw
  modified_base (183)..(183): a, c, t, g, unknown or other
  misc_feature (183)..(183): n is a, c, g, or t
  modified_base (231)..(231): a, c, t, g, unknown or other
  misc_feature (231)..(231): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcccagtctgtgctgacgcacgccgcctnagtgtcgtcgggcccagggcagaggtcacatctcctgcacgtgggacncacgctaccgaacgtggtcgggataaggtatagagtacgtacacgtcgaccagcagtcctacgagaaccacctacccaactctatattacacaactaacccaccacgtcccggtaccctcggtaacccgggttccctcgtacccgttattcccgtcgtccggtcctaccggtacgggtccgtaccggaccctacccgtccgacccgttccccgttacccgtacggtaccctacgtacccgtaccgggtccgggtaccccggtccgggtacgggtaacggggtaaggggttacggtacgggtaccggttacgttacgttaactttaaccgttccggtccgtaacccgtaccgtaccctaaggtaacggaccgtacgccgtaccggtcgttagggttcggttcgggtcggttaccgggttcggggtaccggggacgggttaaaccgggtaacccgttaacgggtcccg

SEQ ID NO: 300775 - DNA, 676 bp, Homo sapiens
  misc_feature: GZ8MTXP01A6MVK.51.75.G09.1.454.CMB.2.raw
  modified_base (240)..(240): a, c, t, g, unknown or other
  misc_feature (240)..(240): n is a, c, g, or t
  modified_base (257)..(257): a, c, t, g, unknown or other
  misc_feature (257)..(257): n is a, c, g, or t
  modified_base (618)..(618): a, c, t, g, unknown or other
  misc_feature (618)..(618): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcccagtctgtgctgacgcacgcccgccctcagtcgtcgtcggggccccagggccaggacggtcaccatctcctgcacgtgggacncacgcctaccgaaacgnggtcggggactaagggttaatgacttcgtaaccacgtacggtaaccagacacgtcctaccgaaggaacctaccgtacccccaaacttcctacttatttacacgtacctaaacccacctaacgtcccggccctacggaaccggggttccctcggtccctattccgtccgtcgggtccctacggtacgggtcctcggaccctaccctcgacccgtccctcccggtacgcctacgttccgaccggtcgggtacccgtccgggtcggtacgggaacggtacgtcgggtaacggtcgttaggttaactttaaccgttcgtccggaccctcgtaccctaatcggactacgcgtacggtccttagggngttccggtggtccggttcgggtccgggggacggaccgggtaaccgttcggtaacccgg

SEQ ID NO: 300776 - DNA, 790 bp, Homo sapiens
  misc_feature: GZ8MTXP01E4251.51.75.G09.1.454.CMB.2.raw
  modified_base (236)..(236): a, c, t, g, unknown or other
  misc_feature (236)..(236): n is a, c, g, or t
  modified_base (781)..(781): a, c, t, g, unknown or other
  misc_feature (781)..(781): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcccagtctgtgctgacgcacgcccgccctcgagtcgtcgtcggggcccagggcaggaggtcaccatctctgcacgtgggancagcctaccgaacaggtccggggactaagggttaatgtaagtacgtaaccgtacgttacggtaacccaggaccacggtccttaccgaaacgggtaaaccctacccgttaaccccctaaaaccttccttacttaattttacgacgtaacctaaaaccccgacccgtaaacgtccccggggtccccttaccggggtaaacccgggggtttcccccctcgggtaccccccgttaaagtttccccgttaccggttcgggtaccccttaccggtaacggggtttcccgttaccggggaaccccttacccgtaccgaaccccggttcccccgttaccccgacgggtacccctaaacgttcccggacccgggttccgggggaccgttccccgggggacggttacggggaaggttacgttacgggacggttaccttaggttaaactttaacgttaccgtccgtaacccgtaccggtaccctaagtccggaaacacggctaacggtcgttagttacgttgtcggcgttaacggtcggggacggaacgtaaccgnggtaacccg

SEQ ID NO: 300777 - DNA, 657 bp, Homo sapiens
  misc_feature: GZ8MTXP01B2512.51.75.G09.1.454.CMB.2.raw
  modified_base (230)..(230): a, c, t, g, unknown or other
  misc_feature (230)..(230): n is a, c, g, or t
  modified_base (315)..(315): a, c, t, g, unknown or other
  misc_feature (315)..(315): n is a, c, g, or t
  modified_base (356)..(356): a, c, t, g, unknown or other
  misc_feature (356)..(356): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcagccgccctcagtgtctcggggccccagggcagagggtcaccatcctcctgcacgtgggancagctccaacagtcggggcaggaatgatacgtacacgtggtaccagcagctccaggaacacgtaccccaaactcctactatttancgactaacaccaagtcccccggccctacgaccggggtcccncgtaccccgtactttccgtccgtgggccctccgtaggtcgtcgccacccttccacgtcccctcccgtgccctatccgacgtcgggccgttccgggctagggaggaggtaggaggtcctaggtaatttacgttacgtcgacccgtaaccggtccctaacgttacgacgtaacgccgttacggacccgttggtacggttcgggttcgttccggttcggggtttcccgggggaccgggggttaaaccgggtaaccccggaaacgggttacccgtaacccggttaacccccggtttaacccccgg

SEQ ID NO: 300778 - DNA, 745 bp, Homo sapiens
  misc_feature: GZ8MTXP01DYIKM.51.75.G09.1.454.CMB.2.raw
  modified_base (185)..(185): a, c, t, g, unknown or other
  misc_feature (185)..(185): n is a, c, g, or t
  modified_base (246)..(246): a, c, t, g, unknown or other
  misc_feature (246)..(246): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacgagggtcctggcccagtctgtgctgacgcacgcccgccctnagtcgtcggtcggggccccagggcaggacggtccacctatcctccgtgcgacggtgggacncgacgcctaccgaaacgcggtccggggactaagggtatagtagtacgtacctacgtcggtaacccagaccgacgtaccgtaacccgaaaggtaaacccctacccgtaacccccctaaaaccttccgttaacttaactttacgaccgtaacctaaaacccccaccgtaacgtcccggtacccgtaccggtaacccggggttcccctcggtacccttacgttcccgtacgtccggtaccttcgacgttcgtaccgaccctaccgtccgtacccgtcccttcccggacggtacctaccgttccggaccgggttcccggggaccgttcccggggtaacgggtacggtaacggggtagttcgggaaccggttacgttaacgtttacctttaaccgttcgttaccgacccgtaaacccgttcccgaagtacgaaacgccgacggtacgtcgttaggcgttcggtgtacggtcgggtcggacgggttaccgaacgttcgtaaccgg

SEQ ID NO: 300779 - DNA, 694 bp, Homo sapiens
  misc_feature: GZ8MTXP01CFFNA.51.75.G09.1.454.CMB.2.raw
  modified_base (240)..(240): a, c, t, g, unknown or other
  misc_feature (240)..(240): n is a, c, g, or t
  modified_base (547)..(547): a, c, t, g, unknown or other
  misc_feature (547)..(547): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcccagtctgtgctgacgcacgcccgccctcgagtcgtcgtcggggccccgagggcaggacggtccacatctcctgcacgtgggancagtcctaccaacgacggtcgggacaggtaatgatcgtaaccacgttacggaccagactacgtccttaccggaacggtaaccacccgtaccccctaaactccttacttaattttacacgtaacctaaaccccaccacgtcccggtaccctaccgggtaacccggggttaccctccggcccttacgttccgtcgtccggtcctcgtacggtcccgtacggtaccctacccgtccgtaccgtccccgttcccgtcggtaaccctcgtccgcgggtccgggtcccgtacccgggtcggtagggtaacggngttaacgggcgttaccgttagttaacgtttaccgtcgtccgtcccgtaaacgtcccgtaagtcgacacggcgtaacggtcgttaacgggttgttcgtcgggttcggttcgggtcgggaccgggacggaaccgttaacgtaacccggg

SEQ ID NO: 300780 - DNA, 632 bp, Homo sapiens
  misc_feature: GZ8MTXP01AO825.51.75.G09.1.454.CMB.2.raw
  modified_base (228)..(228): a, c, t, g, unknown or other
  misc_feature (228)..(228): n is a, c, g, or t
  modified_base (468)..(468): a, c, t, g, unknown or other
  misc_feature (468)..(468): n is a, c, g, or t
  modified_base (537)..(537): a, c, t, g, unknown or other
  misc_feature (537)..(537): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcagccgcctcagtgtcgtggggccccagggcagagggtcaccatctcctgcacgtgggancagcctaccaacagtcgggcaggtatgatgtacacgtggtaccagcagcttacgaggaaccacgtaccccaaacgtcctactaatttacacgacctaaaccacctaacgtcccccggacccctacggaccggggtcccctcggtaaccccgtattccgtcgtcgggccttaccgaggtcctggacccaccctcgacggtccctccgtcggcctactccgacgtcggggccgttcccgggngtagggacgtggtacggacggtcttacgttaacttacgtacgtcgacccgtaccgtacccagtacgacncggccttacggtcgttggtcgttcggttcgttccggttcgggtaacccgggacgggtaacgacccgtacggttccgtaaccggttaacccgtccg

SEQ ID NO: 300781 - DNA, 787 bp, Homo sapiens
  misc_feature: GZ8MTXP01ACCDA.51.75.G09.1.454.CMB.2.raw
  modified_base (234)..(234): a, c, t, g, unknown or other
  misc_feature (234)..(234): n is a, c, g, or t
  modified_base (245)..(245): a, c, t, g, unknown or other
  misc_feature (245)..(245): n is a, c, g, or t
  modified_base (281)..(281): a, c, t, g, unknown or other
  misc_feature (281)..(281): n is a, c, g, or t
  modified_base (301)..(301): a, c, t, g, unknown or other
  misc_feature (301)..(301): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcagcccgccctcagtgtcgtcggggccccagggcgagacgggtcaccatctcctgcacgtggggancagctccaacngtcggggcaagggtaatgatcgtacacgtggtaccngcagtcttccgaaggaaccncgtaccccaaactcctactatttatcgactaaaccactaacgtcccccggaccctcggaccgggggttcccctcggtaaccccgttatttcccgtcgtacgggtcccttaccggagggtttcctacgggacccctaacccgttccgaacccggtcccccgttccccgttcgggaccctacgttacccgtaaccggttccggggggtcccgttacccgggggtcgttaacggggaccgggtaaacgggttggggtaaacggggtcctttacggggttaaatttaaaccgtttacggtacccggtaacccgtaccggtttaccccgaacgttaccgggaaacttaacgggtacccgacggtaacccggttgggttaaacggttcgggttacggttccgggtttacggggtttcccgggggaaccggggttaacggggtaaccccggaacgggttcccggttaaccgggttaaaccccgtttccccggg

SEQ ID NO: 300782 - DNA, 665 bp, Homo sapiens
  misc_feature: GZ8MTXP01BEY7R.51.75.G09.1.454.CMB.2.raw
  modified_base (236)..(236): a, c, t, g, unknown or other
  misc_feature (236)..(236): n is a, c, g, or t
  modified_base (342)..(342): a, c, t, g, unknown or other
  misc_feature (342)..(342): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcccagtctgtgctgacgcacgcccgccctcagtgtcgtcgggccccagggcagacggtcaccatctcctgcacgtgggacncacgctaccaacgaggtcggggacaaggtaatgtatacgtacctacgtcggtaccagccacgtcctacgaacggtaccaccgtacccccaaactcctactatttancgacctaacccacctacgtcccgcccgtcggtaaccgggtccctcggtaccctacttccgtcgtcggtcctcgtacggtcctcgccctacctcgtaccgtccccgtacccgtcggcctaacgtccgtaccggtcggggtacccgtcccggggtacggttaggtacgggggtactacggggtacgttccgttagttaaactttacgttaccgtcccggtacctaccgtcccgtaaagtcgaaacgtcgaccgtcggtccgttaggttgttcggtcgtcggttcgggtaccggggacggttaaacccggaacgttaaccggtccg

SEQ ID NO: 300783 - DNA, 669 bp, Homo sapiens
  misc_feature: GZ8MTXP01D80O7.51.75.G09.1.454.CMB.2.raw
  modified_base (182)..(182): a, c, t, g, unknown or other
  misc_feature (182)..(182): n is a, c, g, or t
  modified_base (237)..(237): a, c, t, g, unknown or other
  misc_feature (237)..(237): n is a, c, g, or t
  modified_base (251)..(251): a, c, t, g, unknown or other
  misc_feature (251)..(251): n is a, c, g, or t
  modified_base (268)..(268): a, c, t, g, unknown or other
  misc_feature (268)..(268): n is a, c, g, or t
  modified_base (290)..(290): a, c, t, g, unknown or other
  misc_feature (290)..(290): n is a, c, g, or t
  modified_base (384)..(384): a, c, t, g, unknown or other
  misc_feature (384)..(384): n is a, c, g, or t
  modified_base (493)..(493): a, c, t, g, unknown or other
  misc_feature (493)..(493): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacgagggtcctgggcccagtctgtgctgacgcacgcccgccctnagtcgtcgtcggggccccagggcaggacggtcaccatcctcctgcacgtgggacncacgctaccaacgnggtcgggacaaggtaangatcgtaactacgtcggtaccngcacgtcctacgaggtaaccaccgtaccccaaacttctacttaattacacgacctaaacacctaacgtccccgacccgtacggaccgggtcccncgtaaccccgtattcctcgtccggtaccctcgtacggtcgtcggaccctaccgtcgaccgtcccctacgtcggaccctacgtccgtacggtcgggtcccgtccggggtntaggggacggtaggtcgggtacgttaccgttagttaaactttcgtaccgtcgacctaccgttccagtaccgacgaacgtccaacggtccgttagcggttcgttggttccgttacgggggaaccgggaccggggaacggtaaccgacggttccgttaacccgggccgtttaacccgg

SEQ ID NO: 300784 - DNA, 508 bp, Homo sapiens
  misc_feature: GZ8MTXP01C67CE.51.75.G09.1.454.CMB.2.raw
  modified_base (277)..(277): a, c, t, g, unknown or other
  misc_feature (277)..(277): n is a, c, g, or t
  modified_base (291)..(291): a, c, t, g, unknown or other
  misc_feature (291)..(291): n is a, c, g, or t
  modified_base (297)..(297): a, c, t, g, unknown or other
  misc_feature (297)..(297): n is a, c, g, or t
  modified_base (307)..(307): a, c, t, g, unknown or other
  misc_feature (307)..(307): n is a, c, g, or t
  modified_base (313)..(313): a, c, t, g, unknown or other
  misc_feature (313)..(313): n is a, c, g, or t
  modified_base (322)..(322): a, c, t, g, unknown or other
  misc_feature (322)..(322): n is a, c, g, or t
  modified_base (338)..(338): a, c, t, g, unknown or other
  misc_feature (338)..(338): n is a, c, g, or t
  modified_base (353)..(353): a, c, t, g, unknown or other
  misc_feature (353)..(353): n is a, c, g, or t
  modified_base (355)..(355): a, c, t, g, unknown or other
  misc_feature (355)..(355): n is a, c, g, or t
  modified_base (363)..(363): a, c, t, g, unknown or other
  misc_feature (363)..(363): n is a, c, g, or t
  modified_base (385)..(385): a, c, t, g, unknown or other
  misc_feature (385)..(385): n is a, c, g, or t
  modified_base (435)..(435): a, c, t, g, unknown or other
  misc_feature (435)..(435): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagaggtcaccatctctgcactgggagcagctccaaacagtcgggcaggaaatgatgacactgacagcagctcagaacngaccccaaatcctnatttancacaacacanccgccncgcggtccncgaccactctctcgcncgacgtcgcgcaccncncgcctccncgcactcacgcggcgtcggcgngagacggagagtcgtatattaattactacgaccacgtaccacacgacaanacacgtcgttacgtagtgttcgttcgttcggtcggacgggaacggaacgacgttacgtaacgaaccgtaaccg

SEQ ID NO: 300785 - DNA, 691 bp, Homo sapiens
  misc_feature: GZ8MTXP01BTR3G.51.75.G09.1.454.CMB.2.raw
  modified_base (182)..(182): a, c, t, g, unknown or other
  misc_feature (182)..(182): n is a, c, g, or t
  modified_base (240)..(240): a, c, t, g, unknown or other
  misc_feature (240)..(240): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacgagggtcctgggcccagtctgtgctgacgcacgcccgccctnagtcgtccgtcggggccccagggcaggacggtccactatcctcctgctacgtgggacncacgtacacgaagtcggtcgggataagtatgtatacgtaacacgtacgacagacgacgtacctaaccgaacgtaaccctacctaaccctactcctattattacactaacctaacaccgtacgtcccccgtaccgtacggtaccggtccctacgtaaccttcttcgtcgtaccgtaccgtccgtcgtcgacgtaccacctcgccgtcccgtcccgtaccgtaccgtaccgtaccgtaccggtccgggtccggtccggtacggtacggtacggtacggggtacggtacggttacgttacgttaacgttacgttaccgtaccgtaccgtaccgtaccgtacgtacgacgtaacgtacgttacgtcggttacgtacggtcggttcggttcggttacgggtaacgggacgggtaaccggtaccgtaccggttaccgtaaccggttaaccgtaaccg

SEQ ID NO: 300786 - DNA, 606 bp, Homo sapiens
  misc_feature: GZ8MTXP01E1UV9.51.75.G09.1.454.CMB.2.raw
  modified_base (232)..(232): a, c, t, g, unknown or other
  misc_feature (232)..(232): n is a, c, g, or t
  modified_base (333)..(333): a, c, t, g, unknown or other
  misc_feature (333)..(333): n is a, c, g, or t
  modified_base (401)..(401): a, c, t, g, unknown or other
  misc_feature (401)..(401): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcacgcccgccctcagtgtcgtcggggccccagggcagacgggtcacatctcctgcacgtgggancagcctaccgaacgacggtcggggactaaggtaactgatgtacacgtcggtaccagcacgtctaccgacggaacctaccgtaccccaactcctatatttanacactaacacctacgtccccggcctacggacggtccctcgaccctattcctcgtcgctccgtaggtcncggaccaccgtcgaccgtcccgtccgtcgcctacgtcgtacggtcgggcccgtcggacgtggacggtggtacggacggtcttagtacgtttacgtccgacggtacctacgtaccagtcgactaacgcgttacggccgttggacgttggacgttcgtttacggggcgggaccgggtaacgactaggccgtaacgttcccgtaaccg

SEQ ID NO: 300787 - DNA, 722 bp, Homo sapiens
  misc_feature: GZ8MTXP01C8BSC.51.75.G09.1.454.CMB.2.raw
  modified_base (245)..(245): a, c, t, g, unknown or other
  misc_feature (245)..(245): n is a, c, g, or t
  modified_base (527)..(527): a, c, t, g, unknown or other
  misc_feature (527)..(527): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcacgcccgccctcgaggtcgtccgtcggggcccccaggggccaggacgggtccaccgatcctcctgcacgtgggacncacgcctaccgaacgcgtcgggggcaagggtaatgtacgttggtaacacgttcggacccaagccacgtacccttaccgaacggtaacctaccgtaaccccctaaacttcccttactaattttacgacgtaacccttaaaccaccgtaaaccgttccccccgggacccccgttacggacggggttccccctacggtacccccgttatttcccgtcgtccggtacccgtcccgtacgggtccgtcgggacccctacccgtccgtaccggtccccgttccccggnggtaccctacgttccgaaccgggttcggggcccgttcccggggagttacgggacggtagggtcggtaacggtccgttaagttacttacgtacgtccggacctacggtacccagtcgacgtaagcacgtcgttaggcgttggcgttcgtttacggccggaacgggcggtaccgagttccgtaacgcccggttaacc

SEQ ID NO: 300788 - DNA, 547 bp, Homo sapiens
  misc_feature: GZ8MTXP02H45OG.51.75.G09.1.454.CMB.2.raw
  modified_base (306)..(306): a, c, t, g, unknown or other
  misc_feature (306)..(306): n is a, c, g, or t
  modified_base (445)..(445): a, c, t, g, unknown or other
  misc_feature (445)..(445): n is a, c, g, or t
tcagcgatcgtatacacgaccggtgctcgatttagtatagacatcaggggcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcggggcaggtaatgatgtacactggtaccagcagcttccaggaacagtccccaaaactcctcatttangactaaacaccaatccccggccctacgacggggtccctgccccgtattcctctggcctccaggtcctgccaccctcacgccctccctggcccatccactgggcctccggggctggagatggaggctggattagttaccncgaccacgtcccagtacgaacgacgacgacgtcctaggacgttcgtcgtcggttcgggtccgggacgggaacgggaccaacggtccgtacggtacccgtccg

SEQ ID NO: 300789 - DNA, 481 bp, Homo sapiens
  misc_feature: GZ8MTXP02IU9X5.51.75.G09.1.454.CMB.2.raw
  modified_base (303)..(303): a, c, t, g, unknown or other
  misc_feature (303)..(303): n is a, c, g, or t
  modified_base (405)..(405): a, c, t, g, unknown or other
  misc_feature (405)..(405): n is a, c, g, or t
tcagcgatcgtatacacgaccggtgctcgatttagtatagacatcagggcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcgggcaggtaatgatgtacactggtaccagcagcttccaggaacagtccccaaactcctcatttangctaacaccaatccggccctcaggggtccctgcccgattctctggctccaggtctggcacctcacgccctcctggccatccacgtgggctccgggctgaggntgagctgattatactgccagtcccatgacagcagcctgagtgtcgctgtcggcggaggaccagcctgaccgttccg

SEQ ID NO: 300790 - DNA, 494 bp, Homo sapiens
  misc_feature: GZ8MTXP02HO7IB.51.75.G09.1.454.CMB.2.raw
  modified_base (227)..(227): a, c, t, g, unknown or other
  misc_feature (227)..(227): n is a, c, g, or t
  modified_base (474)..(474): a, c, t, g, unknown or other
  misc_feature (474)..(474): n is a, c, g, or t
tcagcgatcgtatacacgaccggtgctcgatttagtatagacatcaggggcttcagctgtgggcacaagaggcagcactcaggacaatctccagcatggcctggtctcctctcctcctcactctcctcgctcactgcacagggtcctgggcccagtctgtgctgacgcagcccgccctcagtgtctggggccccagggcagagggtcaccatctcctgcactgggancagctccaacagtcggggcaggtaatgatgtacactggtaccagcagcttccaggaacagtccccaaactcctcatttatgactaacaccaatcccgccctcacggggtccctgccccgattcctctggctcccagggtctggccacctcacgccctccctggcccatccactcgggctccgggctgagatgagctgattatactgccagtcccatcgacacgcagcctgagtcgtgctgtaacggnggacggaccagctgacgtcc

SEQ ID NO: 300791 - DNA, 766 bp, Homo sapiens
  misc_feature: GZ8MTXP02F2CUG.51.75.G09.1.454.CMB.2.raw
  modified_base (232)..(232): a, c, t, g, unknown or other
  misc_feature (232)..(232): n is a, c, g, or t
  modified_base (246)..(246): a, c, t, g, unknown or other
  misc_feature (246)..(246): n is a, c, g, or t
  modified_base (276)..(276): a, c, t, g, unknown or other
  misc_feature (276)..(276): n is a, c, g, or t
  modified_base (322)..(322): a, c, t, g, unknown or other
  misc_feature (322)..(322): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagaggtcaccatctcctgcacgtggggancagcctaccaaacnggtcggacaggtaatgatgacacgtgaccngcagtctaccgaggaactacgtaaccccaaactcctactaatttancgtaacctaaccccaacctaacgtcccggacccccttacggaacccggggtttccccctccgggtacccccgtaattttcccgtaccgttccggggtaacccttccgggtaaaccggttccgttccgggacccctttaaaccccggtcccaaacccggttcccccctttacccccgtccggggtaacccccaaaactttcccccgaaaccgggtttcccgggggacccccggtttacccccgggggtacggtaacggggtaacgggtaacggttaaccggggtaacggttaccgttaagttaaacttttaaccgttaaccggtaccgtaacccgtacccgtaccccgtaagtaccgaaaccgtacgtaaccgtacggtccgtaggtacggtcgtcggtcggttacggggtaccggggaacgggaaacggaaccgtaacggtccg

SEQ ID NO: 300792 - DNA, 479 bp, Homo sapiens
  misc_feature: GZ8MTXP02GXVPU.51.75.G09.1.454.CMB.2.raw
  modified_base (309)..(309): a, c, t, g, unknown or other
  misc_feature (309)..(309): n is a, c, g, or t
  modified_base (455)..(455): a, c, t, g, unknown or other
  misc_feature (455)..(455): n is a, c, g, or t
  modified_base (465)..(465): a, c, t, g, unknown or other
  misc_feature (465)..(465): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcggggcaggtaatgatgtacactggtaccagcagcttccaggaacagtccccaaatcctcatttangctaaccaccaatcggccctcgacggggtccctgcccgattctctggctccaggtctgccacctcacgccctcctgccatccactgggcctccgggctggagatggagctgattatactgccagtcccatgacagcagcctgatgngctggtcggngacggaccaagccg

SEQ ID NO: 300793 - DNA, 499 bp, Homo sapiens
  misc_feature: GZ8MTXP02J3QP8.51.75.G09.1.454.CMB.2.raw
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcggggcaggtaatgatgtacactggtaccagcagcttccaggaaccagtccccaaaactcctcatttatgctaacaccaatcccggccctcaggggtccctgcccgattctctggctccaggtctggcacctcacgccctccctggcccatccactggggcctccggggctgagggatgaggctgtattattactgccacgtcccatgacagcagcctgagtgtgctgttcggcggagggaccaagcctgacccgttccg

SEQ ID NO: 300794 - DNA, 569 bp, Homo sapiens
  misc_feature: GZ8MTXP02I93D2.51.75.G09.1.454.CMB.2.raw
  modified_base (227)..(227): a, c, t, g, unknown or other
  misc_feature (227)..(227): n is a, c, g, or t
  modified_base (314)..(314): a, c, t, g, unknown or other
  misc_feature (314)..(314): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggancagctccaacagtcggggcaggtaatgatgtacacgtggtaccagcagcttaccgaggaacacgtaccccaaactcctactatttancgactaaaccaccaatccccggcccctacgacggggtccctgcccgtattccgtctcggcctccgaggtctcggccacctcacgccctccgtcggcccatccacgtcgggccgttccgggctacggaggacgtcggacggtcttaggtactttacgttacgtcgtacctacgtccctagtcgactacgacagccgtagacgtgtcgtcgttcggtccggacggtaacggaccaagtccgtacggtacccgtaccg

SEQ ID NO: 300795 - DNA, 511 bp, Homo sapiens
  misc_feature: GZ8MTXP02GRQWA.51.75.G09.1.454.CMB.2.raw
  modified_base (228)..(228): a, c, t, g, unknown or other
  misc_feature (228)..(228): n is a, c, g, or t
  modified_base (300)..(300): a, c, t, g, unknown or other
  misc_feature (300)..(300): n is a, c, g, or t
  modified_base (306)..(306): a, c, t, g, unknown or other
  misc_feature (306)..(306): n is a, c, g, or t
  modified_base (464)..(464): a, c, t, g, unknown or other
  misc_feature (464)..(464): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcagcccgccctcagtgtctggggccccagggcagagggtcaccatctcctgcactgggancagctccaacagtcggggcaggtaatgatgtacactggtaccagcagcttcaggaacagtccccaaatcctnatttangactaacaccaatcccggcccctgacggggtcccctgccccgtattcctctggcctccgaggtctggccacccgtcacgccctccctggcccatcacgtgggcctcgggctgagatgaggctgattatactgccagtcccatgacagcagccctaggngtcgtcgtcgtcggtcggcggacggacgacgacgtacgtaccgtccg

SEQ ID NO: 300796 - DNA, 543 bp, Homo sapiens
  misc_feature: GZ8MTXP02I67JP.51.75.G09.1.454.CMB.2.raw
  modified_base (226)..(226): a, c, t, g, unknown or other
  misc_feature (226)..(226): n is a, c, g, or t
  modified_base (438)..(438): a, c, t, g, unknown or other
  misc_feature (438)..(438): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagaggtcaccatctcctgcactgggancagctccaacatcggggcaggtaatgatgtacactggtaccagcagcttccaggaacacgtaccccaaactcctctatttatcgacctaaacaccaatcccggcccctcgacggggtcccctgccccgtattccgtctcggcctccgaggtcctgggccaccctcacgccctccctggccatccacgtcgggcctccgggcttggaggtagnggtaggctgtatttacgtactcgccacgttcccagtcgacacgcagcctggagtcgtcgtcgttaggtcgggcggaacgggaccaaggcctacggacccgttccg

SEQ ID NO: 300797 - DNA, 496 bp, Homo sapiens
  misc_feature: GZ8MTXP02IDGEV.51.75.G09.1.454.CMB.2.raw
  modified_base (190)..(190): a, c, t, g, unknown or other
  misc_feature (190)..(190): n is a, c, g, or t
  modified_base (230)..(230): a, c, t, g, unknown or other
  misc_feature (230)..(230): n is a, c, g, or t
  modified_base (306)..(306): a, c, t, g, unknown or other
  misc_feature (306)..(306): n is a, c, g, or t
  modified_base (413)..(413): a, c, t, g, unknown or other
  misc_feature (413)..(413): n is a, c, g, or t
  modified_base (455)..(455): a, c, t, g, unknown or other
  misc_feature (455)..(455): n is a, c, g, or t
  modified_base (459)..(459): a, c, t, g, unknown or other
  misc_feature (459)..(459): n is a, c, g, or t
  modified_base (469)..(469): a, c, t, g, unknown or other
  misc_feature (469)..(469): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcccagtctgtgctgacgcagccgccctcagtttcnggggccccagggcagaggtcaccatctcctgcactgggancagctccacatcggggcaggtaatgatgtacactggtaccagcagctccgaggacagtccccaaaatcctcattangactaacacccaatccgcctcgacgggtcccctgcccgattctcgtgcctccgagtctcggcacccgtcacgccctccctggcctatccgacgtcgggctcccgggntagaggatgaggctgtattatactcgccagtcccaatcgacngacncgctgcgtgngcgtggtacggacggacgacagcgtcg

SEQ ID NO: 300798 - DNA, 581 bp, Homo sapiens
  misc_feature: GZ8MTXP02ISGZM.51.75.G09.1.454.CMB.2.raw
  modified_base (230)..(230): a, c, t, g, unknown or other
  misc_feature (230)..(230): n is a, c, g, or t
  modified_base (242)..(242): a, c, t, g, unknown or other
  misc_feature (242)..(242): n is a, c, g, or t
  modified_base (316)..(316): a, c, t, g, unknown or other
  misc_feature (316)..(316): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcagccgccctcagtgtctggggcccccagggcaggagggtcaccatctcctgcacgtgggancagcctccaacngtcggggcaggtaatgatgtacactggtaccagcagcttccaggaacacgtaccccaaaactcctactatttancgacctaacaccaactcccgcccctcgacggggtccctcgccccgtattcctctcggcctccgaggtctcgggcctaccctcacgccctccctcggccactccgacgttcgggccgtccgggctggacggtagtcggaggtcgtagtaactttagttactcgccgtaacgtcccagtcgacgacgctacggccttaggacgttggtcgtcgtttacgggtccgggacgggaacgggtaccaaggtccgtcggtaacccgttcccg

SEQ ID NO: 300799 - DNA, 522 bp, Homo sapiens
  misc_feature: GZ8MTXP02IF4CD.51.75.G09.1.454.CMB.2.raw
  modified_base (227)..(227): a, c, t, g, unknown or other
  misc_feature (227)..(227): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacaaggtcctgggcccagtctgtgctgacgcagccgccctcagtgtctggggccccagggcagagggtcaccatctcctgcactgggancagctccaacagtcggggcaggtaatgatgtacactggtaccagcagcttaccaggaacacgtccccaaaactcctctatttatgactaaacaccaactcccggcccctcgacggggtccctgccccgattctctcggctccgaggtctcggccacctcacgtccctccctcggcccatccacgtcggggcctccggggctggaggatggagtctgtattacttactcgccacgtcccatcgacagcagcctgagtcgtgcttggtcggcggacgggacagtctcgacccgtccg

SEQ ID NO: 300800 - DNA, 551 bp, Homo sapiens
  misc_feature: GZ8MTXP02ISQL0.51.75.G09.1.454.CMB.2.raw
  modified_base (313)..(313): a, c, t, g, unknown or other
  misc_feature (313)..(313): n is a, c, g, or t
  modified_base (512)..(512): a, c, t, g, unknown or other
  misc_feature (512)..(512): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactggggagcagctccaacatcggggcaggtaatgatgtacactggtaccagcagcttccaggaacacgtacccccaaatcctcatttangactaaccaccaatccggcccctcgacggggtcccctgcccgtattcctcctcggctccgaggtctggccacctcacgcccctccctcggccactccacgtcggggccttcccggggctacggaggtactgggacggtcttaggtactttacgttacgttggcccagttcccctaagtcgacaggccacgtccctaggngttgtgcgttcggttcgggacggacgggaccaaggtccg

SEQ ID NO: 300801 - DNA, 602 bp, Homo sapiens
  misc_feature: GZ8MTXP02I4BTN.51.75.G09.1.454.CMB.2.raw
  modified_base (307)..(307): a, c, t, g, unknown or other
  misc_feature (307)..(307): n is a, c, g, or t
  modified_base (387)..(387): a, c, t, g, unknown or other
  misc_feature (387)..(387): n is a, c, g, or t
tcagcgatcgtatacacgaccggtgctcgatttagtatagacatcaggggcttcagctgtgggcacaagaggcagcactcaggacaatctccagcatggcctggtctcctctcctcctcactctcctcgctcactgcacagggtcctgggcccagtctgtgctgacgcagccgcctcagtgtctggggccccagggcagagggtcaccatctcctgcactgggagcagctccaacagtcggggcaggtaatgatgtacactggtaccagcagcttccaggaacacgtccccaaactcctctatttancgactaacaccaatcccggccctacgacggggtcccctggcccccgtattcctctcggcctccgaggtctgggccacctnacgtccctccgtggccatccacgtcgggcctccgggctggacggatggacggtccttggaactttacgttacctcgtcccaacggttccccaagtacgaccaacggctaaacgggtcccttaggaacggtttcggtacgtccgtttcggggttaacccgggggacgggtaacgggggtaacccaacggcccgtttcggaacccccggtttacccg

SEQ ID NO: 300802 - DNA, 555 bp, Homo sapiens
  misc_feature: GZ8MTXP02JNTC5.51.75.G09.1.454.CMB.2.raw
  modified_base (233)..(233): a, c, t, g, unknown or other
  misc_feature (233)..(233): n is a, c, g, or t
  modified_base (317)..(317): a, c, t, g, unknown or other
  misc_feature (317)..(317): n is a, c, g, or t
  modified_base (354)..(354): a, c, t, g, unknown or other
  misc_feature (354)..(354): n is a, c, g, or t
  modified_base (521)..(521): a, c, t, g, unknown or other
  misc_feature (521)..(521): n is a, c, g, or t
  modified_base (525)..(525): a, c, t, g, unknown or other
  misc_feature (525)..(525): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcacgtggggancagctccaacagtcggggcaggtaatgatgtacacgtggtaccagcagcttccgaggaacacgtaccccaaactcctcatttangactaaaccaccaagtccgccctcgacggggttcccncgcccgtattcctcgtcggcctccgagggttcctcgggccctacccgtcgacgtccccttccccgtggcccacgtccaccgtcgggccgtccgggcgtggacggagtcggacggtcttaggatttacgtactcgacctacgtcccatcggacacgcacgccttaggngtgngtcgtcggtcgggcggacggaccgagtccg

SEQ ID NO: 300803 - DNA, 527 bp, Homo sapiens
  misc_feature: GZ8MTXP02HT9YL.51.75.G09.1.454.CMB.2.raw
  modified_base (399)..(399): a, c, t, g, unknown or other
  misc_feature (399)..(399): n is a, c, g, or t
  modified_base (448)..(448): a, c, t, g, unknown or other
  misc_feature (448)..(448): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcagcccgcccccagtgtctgggccccagggcagagggtcaccatctcctgcactgggagcagctccaacagtcggggcaggtaatgatgtacactggtaccagcagcttaccaggaacacgtacccccaaaactcctactatttatgactaaacaccaaatccgccccctacgacggggtccctgcccgtattctctggctccgaggtctggccacctcacgccctcccgngcccatcacgtggcctccgggctgaggatggaggtctgtaattattacncgcctagtcccaagtcgacagcagcctgagtgtcgcgtaggtcggaacggacgggaaccagcgtacgaccgttccgacg

SEQ ID NO: 300804 - DNA, 598 bp, Homo sapiens
  misc_feature: GZ8MTXP02JJ80W.51.75.G09.1.454.CMB.2.raw
  modified_base (229)..(229): a, c, t, g, unknown or other
  misc_feature (229)..(229): n is a, c, g, or t
  modified_base (321)..(321): a, c, t, g, unknown or other
  misc_feature (321)..(321): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcaggagggtcaccatctcctgcacgtgggancagcctaccaacagtcggggcaggtaatgatgtacacgtggtaccagcagccttaccgaggaaccacgtaccccaaaactcctactatttangacctaacaccaatccccggccctgacgggtccctgcccgtattcctctcggcctccgaggtctcggccaccctcgacgccctcccgtggccctatccgacgtcggggcctccggggctggacggtatacggacggtcttaggtaactttactacgtcggaccctacgttccccagtcgaactacgaccgtaacggccgttaggacgttgtcgtccgttacgggttaacggggacgggtaacgggaccaacggtccgttacggacccgtttacccgg

SEQ ID NO: 300805 - DNA, 600 bp, Homo sapiens
  misc_feature: GZ8MTXP02GCCUR.51.75.G09.1.454.CMB.2.raw
  modified_base (314)..(314): a, c, t, g, unknown or other
  misc_feature (314)..(314): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactggggagcagctccaacagtcggggcaggtaatgatgtacactggtaccagcagcttccaggaacacgtccccaaactcctacatttangactaaacccaccaatccggccctcgacggggttcccctgccccgatttcctcgtggctccgaggttcctggcctaccctcacgtcccctccctggcccactcaccgtcggggcctcccggggctgggacggtagttacgggacggtcttaggtaacttttaacgtttaccgtcggaccctaacggttcccccaagtcggaaccacggccaacggcccttgggaacgttggtcggtccgttacggggtttccgggggacggggtaaacggggaacccaaggtcccg

SEQ ID NO: 300806 - DNA, 511 bp, Homo sapiens
  misc_feature: GZ8MTXP02FPNJ9.51.75.G09.1.454.CMB.2.raw
  modified_base (226)..(226): a, c, t, g, unknown or other
  misc_feature (226)..(226): n is a, c, g, or t
  modified_base (237)..(237): a, c, t, g, unknown or other
  misc_feature (237)..(237): n is a, c, g, or t
tcagcgatcgtatacacgaccggtgctcgatttagtatagacatcaggggcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggancagctccaacntcggggcaggtaatgatgtacactggtaccagcagcttccaggaacagtccccaaactcctcatttatgactaacaccaatcccggccctcgacggggtccctgccccgattcctctggcctccgaggtctggccacctcacgccctcccgtggcccatccacgtcgggcctccgggctggacggatggaggcttaggattacgttactgcctagtcccatcgacagcagcctgacgtcgtgctggtcggcggacggaccagctacgaccgtac

SEQ ID NO: 300807 - DNA, 622 bp, Homo sapiens
  misc_feature: GZ8MTXP02IUSSQ.51.75.G09.1.454.CMB.2.raw
  modified_base (231)..(231): a, c, t, g, unknown or other
  misc_feature (231)..(231): n is a, c, g, or t
  modified_base (319)..(319): a, c, t, g, unknown or other
  misc_feature (319)..(319): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggancagctccaacagtcggggcaggtaatgatgtacacgtggaccagcagcttaccaaggaacacgtacccccaaactcctactaatttanacgtacctaaacccaaccctaaacgtcccgggacccctacgaaccggggttccccctcggacccccgtaatttccctccgtcgggtcctcccgtaacgggttcctacgggcccacccgttccgacgtcccctccccgtcgggcccactaccgacgtcgggtcccgtccggggctacggagggatcgggaggccttggtaactttagttactcgtaccgtacgtacccatacgaacgacgacgacgtcctaggaggttcgtggtcgtcgggttcggggaccggacggggtaaccaacggtccgg

SEQ ID NO: 300808 - DNA, 669 bp, Homo sapiens
  misc_feature: GZ8MTXP02IXY8Y.51.75.G09.1.454.CMB.2.raw
  modified_base (238)..(238): a, c, t, g, unknown or other
  misc_feature (238)..(238): n is a, c, g, or t
  modified_base (344)..(344): a, c, t, g, unknown or other
  misc_feature (344)..(344): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcccagtctgtgctgacgcagccgccctcagtcgtctcggggccccagggcaggagggtcaccatcctcctgcacgtggggacncacgcctaccaacgacggtcggggactaaggtaatgatcgtaaccacgtcggaccagcacgtctaccgaaggaaccaccgtaccccaaacttcctactaatttacncgtaacctaaccccacctaacgtcccgtccctacggtaccggggttcccctccggtcccgtacttccgtccgtccggtccctaccggtacggttccgtcgccctacccgtcgacccgtccccgtcccgtcggtaccctacgtaccgtaccggtccggggtacccgtcccggggtcgtacgggacggtagtacgggacggtcttacgttaactttacgttaccgtcgacccgtacgtaccctagtacgaaccgcgaccgacgtccgtaggtacggtcggtcggttcggttacggggtacgggacgggtacggaaccgtacggtccg

SEQ ID NO: 300809 - DNA, 640 bp, Homo sapiens
  misc_feature: GZ8MTXP02IBQ4H.51.75.G09.1.454.CMB.2.raw
  modified_base (263)..(263): a, c, t, g, unknown or other
  misc_feature (263)..(263): n is a, c, g, or t
  modified_base (324)..(324): a, c, t, g, unknown or other
  misc_feature (324)..(324): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtcgtcggggccccagggcagagggtcaccatctcctgcacgtggggagcagctaccaacagtcggggcaaggtaangatgtacactggaccagcagctaccgaaggaacacgtaccccaaaactcctactaatttancgacctaaacccacctaaacgtccggccctacgacggggtcccctcgcccgtattcctcgtcggcctcgacggtcctcggcctacccgtccacgtccccttcccgtcggccctaacgtcccgtacgtccggggcccgttcccgggggcttacgggtaagggacgttgggaacggtcgttaggttaactttaacgttccgttcggaccctacggttaccccagtacggaccaaaggcccaacggtcccgttaggtacgttggtcggtccgttacggggttccgggggacggggtaaccggaaccgtaacggtcccgg

SEQ ID NO: 300810 - DNA, 589 bp, Homo sapiens
  misc_feature: GZ8MTXP02IQAI5.51.75.G09.1.454.CMB.2.raw
  modified_base (230)..(230): a, c, t, g, unknown or other
  misc_feature (230)..(230): n is a, c, g, or t
  modified_base (255)..(255): a, c, t, g, unknown or other
  misc_feature (255)..(255): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcagccgccctcagtgtcgtggggccccagggcagagggtccaccatctcctgcacgtgggancagctccaacatcggggcaggtaangatgtacactggtaccagcagcttaccaggaacacgtccccaaaactcctactatttatgactaaccacctaactcccggcccctcgacggggtccctcgccccgattccgtctcggcctccgaggtctggccacctcacggtccctcccgtggcccaactccgtacgtcggggccgtccggggctaggacggagtggtacggcttaggtaactttacgttaccgtgaccctacggttccccagtcgacctacgcgacgccgttaggagtcggtcgtccgttgggttccgggacgggaacgggaccaacggcgttacggaccccgtttacccgg

SEQ ID NO: 300811 - DNA, 556 bp, Homo sapiens
  misc_feature: GZ8MTXP02IVEGO.51.75.G09.1.454.CMB.2.raw
  modified_base (225)..(225): a, c, t, g, unknown or other
  misc_feature (225)..(225): n is a, c, g, or t
  modified_base (307)..(307): a, c, t, g, unknown or other
  misc_feature (307)..(307): n is a, c, g, or t
tcagcgatcgtatacacgaccggtgctcgatttagtatagacatcaggggcttcagctgtgggcacaagaggcagcactcaggacaatctccagcatggcctggtctcctctcctcctcactctcctcgctcactgcacagggtcctgggcccagtctgtgctgacgcagcccgccctcagtgtctgggccccagggcagagggtcacatctcctgcactgggancagctccaacagtcggggcaggtaatgatgtacactggtaccagcagcttccaggaacacgtaccccaaactcctcatttangactaacacaactcccggccctcgacggggtccctgccccgtattcctctggcctccgagtctggccacctcacgtccctcccgtggcccatccgaccttcgggccgtccgggctaggaggatgaggctaggatttacttacgcgtacctacgtaccacgacgacacgacgacgccgtagtacggtcgtcgtccggttacggtccgggacgggaacgggaacctaacggccgttacggacccgttaccg

SEQ ID NO: 300812 - DNA, 634 bp, Homo sapiens
  misc_feature: GZ8MTXP02JBKSP.51.75.G09.1.454.CMB.2.raw
  modified_base (306)..(306): a, c, t, g, unknown or other
  misc_feature (306)..(306): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgtacagggtcctgggcccagtctgtgctgacgcagccgccctcagtgtctggggccccagggcaggagggtcaccatctcctgcacgtgggagcagctccaacagtcggggcaggtaatgatgtacactggtaccagcagcttcaggacagtccccaaatcctcatttangactaaacaccaaatccggccccctcgacggggtcccctgcccgattctcgtcggcctccgaggtctggccacctcacgccctccctcggccagtcacgtcgggccgtccggggctggacggtatcggacggtctacggtactttaaacttaccgttggacccctaacggtttcccccaaagttcgggaaccaacggcccgtaacggccccgttacggtaacggtttcggtacggtaccggttcggtttacccgggggaaccggggtaaacggggaaccccgtaaagggccccgtttaacgggacccccggttacccgtttaaccggg

SEQ ID NO: 300813 - DNA, 745 bp, Homo sapiens
  misc_feature: GZ8MTXP02GAB4T.51.75.G09.1.454.CMB.2.raw
  modified_base (229)..(229): a, c, t, g, unknown or other
  misc_feature (229)..(229): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcaggagggtcaccatctcctgcacgtgggancagctaccaacagtcggggcaggtaatgatgtacactggtaccagcagcttccaaggaaccacgtacccccaaaactccctactattttacgtcgtaacctaaaccaaacccctaaacgtcccccgggtaccccccttacggtaaccgggggttcccccttcggacccccctaaatttcctcgtcgggccttccccgtagggttccgttcgggccctaacccgtccgaacccggtcccccttccccgttcgggacccctaactcccgtaaccggttccgggggtcccgttccccgggggccttaggggacgggtaagttcggggaacgggtcctttagggtaacttttaacgttaaccgtcggtaccctaacggtcccccaagttaccggaaaccaacggccgaaccggtcccgttgggaacggtttcgggtccgtcggtttaacggggttccggggaccggggtaaacggggaaccccgaaaggtccggtaacccggtaccccggtttaacccgg

SEQ ID NO: 300814 - DNA, 554 bp, Homo sapiens
  misc_feature: GZ8MTXP02GP6YE.51.75.G09.1.454.CMB.2.raw
  modified_base (228)..(228): a, c, t, g, unknown or other
  misc_feature (228)..(228): n is a, c, g, or t
  modified_base (305)..(305): a, c, t, g, unknown or other
  misc_feature (305)..(305): n is a, c, g, or t
  modified_base (312)..(312): a, c, t, g, unknown or other
  misc_feature (312)..(312): n is a, c, g, or t
  modified_base (398)..(398): a, c, t, g, unknown or other
  misc_feature (398)..(398): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcacgtgggancagcctaccaacagtcggggcaggtaatgatgtacacgtggtaccagcagcttccaggacacgtaccccaaatcctntatttangacctaacacctaactccccgccctcgacggggtccctcgccccgattccgtctcggctccgagtctcgccacctcacgcctccgnggcccatccacgtcgggcctccgggcgtgaggtagtcggagtcgtagtacttacgttacgtcgacctacgtcccaagtcgaacacgccagcctaggcgttcgtcgtcgttggtaacggacgggacggacccaaggtccgtacggtacccgttaccg

SEQ ID NO: 300815 - DNA, 477 bp, Homo sapiens
  misc_feature: GZ8MTXP02IDY3E.51.75.G09.1.454.CMB.2.raw
  modified_base (240)..(240): a, c, t, g, unknown or other
  misc_feature (240)..(240): n is a, c, g, or t
  modified_base (442)..(442): a, c, t, g, unknown or other
  misc_feature (442)..(442): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcacatctcctgcactgggagcagctccaanatcgggcaggtaatgatgtacactggtaccagcagcttccaggaacagtccccaaactcctcatttatgactaaccaccaatcggccctcgacggggtccctgcccgtatcctctggctcagtctgcactcagccctcctggccatcactggctcggctgaggatgaggctgattatactgcagtccatgacacgcacgccncgtgtgtgtcgtgttcggcggacggacgaacgccg

SEQ ID NO: 300816 - DNA, 586 bp, Homo sapiens
  misc_feature: GZ8MTXP02ISQUG.51.75.G09.1.454.CMB.2.raw
  modified_base (314)..(314): a, c, t, g, unknown or other
  misc_feature (314)..(314): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcagcccgccctcagtgtctggggccccagggcagagggtcaccatctcctgcactgggagcagcctccaacagtcggggcaggtaatgatgtacactggtaccagcagcttccaggaacacgtccccaaaactcctactattttancgacctaaccaaccaactcccggacccctcgacggggtccctcgccccgtattccgtctcggctcccaggtctgggccacctcacgtccctcccgcggcccactccgtacgtcggggtccgtccggggcgtggaacggtagttaggacgggtctagggtaactttacttacgtcgtcctaacgtccctaagtcgaacacggcaagtcccgtagacgtggtcgcgttgggtaacggcgggacggtaccgaacgtccgtcggaaccgtttcccg

SEQ ID NO: 300817 - DNA, 636 bp, Homo sapiens
  misc_feature: GZ8MTXP02I754Q.51.75.G09.1.454.CMB.2.raw
  modified_base (308)..(308): a, c, t, g, unknown or other
  misc_feature (308)..(308): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcagccgccctcagtgtcgtcggggccccagggcaggagggtcaccatctcctgcacgtgggagcagctccaacagtcggggcaggtaatgatgacactggtaccagcagcttccaggaacacgtccccaaatcctcattncgactaacaccaatcccggccctcgacggggtcccctgacccgtacttcctcgtcggtcctcccgaggtcgtcggcctaccctcgaccgccctcccgtcggcccactccgacgtcggggtcccgtccggggcttgggacggtatcggtacgggtccttaggtaactttacttaaccgtcggtaccccgtacggttacccctaagtacggaaccgtaacggccacggtcccgtaggtaacggttcggtacgtccggtttcgggttaaccgggggaccgggtaacggggtacccgaaacggtccgttaccgggtaaccccgtttacccgg

SEQ ID NO: 300818 - DNA, 641 bp, Homo sapiens
  misc_feature: GZ8MTXP02JCHTD.51.75.G09.1.454.CMB.2.raw
  modified_base (227)..(227): a, c, t, g, unknown or other
  misc_feature (227)..(227): n is a, c, g, or t
  modified_base (306)..(306): a, c, t, g, unknown or other
  misc_feature (306)..(306): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggancagctccaacagtcggggcaggtaatgatgtacactggtaccagcagcttccaggaacagtccccaaatcctcatttancgactaacaccaatcccggccctcgacggggtcccctacgccccgtattccgtctcgggtcctccgtacgggtcgtcgggcccacccgtcgacgtccccgtccctcgggcccaactcccgaacgttcgggggcccttccccgggggccttaggggaacgggtacgtacgggtacggtacccgttagggtaactttaacgttaccgttacgccgtaaacggttccccaagttacggaccgtaacggcgaacgcccgtagaacggttggtacggccgtttggttccggggacgggaacggggaacccgaaggtcccgtacggaacccgtttccccgg

SEQ ID NO: 300819 - DNA, 488 bp, Homo sapiens
  misc_feature: GZ8MTXP02FX1TA.51.75.G09.1.454.CMB.2.raw
  modified_base (228)..(228): a, c, t, g, unknown or other
  misc_feature (228)..(228): n is a, c, g, or t
  modified_base (305)..(305): a, c, t, g, unknown or other
  misc_feature (305)..(305): n is a, c, g, or t
  modified_base (412)..(412): a, c, t, g, unknown or other
  misc_feature (412)..(412): n is a, c, g, or t
  modified_base (456)..(456): a, c, t, g, unknown or other
  misc_feature (456)..(456): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtccctgggcccagtctgtgctgacgcagccgcccccagtgtctggggcccccagggcagagggtcacatctcctgcactgggancagctcaacatcggggcaggtaatgatgacactggtaccagcagcttccaggaacagtccccaaaactcctcattangactaaacaccaaactcggcccccctcgacggggtccctcgccccgattctctgggctcaggtctggcactcacgccctccctgcatcactgggctcgggctgagangaggctgattatactgccagtcccatcgacagcagcctgagtgngctgtcggcggaggaccagctgaccgtctacg

SEQ ID NO: 300820 - DNA, 597 bp, Homo sapiens
  misc_feature: GZ8MTXP02GI7MU.51.75.G09.1.454.CMB.2.raw
  modified_base (242)..(242): a, c, t, g, unknown or other
  misc_feature (242)..(242): n is a, c, g, or t
  modified_base (311)..(311): a, c, t, g, unknown or other
  misc_feature (311)..(311): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcccagtctgtgctgacgcagccgcctcagtgtcgtcgggccccagggcagaggtcaccatctcctgcacgtgggagcagctaccaanagtcggggacaggtaatgatgtacacgtggacagcagctacgagacacgtaccccaaatcctatattangtactaacccacctaacgtccggcccctacggacgggttccctggtaccctatttccgtccgtggtaccttccgacgggttcctacgaccctaccctcgaccgtcccctccgcgacctacgtccgacggtcgggtcccgtccgggactaggaggtagtacgggacgttactaggttaactttaacgtcgaccgtaccgtacgtacccagtacgaccgagccgacggtcgtagtacggtgtaacgtcccggttagggtaccggacggtaacggaacctaacggtccg

SEQ ID NO: 300821 - DNA, 589 bp, Homo sapiens
  misc_feature: GZ8MTXP02H4N9J.51.75.G09.1.454.CMB.2.raw
  modified_base (224)..(224): a, c, t, g, unknown or other
  misc_feature (224)..(224): n is a, c, g, or t
  modified_base (308)..(308): a, c, t, g, unknown or other
  misc_feature (308)..(308): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcagccgcctcagtgtctgggccccagggcaggaggtcacatctcctgcactgggancagcctcaacagtcggggacaggtaatgatcgtacactggtaccagcagcttccaggaaccagtccccaaaatcctacatttancgactaacacatcccggccctcgacgggtccctgccgtattctcgtacggcctccgaggtcctcgggaccctacctcgacggtcccctcccgtcggaccctaagttcccgaacgttcggggaccccttcggggaccttaggagggtaacttcggaggggtccttaggtaactttaaacgttccgacgttacccgacgttacccgagttacgaccgtagacgacgtcctaggacgtgtacgtccgttggtcggcggtacggaccgagtcgtacgaccgtccg

SEQ ID NO: 300822 - DNA, 646 bp, Homo sapiens
  misc_feature: GZ8MTXP02GVHAB.51.75.G09.1.454.CMB.2.raw
  modified_base (233)..(233): a, c, t, g, unknown or other
  misc_feature (233)..(233): n is a, c, g, or t
  modified_base (321)..(321): a, c, t, g, unknown or other
  misc_feature (321)..(321): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtcgtcggggccccagggcagaggtcaccatctcctgcacgtgggancagcctccaacagtcggggcaggtaatgatgtacactggtaccagcacgctaccaaggaacacgtacccccaaactcctactatttancgtactaaaccccaccaacgtccggcccctacggaccggggttccctcggcccgtattcctcgtcggcctccgaggtcctcggcccaccgtcaccgtccctcccgtcggaccctacgtcccgacgtcggggtcccgtacccggggtcgtagggtacgggacgttagggaacggtccgttagttaacgtttaacgtttacgtccgtaccgtaccgtccccgtaaacgtcgaaccgacggtaccctacggtcccgttaaggtaccggttggtcggttcggttcgggttaccgggggaccggggtaacggtacccgaaacggtcccgg

SEQ ID NO: 300823 - DNA, 611 bp, Homo sapiens
  misc_feature: GZ8MTXP02JPUFO.51.75.G09.1.454.CMB.2.raw
  modified_base (233)..(233): a, c, t, g, unknown or other
  misc_feature (233)..(233): n is a, c, g, or t
  modified_base (314)..(314): a, c, t, g, unknown or other
  misc_feature (314)..(314): n is a, c, g, or t
  modified_base (451)..(451): a, c, t, g, unknown or other
  misc_feature (451)..(451): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcccagtctgtgctgacgcagcccgccctcagtgtctggggccccagggcagagggtcaccatctcctgcacgtgggancagctccaacagtcggggcaggtaatgatgtacactggtaccagcagcttccaggaacagtccccaaactcctacatttangctaaacccaccaatccggccctcgacggggttccctgcccgatttcctcgtggccttccgaggttcctggcctacctcgacgccctccctcggccctatccgacgtcggggtcctcccggggcttacggacgggtnttgggaacggtccgttaggtaactttacgttacctgggtacccctaacggtccccctaagttcggaaccaacggccgtaacggtcccctaggtaacggttcgttcggtcggtttcgggtttaccggggcggggtaaacgggacccgtaaacggttcccgg

SEQ ID NO: 300824 - DNA, 512 bp, Homo sapiens
  misc_feature: GZ8MTXP02I59KX.51.75.G09.1.454.CMB.2.raw
  modified_base (226)..(226): a, c, t, g, unknown or other
  misc_feature (226)..(226): n is a, c, g, or t
tcagcgatcgtatacacgaccggtgctcgatttagtatagacatcaggggcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggancagctccaacatcggggcaggtaatgatgtacactggtaccagcagcttccaggaacagtccccaaatcctcatttatcgctaacaccaatccggccctcgacggggtccctgccccgtattctctcggctccaggtctggccacctcacgccctcccgtggcccatccacgtcgggcctccggggctggacggatgaggctgattatactgccagtccatcgacagcagcctagacgtcgtagccgttggtcggcggtacggaccaagccgtacgacccgttccg

SEQ ID NO: 300825 - DNA, 550 bp, Homo sapiens
  misc_feature: GZ8MTXP02IZKW2.51.75.G09.1.454.CMB.2.raw
  modified_base (242)..(242): a, c, t, g, unknown or other
  misc_feature (242)..(242): n is a, c, g, or t
  modified_base (316)..(316): a, c, t, g, unknown or other
  misc_feature (316)..(316): n is a, c, g, or t
  modified_base (349)..(349): a, c, t, g, unknown or other
  misc_feature (349)..(349): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacngtcggggcaggtaatgatgtacacgtggtaccagcagcttaccaggaacacgtaccccaaactcctacatttangactaaccaccaatcgccctcgacggggtcccngcccgtatcctcgtcgctcacggtctcggcacctcacgccctccgtcggccacgtcacgtcggccgtccgggctggacggtagtggaacggcttgtaactttacgttaactcgtaccacggtccccaagtcggaacacgcctacgtccgtgtacgtggtcgcgttcggttccggggacggtacggggacccgtaacgtccg

SEQ ID NO: 300826 - DNA, 614 bp, Homo sapiens
  misc_feature: GZ8MTXP02G02R6.51.75.G09.1.454.CMB.2.raw
  modified_base (230)..(230): a, c, t, g, unknown or other
  misc_feature (230)..(230): n is a, c, g, or t
  modified_base (319)..(319): a, c, t, g, unknown or other
  misc_feature (319)..(319): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcagcccgccctcagtgtctggggccccagggcaggagggtcaccatctcctgcacgtgggancagctccaacagtcggggcaggtaatgatgtacactggaccagcagcttccgaaggaaccacgtaccccaaaactccctactatttacncgacctaaacacctatccccggccctacgacggggtcccctggcccgtattcctctcggcctccgaggtctcggccacctcacgtcccgtcccgtcggcccactccgacgtcgggccgtccgggctaggaggtagtggacggtcgttaggtaattacttacgtcgacccgtacgttcccgaagtacggaccacggccaacggtcccgtaggtacggttcgtcggtaccgttcgggttaaccggggacggggtaacgggtaccgaaacggtccgtaccggtacccgttaaccccgg

SEQ ID NO: 300827 - DNA, 636 bp, Homo sapiens
  misc_feature: GZ8MTXP02GS5WP.51.75.G09.1.454.CMB.2.raw
  modified_base (233)..(233): a, c, t, g, unknown or other
  misc_feature (233)..(233): n is a, c, g, or t
  modified_base (317)..(317): a, c, t, g, unknown or other
  misc_feature (317)..(317): n is a, c, g, or t
  modified_base (393)..(393): a, c, t, g, unknown or other
  misc_feature (393)..(393): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtcgtggggccccagggcagagggtcaccatctcctgcacgtgggancagctccaacagtcggggcaggtaatgatgtacacgtggtaccagcagctaccgaggaacacgaccccaaatcctctatttacncgtacctaaacccaccaacgtccgaccctcgacggggtccctgccccgtattcctcgtcggacctccgaggttccncggtacccacccgtcgacgtcccctcccgtcggcctaacgttcccgaccgttcggggcccgtcccggggtctagggtaacggtacgtacgggacggtcgtaggtaactttaacgttaccgtacggtacccgtacgtaccctaagtcggaaaccgcgtaacccgacgggtccgttaggtacgttggtaaccggttcggtcggggttaccggggacggggaaaccgggtacccgaacggtcccgg

SEQ ID NO: 300828 - DNA, 669 bp, Homo sapiens
  misc_feature: GZ8MTXP02JKA59.51.75.G09.1.454.CMB.2.raw
  modified_base (235)..(235): a, c, t, g, unknown or other
  misc_feature (235)..(235): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtcgtggggccccagggcaggagggtcaccatcctcctgcacgtgggancagctaccaacagtcggggcaggtaatgatgtacacgtggtaccagcagcttaccgaaggaacacgtacccccaaactcctactatttatcgtactaaacccacctaagtccgccctcgacggggtccctcgacccgtattccgtcgtcggctccgagggttcctcggcctacccgtcgaccgtcccctcccgtcggcctactccgtacgtcggggtcccgtcccggggtactcgggtaacgggtacgtacgggtaagggtaccttaggtaacttttaacggttaaccgttccggaacccgtaacccgttaccccctaaagttacggaacccgtaacggaacccgtcggtacccgttaggtacggttcgtcggtccggtttaccgggggttccggggacccggggtaaccggggtaaacccgaacgggttcccg

SEQ ID NO: 300829 - DNA, 680 bp, Homo sapiens
  misc_feature: GZ8MTXP02JNHTK.51.75.G09.1.454.CMB.2.raw
  modified_base (228)..(228): a, c, t, g, unknown or other
  misc_feature (228)..(228): n is a, c, g, or t
  modified_base (324)..(324): a, c, t, g, unknown or other
  misc_feature (324)..(324): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcacgtgggancagctaccaacgagtcggggacaggtaatgatgtacacgtggtaccagcacgccttaccgaaggaaccaccgtaccccaaacttcctactatttanacgtaacctaaaccaaccgtaacgtccccggacccgtacggaccggggtcccctcggtacccgttacttccgtacgtcggtcctaccgtacggtccgtcggaccctaacccgttcccgaccgtccccgtacccgtcggaccctacgtacccgtacgggtcccgggggtccttaccgggggacgttagggaacgggtagtacggggtacgttacgttaacggttaactttaacgtaccgtaccggaccctaacgtacccgtagaccgacgtacgcgtaacggtccgttaggtacggtcgtaccggtcggttagggaaccggacggtaccgacgtcgtaccgttaccgaccgttaccg

SEQ ID NO: 300830 - DNA, 611 bp, Homo sapiens
  misc_feature: GZ8MTXP02FSS12.51.75.G09.1.454.CMB.2.raw
  modified_base (236)..(236): a, c, t, g, unknown or other
  misc_feature (236)..(236): n is a, c, g, or t
  modified_base (249)..(249): a, c, t, g, unknown or other
  misc_feature (249)..(249): n is a, c, g, or t
  modified_base (283)..(283): a, c, t, g, unknown or other
  misc_feature (283)..(283): n is a, c, g, or t
  modified_base (327)..(327): a, c, t, g, unknown or other
  misc_feature (327)..(327): n is a, c, g, or t
  modified_base (523)..(523): a, c, t, g, unknown or other
  misc_feature (523)..(523): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcccagtctgtgctgacgcacgcccgccctcagtgtcgtcggggccccagggcagagggtcaccatctcctgcacgtgggancagcctaccaacngtcggggcaggtaatgatgtacacgtggtaaccngcagccttaccaggaaccacgtaccccaaactcctactaattanacgactaacccaccaacgtccggaccctcggaccggggtccctcggacccgtattccgtccgtcgggtacctccgtagggtcctcggtaccctacccgtcaccggtcccttccccgtcggacccactccgaccgtcgggtacccgtccgggtctagggaggtacgtgggacggtaccttagtaactttagttaccncgtaccgtacgtccacgtacgacacgccgacgtcgtaggtcgtcggtcgtccggtacgggtaccggggacggacggaccgaacgtccg

SEQ ID NO: 300831 - DNA, 521 bp, Homo sapiens
  misc_feature: GZ8MTXP02FI2IT.51.75.G09.1.454.CMB.2.raw
  modified_base (357)..(357): a, c, t, g, unknown or other
  misc_feature (357)..(357): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcggggcaggtaatgatgacactggtaccagcagcttccaggaacagtccccaaaactcctacatttatgactaaacaccaatccccggcccctcgacggggtcccctgccccgattcncgtggcctccgaggtctgggccacctcacgccctcccgtggcccatcacgtcgggcctccgggctggagatggagctgattatactgccagtcccatcgacacgcagccgtgacggtgtcgcgtggtcggcgggtaacggacccaagtctacggacccgtaccg

SEQ ID NO: 300832 - DNA, 583 bp, Homo sapiens
  misc_feature: GZ8MTXP02GZIK7.51.75.G09.1.454.CMB.2.raw
  modified_base (229)..(229): a, c, t, g, unknown or other
  misc_feature (229)..(229): n is a, c, g, or t
  modified_base (239)..(239): a, c, t, g, unknown or other
  misc_feature (239)..(239): n is a, c, g, or t
  modified_base (315)..(315): a, c, t, g, unknown or other
  misc_feature (315)..(315): n is a, c, g, or t
  modified_base (396)..(396): a, c, t, g, unknown or other
  misc_feature (396)..(396): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcagcccgccctcagtgtcgtggggccccagggcagagggtcaccatctcctgcactgggancagctcaacngtcggggcaggtatgatgtacacgtggaccagcagcttaccgaggaaccacgtaccccaaactccgtactatttancgactaacacctaatccccggccctcgacggggtccctacggcccgtattccgctacggcctccgaggtctcggccacctnacgccctaccgtggcccatcacgttcggggccttccgggctaggacggagtcggacggtcttaggtaatttacgtactcgtacctacggttcccagtcgaactacggactcggacctagacggtcgtcgtcgttcgggtaaccgggcgggtaacggaccgaacggtccgtacggacccgttaaccgg

SEQ ID NO: 300833 - DNA, 604 bp, Homo sapiens
  misc_feature: GZ8MTXP02GIEKD.51.75.G09.1.454.CMB.2.raw
  modified_base (233)..(233): a, c, t, g, unknown or other
  misc_feature (233)..(233): n is a, c, g, or t
  modified_base (320)..(320): a, c, t, g, unknown or other
  misc_feature (320)..(320): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctcggggccccagggcagagggtcaccatctcctgcacgtgggancagctccaacagtcggggcaggtaatgatgtacactggtaccagcagcttccgaaggaacacgtaccccaaactccctactatttancgtactaacccaccaatccggccctcgacggggtccctcgcccgtattcctcgtcggcctccgacggtctcggccctaccctcgacgccctccctcggcccactccgacgtcgggcccgttccggggctaggacggtatcggagggtccttaggtactttacgttacgtcgacccgtaacgttccccaagttacggacaacggtccaacggtcccgtaaggtaggttcgtcggtccgttcgggtttcggggaccggggtaaacgggacccgtaaacggtcccgg

SEQ ID NO: 300834 - DNA, 580 bp, Homo sapiens
  misc_feature: GZ8MTXP02H0EEX.51.75.G09.1.454.CMB.2.raw
  modified_base (233)..(233): a, c, t, g, unknown or other
  misc_feature (233)..(233): n is a, c, g, or t
  modified_base (320)..(320): a, c, t, g, unknown or other
  misc_feature (320)..(320): n is a, c, g, or t
  modified_base (435)..(435): a, c, t, g, unknown or other
  misc_feature (435)..(435): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcacagtctgtgctgacgcagccgccctcagtgtcgtggggccccagggcagagggtcaccatctcctgcactggggancagctccaacagtcggggcaggtaatgatgtacactggtaccagcacgcttaccgaaggaacacgtaccccaaactcctctatttangccctaaacaccaaacgtccggcccctacgacggggtccctacgccccgtatttccctcgtcggccttccacggtctcggacctaccctcgacgtccctcccgtggcccactccncgtcgggccgtccggggtctggacggtatggacggtctaggtattaagttactgaccctacggtacccagttcggacaggtaccacgccttaggcgttggtcgcgttcggggttacggggacccgggtaaggggaaccctaacgg

SEQ ID NO: 300835 - DNA, 583 bp, Homo sapiens
  misc_feature: GZ8MTXP02IRLE6.51.75.G09.1.454.CMB.2.raw
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacagtcggggcaggtaatgatgtacactggtaccagcagcttccaggaacacgtaccccaaactccctactatttatcgacctaacaccaactcccggccctcgacggggtccctcgcccgtattctctcggcctccgaggtctcggcacctcgacgtccctcccgtcggccctatccacgtcggggccgtccgggcgtaggacggagtggaggtcttggtaatttacgttacgtcgcctacgtcccaagtcgaactacggcacggtccgtagtacggtcgtcggtcgttcgggttccgggacgggtaacggggaaccaacggtccgtaccggtacccggtttacccg

SEQ ID NO: 300836 - DNA, 647 bp, Homo sapiens
  misc_feature: GZ8MTXP02GMUH2.51.75.G09.1.454.CMB.2.raw
  modified_base (237)..(237): a, c, t, g, unknown or other
  misc_feature (237)..(237): n is a, c, g, or t
  modified_base (263)..(263): a, c, t, g, unknown or other
  misc_feature (263)..(263): n is a, c, g, or t
  modified_base (324)..(324): a, c, t, g, unknown or other
  misc_feature (324)..(324): n is a, c, g, or t
  modified_base (370)..(370): a, c, t, g, unknown or other
  misc_feature (370)..(370): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcccagtctgtgctgacgcagcccgccctcagtgtcgtcggggcccccagggcaggagggtcaccatctcctgcacgtgggancagctaccaacagtcgggcaggtaangatgtacacgtggtaccagcagcctaccgaggaacacgtaccccaaactcctactatttancgactaacccaccatccgccctcggaccggggtccctcgacccgtnttccgtcgtcggcctaccgagtccgtcggacccaccctcacccgtcccttacccgcggaccctacgttccgaccggttcggggtcccggtacccggggcgttacgggaagggtacgtgggaacggtccgttaaggttactttacgttaccgtccgaccccgtacggttacccctagtaccgaacgacgaccgtaacggtccgttaggtacggttgtaacggttccgttacggggttaccgggggaaccgggaacgggtaacccgtaacggtacccgg

SEQ ID NO: 300837 - DNA, 669 bp, Homo sapiens
  misc_feature: GZ8MTXP02GFE4K.51.75.G09.1.454.CMB.2.raw
  modified_base (229)..(229): a, c, t, g, unknown or other
  misc_feature (229)..(229): n is a, c, g, or t
  modified_base (240)..(240): a, c, t, g, unknown or other
  misc_feature (240)..(240): n is a, c, g, or t
  modified_base (255)..(255): a, c, t, g, unknown or other
  misc_feature (255)..(255): n is a, c, g, or t
  modified_base (323)..(323): a, c, t, g, unknown or other
  misc_feature (323)..(323): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcagccgccctcagtgtcgtcggggccccagggcagaggtcaccatctcctgcacgtgggancagcctccaangtcggggcaggtaanggatgtacacgtggtaccagcagtcttaccaaggaaccacgtacccccaaaacttcctactaatttanacgacctaaacacctaactcccccggcccctacgacggggtcccctcggacccgtattcctcgttcggccttacccgacgggttctcgggcctaccctcgaccgtccctcccgtgcccatccacgtcggcccgttcgggctaggacggtactggaggtccttaggttactttaacgttccgtcgtccccgtaacggttcccctagttaccgggaaaccgtacgaccgttacggtacccggtagggtacggttccggttacggtccggtttacgggggtaaccgggggaaccgggggtaaacccggtacccgtaaccgggtccgttacccgggtaccccgttacccg

SEQ ID NO: 300838 - DNA, 556 bp, Homo sapiens
  misc_feature: GZ8MTXP02HTTLO.51.75.G09.1.454.CMB.2.raw
  modified_base (309)..(309): a, c, t, g, unknown or other
  misc_feature (309)..(309): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcacgtgggagcagctccaacagtcggggcaggtaatgatgtacactggtaccagcagctccaggacacgtcccaaactctcatttangactaaccaccaactcggccctcgaccggggttccctcggcccgtatttcctcgttgcctccacggtctcggccaccctcacgcccttcccgtcggcccatccgacgttcggggcctccggggctggagggatggacggtctgtatttacttacgtgtaccctacgtccccagtacgacgaacgccgaacgtccctggtacgtggtcgtcgtcggtttccgggacgggtaacgggacctaaggcccg

SEQ ID NO: 300839 - DNA, 587 bp, Homo sapiens
  misc_feature: GZ8MTXP02GH1AB.51.75.G09.1.454.CMB.2.raw
  modified_base (278)..(278): a, c, t, g, unknown or other
  misc_feature (278)..(278): n is a, c, g, or t
  modified_base (320)..(320): a, c, t, g, unknown or other
  misc_feature (320)..(320): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtcgtcggggccccagggcagagggtcaccatcctcctgcacgtgggagcagctccaacagtcggggcaggtaatgatgtacactggtaccngcagcttaccaggaacacgtaccccaaactcctactatttancgtacctaacccacctaacgtccggacccctcgacggggttcccctcgccccgtattcctctcggctccgaggtctcggcccacctcacgccctcccgtcggccctactcctacgtcgggccgtccgggcgtggaggtatagggacgtctaggtatttacgttaccgtcgacccgtacgttaccccagttacgaacacgaccgacgtcccgtaggtacgttggtcgtcgttacgggttccggggacgggacgggaccaacggtcccg

SEQ ID NO: 300840 - DNA, 623 bp, Homo sapiens
  misc_feature: GZ8MTXP02IBPGJ.51.75.G09.1.454.CMB.2.raw
  modified_base (228)..(228): a, c, t, g, unknown or other
  misc_feature (228)..(228): n is a, c, g, or t
  modified_base (241)..(241): a, c, t, g, unknown or other
  misc_feature (241)..(241): n is a, c, g, or t
  modified_base (256)..(256): a, c, t, g, unknown or other
  misc_feature (256)..(256): n is a, c, g, or t
  modified_base (264)..(264): a, c, t, g, unknown or other
  misc_feature (264)..(264): n is a, c, g, or t
  modified_base (316)..(316): a, c, t, g, unknown or other
  misc_feature (316)..(316): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcagccgcctcagtgtctcggggccccagggcaggaggtcaccatctcctgcacgtgggancagcctccaacgngtcggggcaggtaangatgtacncgtggtaccagcagcttacgaggaaccacgtaccccaaactcctctatttancactaaccacaacgtccgccctcgacgggtccctgcccgtattcctcgtcgcctcgacggtctcggccctaccctcaccgtccctcccgtcggccctacgtccgacggtcgggccgttcccggggattacgggacgggtaacgtcggtacgggtccgttaggtactttacgttaacgtcgtaccgtaccggttacccagtcgaaccgacgtccgaacggtcctagggtacgttcgtcggtccgtttcggggtccggacggggaacgggtacctaacgggtccgtaccggtacccggtttaaccccgg

SEQ ID NO: 300841 - DNA, 583 bp, Homo sapiens
  misc_feature: GZ8MTXP02IYZCX.51.75.G09.1.454.CMB.2.raw
  modified_base (235)..(235): a, c, t, g, unknown or other
  misc_feature (235)..(235): n is a, c, g, or t
  modified_base (321)..(321): a, c, t, g, unknown or other
  misc_feature (321)..(321): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctcggggccccagggcaggagggtcaccatctcctgcacgtgggacncagctccaacagtcggggcaggtaatgatgtacactggtaccagcagccttaccaggaaccacgtaccccaaactcctctatttancgactaaccaccacgtccgaccctcgaccggggtccctcgccctattcctcgtcggctccgaggtcctggccaccgtcacgtccctccgtcgccagtccgacgtcgggtccgtccgggtctaggaggtacgtgggacggtccttaggtaactttaacgttaccgtcgacccgtacgtcccctaagtcgacgacggtcacggtcctaggacgttcgtcgtccgttacgggttaccgggacggtaacgggtacccaaggtcccg

SEQ ID NO: 300842 - DNA, 673 bp, Homo sapiens
  misc_feature: GZ8MTXP02F3TSC.51.75.G09.1.454.CMB.2.raw
  modified_base (235)..(235): a, c, t, g, unknown or other
  misc_feature (235)..(235): n is a, c, g, or t
  modified_base (246)..(246): a, c, t, g, unknown or other
  misc_feature (246)..(246): n is a, c, g, or t
  modified_base (324)..(324): a, c, t, g, unknown or other
  misc_feature (324)..(324): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcagcccgccctcagtgtcgtcgggggccccagggccaggacgggtcaccatctcctgcacgtgggancagctccaacngtcggggcaggtaatgatgtacacgtaggtaccagcagctaccgaaggaaccacgtaccccaaactcctactatttancgactaaaccacctaagtccccggcctcgacggggtcccctacgccccgttattccgtcgtcgggtccttaccgtaggtcgttacgggaccctacccgttccgaccggtccccttcccgtccgggacccaacgtccgaaccggttcggggtcccgttcccggggacgttaggacgggtacggttcgaacgggtcttagggttaacttacgttacgtcggaccttaacggtacccaagttccggaacacgccgtaacgtccgtaggtacggttgtcgtaacggtttcgggtaaccggggaccggggtaaacggtacccgaacggtccgtaccggtacccggtttaacccg

SEQ ID NO: 300843 - DNA, 588 bp, Homo sapiens
  misc_feature: GZ8MTXP02IXKDK.51.75.G09.1.454.CMB.2.raw
  modified_base (316)..(316): a, c, t, g, unknown or other
  misc_feature (316)..(316): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactggggagcagctccaacagtcgggcaggtatgatgtacacgtggtaccagcagcttaccaggaacacgtacccccaaactcctctatttangactaaccaccaactccggccctcgacggggtccctggcccgtattcgtctcggctccgaggtctgcacctcacgccctcccgtcggcctactccgaccgtcggggtcccgtcccggggtctacgggaggtacgttgggaacgggtcgtggtaacttttacgttaccgttcggaccctacgtccccaagtcggaacacggccacggcccgtaggtcgttcggtcgtccggttcgggttaccggggacgggtaaccggggaaccaacggtccg

SEQ ID NO: 300844 - DNA, 692 bp, Homo sapiens
  misc_feature: GZ8MTXP02FW0ZF.51.75.G09.1.454.CMB.2.raw
  modified_base (233)..(233): a, c, t, g, unknown or other
  misc_feature (233)..(233): n is a, c, g, or t
  modified_base (246)..(246): a, c, t, g, unknown or other
  misc_feature (246)..(246): n is a, c, g, or t
  modified_base (324)..(324): a, c, t, g, unknown or other
  misc_feature (324)..(324): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcagcccgccctcagtgtcgtcggggccccagggcaggacgggtcaccatctcctgcacgtgggancagcctccaacgngtcggggcaggtaatgatgtacacgtggtaccagcagcttaccgaaggaaccacgtaccccaaactcctactatttancgacctaaacaccaatccccgccctcgacggggtcccctgccccgtattccgtctcggcctcccgaggtctcggcctaccctcaccgtcccctcccgtcggaccctacgtccgtaccggtccggggtcccgttacccgggggcttaggggaacgggtacgttcggggaacggttccgttaggttaacgtttaacctttacgccggtacccctaacggttccccaagtaccgaaccgaacggccgtaacggtcccgttaagggtacggtttcggtaccggtccggtttacggggttcccgggggaaccggggtaaaccggggaaccccgtaacgggtccccgttaccggtaacccccggtttaacccgg

SEQ ID NO: 300845 - DNA, 518 bp, Homo sapiens
  misc_feature: GZ8MTXP02FGK6S.51.75.G09.1.454.CMB.2.raw
  modified_base (396)..(396): a, c, t, g, unknown or other
  misc_feature (396)..(396): n is a, c, g, or t
  modified_base (509)..(509): a, c, t, g, unknown or other
  misc_feature (509)..(509): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcacgtgggagcagctcaacagtcggggcaggtaatggatgtacactggtaccagcagcttccaggaacacgtaccccaaactcctactatttatcgactaacccaccaactcggccctcgacgggtccctcgcccgattctcgtgctccgagtctgccacctcacgccctcccngaccatcacgtcgggctccgggctgaggatggagtctagtattacgtcgcactcgaccagtacgacacgacacgtcgtaggtcgtgcgtcgttcggcgggacggacggaaccncggtacccg

SEQ ID NO: 300846 - DNA, 608 bp, Homo sapiens
  misc_feature: GZ8MTXP02GOC7Z.51.75.G09.1.454.CMB.2.raw
  modified_base (236)..(236): a, c, t, g, unknown or other
  misc_feature (236)..(236): n is a, c, g, or t
  modified_base (247)..(247): a, c, t, g, unknown or other
  misc_feature (247)..(247): n is a, c, g, or t
  modified_base (324)..(324): a, c, t, g, unknown or other
  misc_feature (324)..(324): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtcgtcggggccccagggcagagggtcaccgatcctcctgcacgtgggancagctccaacngtcggggcaggtaatgatgtacacgtggtaccagcagccttaccgaggaacacgtacccccaaactcctacatttancgactaacccacctaactccggcccctcgaccggggttcccctggccccgtattccgtaccgtcgggtcctacccgagggtccgtcgggccctaccctccgacgtccccctcccgtccggaccctaacgtccctaccggtcgggtcccgttcccggggcgttacgggaggtaacgttggacggtccgtaggtaattacgttacgtcgaccctacggtcccctagacgacgcgacgacgtccgtagcgttggtcgtcgtcggttcgggcggacggaccacgtccg

SEQ ID NO: 300847 - DNA, 633 bp, Homo sapiens
  misc_feature: GZ8MTXP02G4VCU.51.75.G09.1.454.CMB.2.raw
  modified_base (240)..(240): a, c, t, g, unknown or other
  misc_feature (240)..(240): n is a, c, g, or t
  modified_base (253)..(253): a, c, t, g, unknown or other
  misc_feature (253)..(253): n is a, c, g, or t
  modified_base (328)..(328): a, c, t, g, unknown or other
  misc_feature (328)..(328): n is a, c, g, or t
  modified_base (368)..(368): a, c, t, g, unknown or other
  misc_feature (368)..(368): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacgagggtcctgggcccagtctgtgctgaccgcacgccgccctcagtgtcgtcggggccccagggcaggagggtcacctatctcctgcacgtggggancagctaccaacgngtcgggcaaggtaatgatcgacacgtaggacagcagccttaccgagaaccacgtaccccaaatcctactatttancgtacctaacccaccactccgccctacgaccgggttcccncggccctattccgtaccgtcgcctaccgtacggtcgtcggaaaccctccctacgaccgtccccttacccgtcggacctacgtccgaccggttcgggccgtccggggacgtaggacggtacgtgggacgtcgtagttacgtttaactccgtacgacctacggtaccctaagtacgtaccgacgtaccgtacggtccgtagtacggttacggtcggttccggttacggggttaccgggaaggtaacccgggaccgtaacggtccccg

SEQ ID NO: 300848 - DNA, 608 bp, Homo sapiens
  misc_feature: GZ8MTXP02F9GGX.51.75.G09.1.454.CMB.2.raw
  modified_base (229)..(229): a, c, t, g, unknown or other
  misc_feature (229)..(229): n is a, c, g, or t
  modified_base (386)..(386): a, c, t, g, unknown or other
  misc_feature (386)..(386): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcagccgccctcagtgtctcggggccccagggcagagggtcaccatctcctgcacgtgggancagctccaacagtcggggacaggtaatgatgtaccacgtaggtaccagcacgtccttaccgaaggaaccaccgtacccccaaaactcctactatttatcgacctaaaccaccgtaatccccggacccctcgacggggtcccctgccccgtatttccncgtcggccttccgacggttctcggccctacctcgacgtcccctcccgtacggccctatccacggtcgggggccttcccggggcttgggacggtagtcggaacggtctagtattacgtactcgacctacggtcccagtgacgacgcacgtccgtagtaggtcgtcgtcgttcgggtccgggacgggaacggtaccgaacggtccgtaccggtaccgttacccg

SEQ ID NO: 300849 - DNA, 577 bp, Homo sapiens
  misc_feature: GZ8MTXP02IE2AT.51.75.G09.1.454.CMB.2.raw
  modified_base (240)..(240): a, c, t, g, unknown or other
  misc_feature (240)..(240): n is a, c, g, or t
  modified_base (270)..(270): a, c, t, g, unknown or other
  misc_feature (270)..(270): n is a, c, g, or t
  modified_base (309)..(309): a, c, t, g, unknown or other
  misc_feature (309)..(309): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctgggccccagggcagagggtcaccatctcctgcacgtgggagcagctcaangtcgggcaggtatgatgtacactggtaccngcagcttacaggaacagtaccccaaatcctactatttancgctaaccaccaatccgcctcgacgggtccctgcccgtatctctcggactcgaggtctgacctacctcacgtccctcccgtggcctagtccgaccgttcggggccgttcccggggcttagggacggagttcgggagggtccttaggtactttaacgttaccgtcgtaccgtaacggtcccctaagttcgacctacggccgacggtccgtaggtacggttggtcgtcgtttacgggttccggggacggacgggaacctaacggtcccgg

SEQ ID NO: 300850 - DNA, 673 bp, Homo sapiens
  misc_feature: GZ8MTXP02IJ3EY.51.75.G09.1.454.CMB.2.raw
  modified_base (232)..(232): a, c, t, g, unknown or other
  misc_feature (232)..(232): n is a, c, g, or t
  modified_base (330)..(330): a, c, t, g, unknown or other
  misc_feature (330)..(330): n is a, c, g, or t
  modified_base (416)..(416): a, c, t, g, unknown or other
  misc_feature (416)..(416): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcagccgccctcaggtgtcgtgggggccccagggcaggagggtcaccatctcctgcacgtgggancagcctacaacagtcggggcaaggtaatcgatgtaacacgtacggtaccagccagtcttaccgaaggaaccacgtaccccaaaactcctatactttancgtactaaacgaacctaacgtcccggaccctagaccggggtccctgtaccccgtattccgtacgtcggtcctaccgtacgggttcncggtaccaccgtcacgtccctccgcggtacctactcgaccgtcgggccgttacccgggacgtagggtacggtacgcgggtaacggtccgtagggtaaaacctttagttaacccgttccggaccctacgggttacccccagttaccggaaacccgtacggtaccgacggtaccgttaggtacgttacggtcggttacggttacgggtaaccggggtacggaaccggaccgtacggtccggttaccggtacccgtaccg

SEQ ID NO: 300851 - DNA, 639 bp, Homo sapiens
  misc_feature: GZ8MTXP02GPI3A.51.75.G09.1.454.CMB.2.raw
  modified_base (331)..(331): a, c, t, g, unknown or other
  misc_feature (331)..(331): n is a, c, g, or t
  modified_base (445)..(445): a, c, t, g, unknown or other
  misc_feature (445)..(445): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcccagtctgtgctgacgcagcccgccctcagtgtctcggggccccagggcaggagggtcaccatcctcctgcacgtggggagcagcctaccaacagtccggggcagggtaatggatgtacacgtggtaaccagcagcttaccaaggaaccacgtaccccaaactcctactatttanacgacctaaacccaacctaacgtccggccccttacgaccggggttcccctcgccccgtattcctcgtcggtcctccgagtcctggaccctaccctcgacgtcccccttccccgnggtaccctaacgttcccgacgtcgggggtacccgttcccggggcttacggggaagggtatacgggagggtccttaaggtaactttaaccgttccgtccggacccctacgttacccccaagtcgaaccacgaccgtacgtcccgtaggacgtttgcgtccgttggtaccggggacgggaacggaccgtagtcccg

SEQ ID NO: 300852 - DNA, 578 bp, Homo sapiens
  misc_feature: GZ8MTXP02G6I7Y.51.75.G09.1.454.CMB.2.raw
  modified_base (237)..(237): a, c, t, g, unknown or other
  misc_feature (237)..(237): n is a, c, g, or t
  modified_base (371)..(371): a, c, t, g, unknown or other
  misc_feature (371)..(371): n is a, c, g, or t
  modified_base (404)..(404): a, c, t, g, unknown or other
  misc_feature (404)..(404): n is a, c, g, or t
  modified_base (418)..(418): a, c, t, g, unknown or other
  misc_feature (418)..(418): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcccagtctgtgctgacgcacgccgccctcagtcgtcgtcggggccccagggcaggaggtcaccatctcctgcacgtgggacncagctaccaactaggtccggggacaggtaatgagtcgtacacgtggtaccagcagccttacgacgaacacgtaccccctaaactcctactatttagcgtactaaaccaccaacgtccgccctcgacgggtcccncggtccctattcctcgtcggtcctccgagttcncggccacctcgacnccctcctcggccactcgacgtcgggtccgaccgggtctggaagtcgtacgggagtccgtagttattacttacgtcgaccgtactcccaagcgtaacgcggtaccacgtcgtaggtacgttcgtaacggtcgtcgggtacggacggacgtaccgacgtccg

SEQ ID NO: 300853 - DNA, 669 bp, Homo sapiens
  misc_feature: GZ8MTXP02G3A0M.51.75.G09.1.454.CMB.2.raw
  modified_base (232)..(232): a, c, t, g, unknown or other
  misc_feature (232)..(232): n is a, c, g, or t
  modified_base (244)..(244): a, c, t, g, unknown or other
  misc_feature (244)..(244): n is a, c, g, or t
  modified_base (374)..(374): a, c, t, g, unknown or other
  misc_feature (374)..(374): n is a, c, g, or t
  modified_base (379)..(379): a, c, t, g, unknown or other
  misc_feature (379)..(379): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcagcccgccctcagtgtcgtcggggccccagggcaggagggtcaccatctcctgcacgtgggancagctccaacgngtcggggcaggtaatgatgtacacgtggtaccagcagtcttaccgaggaaccacgtaccccaaaacttcctactatttactcgacctaaacacctaatcccacgccctcggacggggtccctcgcccgtnttccncgtcggcctccgaggtctcggccctacctccgaccgtcccctccgtcgaccctatccgtaccggtcggggtcccgtccggggtacgttacgggaaacgggtcgttacggacggttccgttagtttaaccgtttactttaacccgcgtaccccgttaccggtaccctaagttccggaaccgtaacggcctaacggtccgttacggtacgttcggttcgttcgggtttaacgggttacccggggacggggtaaaccgggaacctaacggtccggttacccggtaaaccccgg

SEQ ID NO: 300854 - DNA, 704 bp, Homo sapiens
  misc_feature: GZ8MTXP02GMQF4.51.75.G09.1.454.CMB.2.raw
  modified_base (234)..(234): a, c, t, g, unknown or other
  misc_feature (234)..(234): n is a, c, g, or t
  modified_base (328)..(328): a, c, t, g, unknown or other
  misc_feature (328)..(328): n is a, c, g, or t
  modified_base (370)..(370): a, c, t, g, unknown or other
  misc_feature (370)..(370): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcacgcccgccctcagtgtcgtcggggccccagggcaggagggtcaccatcctcctgcacgtgggancagctaccaacgaggtcgggacaaggtaatgatcgtacacgtggtaccagcagtctaccgaaggaacaccgtaaccctaactcctactatttancgtactaacacctaactcccgccctacgacggggttcccccncgtaccccgtatttccgtacgtcggtaccgttccgaacggggttcgtcggaccctacccgttaccgaccgtccccgtaccccgttggaccctaacgtccccgtaacggtccgggggtcccgtaccccgggggtcgttaggggaacggtacgttacgggaccggtacgttaggtaactttaacgtacgttaccgaccgtaaccgttcccaagttacgaacgtacgaccgttaacggcttaaagggccgttgtaacgtcggttcgggtaacccggggtaacggggtaaaccggaaccgaaacggttccccgtacggtaacccccggtttaacccgg

SEQ ID NO: 300855 - DNA, 615 bp, Homo sapiens
  misc_feature: GZ8MTXP02FRDS4.51.75.G09.1.454.CMB.2.raw
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacacgggtcctgggcacagtctgtgctgacgcacgcccgccctcagtgtcgtcggggccccgagggcaggacgggtcacctatcctcctgcacgtggggacgcacgcctaccaacgaggtcggggacaaggtaatgatacgtacacgtcgaccagcagtctacgaaggaaccaccgtaccccaaacttcctactatttactacgaaccctaaaccacctaacgtcccggtcccgtacggaccgggttccctccgacccgttacttccgtcgtcgctcccgagtcgtacgaccacctcaccgtccctccgtacgtcccatccgacggtccgggtccgtccgggcgtaggacggtacgtacgacggtctagttaacttacgtacctcgacctacgttaccagtacgaccgactacgacgtacgtagtagtcggtcgcggttacgggtaccggggacggaaccgggtactaaccgg

SEQ ID NO: 300856 - DNA, 771 bp, Homo sapiens
  misc_feature: GZ8MTXP02JT9BE.51.75.G09.1.454.CMB.2.raw
  modified_base (709)..(709): a, c, t, g, unknown or other
  misc_feature (709)..(709): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctcggggccccagggcaggagggtcaccatcctctgcacggtgggacgcgacgcctaccgaaacgcgggtccggggacgtaaggttaagtggtaacgttacggtaacctaccggttacgggtaaccccacggaccgtaacggtacccgtttaacccggaaaacgggtaaacccgtaaacccccggttaaacccccctaaaaccctttccccttaactttaaacgttttacgtaccgtaaacctaaaaccccctaaccccgtaaaccgtcccccggtacccccgttacggggtaaccccggggttcccctcccgggtaaccccgttacgtttcccgtcgtccggtacccgtcccggtacgggttcctccggaccctacccgtacgcccgttcccccttccggccgaccctacgtcccgtacgggtccgggtcccggtcccggggtgtaaggggacgtagtcgggacgttcgtaaggttactttacgtcgccgtacccgtacgtcccagtacgacgacgaccncggtctagggtcgttggcgtccggttcggggacgggacggggaaccgtaccgtaggtcccgg

SEQ ID NO: 300857 - DNA, 545 bp, Homo sapiens
  misc_feature: GZ8MTXP02FTQEY.51.75.G09.1.454.CMB.2.raw
  modified_base (308)..(308): a, c, t, g, unknown or other
  misc_feature (308)..(308): n is a, c, g, or t
  modified_base (361)..(361): a, c, t, g, unknown or other
  misc_feature (361)..(361): n is a, c, g, or t
  modified_base (442)..(442): a, c, t, g, unknown or other
  misc_feature (442)..(442): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcggggcaggtaatgatgtacactggtaccagcagcttccaggaacacgtccccaaactcctacatttangacctaaacaccaatccccggacccctcgacggggtccctgccccgtattccnctggcctccgaggtctggccctaccctcaccgccctcccgtcggcccactccacgttcggggcctcccggggctaggaggntgggaggcttagtattacgttactgcctagtcccatgacagcagcctagacgtgtcgtcgttggtcgggcgggaacggacccagtcctacggacccgttaccg

SEQ ID NO: 300858 - DNA, 649 bp, Homo sapiens
  misc_feature: GZ8MTXP02FOBYZ.51.75.G09.1.454.CMB.2.raw
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcccagtctgtgctgacgcacgcccgccctcgagtcgtccgtcggggccccaggggcaggacgggtccaccatcctcctgcagtgggagcagctaccaacagtcgggcaggtaatgatgtacacgtgtacagcacgcttacgaagaaccacgtaccccaaactctactagtttacacgtacctaacccaccacgtcccggaccctcggtaccgggtcccctcggcccgtacttccgtccgtcggcctaccgtacggttccgtcgaccctcctacgccgtcccctaccgtccgacctacgtaccgaccgggttccgggtcccggttccccggggagtacgggtacgggtagttacggggtacggtacgttaagggttactttaaacgttccgtaccgtcccgtaaacggttccctagtccgaacacggccgacgtccgtacggtgttcggtcgttcgggttcggtaccgggaggggtaaccgaccgacggtacccg

SEQ ID NO: 300859 - DNA, 709 bp, Homo sapiens
  misc_feature: GZ8MTXP02FNTNZ.51.75.G09.1.454.CMB.2.raw
  modified_base (228)..(228): a, c, t, g, unknown or other
  misc_feature (228)..(228): n is a, c, g, or t
  modified_base (239)..(239): a, c, t, g, unknown or other
  misc_feature (239)..(239): n is a, c, g, or t
  modified_base (312)..(312): a, c, t, g, unknown or other
  misc_feature (312)..(312): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcacgtgggancagctccaacngtcggggcaggtaatgatgtacactggtaccagcagctaccaggaacacgtaccccaaactcctactatttangacctaacacctaacgtccccggcccctacggacggggttcccctacggtcccccgtaatttccgtcgtcggtcctccgtaggtctacgggaccctacccgttcgaccggtcccctacccgtacggacccaacgtcccgtaacggtccgggggtacccgttcccgggggccttacggggaacgggtaagttacggggaacgggtcctttaagggttaactttaaccgttaacccgttcggaccccgtaaaccggttccccctaaagttcgggaaaccctaacgggtccaaacggttcccggtaaggtacggttcgtcggtccgtttcgggggttaacccgggacggggtaaacggggaccctaacgggtccgtacccgggtaaccccgtttacccgg

SEQ ID NO: 300860 - DNA, 703 bp, Homo sapiens
  misc_feature: GZ8MTXP02FSG95.51.75.G09.1.454.CMB.2.raw
  modified_base (227)..(227): a, c, t, g, unknown or other
  misc_feature (227)..(227): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcagccgcctcagtgtctggggccccagggcagagggtcaccatctcctgcacgtgggancagctccaacagtcggggcaggtaatgatgtacactggtaccagcagcttcgaggaacacgtccccaaaactcctactactttactcgacctaaacaccaactcccgacccctcgacggggttccctacgccccgtatttccgtccgtcggtccttacccgaggttccgtcgggacccaacccttccgaacccggtcccttcccccgttacgggcccctaacgtcccgtaccgtccggggtccgtcccgggggtccttcggggaacgggtaagttcgggaggtcccgttaacgggttaattttaaccgttaaccgttcggacccgttaacggttcccccaagttaccgaacgtacggaccgaacggttcccgtaggtaacgggttcgtcggtaaccggtttcggggttaaccggggaccggggtaaacggggttaacccaaacgggtcccgttaccgggtacccgtttaaccccgg

SEQ ID NO: 300861 - DNA, 620 bp, Homo sapiens
  misc_feature: GZ8MTXP02J057J.51.75.G09.1.454.CMB.2.raw
  modified_base (226)..(226): a, c, t, g, unknown or other
  misc_feature (226)..(226): n is a, c, g, or t
  modified_base (270)..(270): a, c, t, g, unknown or other
  misc_feature (270)..(270): n is a, c, g, or t
  modified_base (316)..(316): a, c, t, g, unknown or other
  misc_feature (316)..(316): n is a, c, g, or t
  modified_base (368)..(368): a, c, t, g, unknown or other
  misc_feature (368)..(368): n is a, c, g, or t
  modified_base (447)..(447): a, c, t, g, unknown or other
  misc_feature (447)..(447): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagaggtcaccatctcctgcactgggancagctccaacagtcggggcaggtaatgatgtacactcggtaccngcagccttaccgaggtaaccacgtaccccaaactcctacatttacngacctaaacaccaactccccggccctgacggggtcccctgccccgtattccncgtcggcctcgaggtctggccaccctcacgccctccgtggccatcacgtcgggccttccggggctagggacggtacggnggtacggtcgtacgttacgttacgttaccgtacgtaccgtaccgtacccgtacgtacgacgtaccgacgtacgtaccgtacggtacggtcggtacggtaccggttacgggttaaccggggtaccggggaaccgggtaccggtaaccggtaccggtaccggtacccggtacccg

SEQ ID NO: 300862 - DNA, 710 bp, Homo sapiens
  misc_feature: GZ8MTXP02F6915.51.75.G09.1.454.CMB.2.raw
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcagcccgccctcagtgtcgtcggggccccagggcaggagggtcaccatctcctgcacgtgggagcagctaccaagagtcggggacaggtaatgatagtaccacgtcggtaccagcagtcttaccgaaggaaccacgtaccccaaacttcctactatttactcgacctaaacaacctaagtccccggaccctaccgacggggtccctacgcccgtattccgtccgtggtacctacccgtaggtcctacggaccctacccgtactaccgtccctcccgtcggaccctacgtccgtacggtccggccgtccgggcttacgggaggtatcgggtaggtccttaggtaactttaaccgtttacgaccgtaccccgtaacgttacccccgaagttaccggaaccgtaaaccggtccgaaaccggtccgttacggggtacgttcgggttaccgtacccggtttgggggtaaccccgggggaaccgggggttaaccgggtaaaaccgaccggggtaacccggttccggtaaccccccgtttaaccccggg

SEQ ID NO: 300863 - DNA, 568 bp, Homo sapiens
  misc_feature: GZ8MTXP02GRKWX.51.75.G09.1.454.CMB.2.raw
  modified_base (236)..(236): a, c, t, g, unknown or other
  misc_feature (236)..(236): n is a, c, g, or t
  modified_base (247)..(247): a, c, t, g, unknown or other
  misc_feature (247)..(247): n is a, c, g, or t
  modified_base (321)..(321): a, c, t, g, unknown or other
  misc_feature (321)..(321): n is a, c, g, or t
tcagcgatcgtatacacgaccggtgctcgatttagtatagacatcagggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtcgtcggggccccagggcaggagggtcaccatctcctgcacgtgggancagctccaacngtcgggcaggtaatgatgtacacgtggtaccagcacgctaccgaggaacacgtaccccaaactcctactattancgactaacccaccaactccgacctcgacgggtcctcgccctattcctcgtcggcctccgacggttcgcgacccacctcaccggtcccttcccgacggccctagtccgacgtcgggccctccgggactggacggagtcggacggtctagtactttacgtacgcgacctacgtacccagtacgacacgtcacgtccgtaggtagttcgtcgtcggtcggtaccgggacggaaccggaccaacgtcccgg

SEQ ID NO: 300864 - DNA, 696 bp, Homo sapiens
  misc_feature: GZ8MTXP02JZ758.51.75.G09.1.454.CMB.2.raw
  modified_base (236)..(236): a, c, t, g, unknown or other
  misc_feature (236)..(236): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcccagtctgtgctgacgcacgcccgccctcagtgtcgtcggggccccagggcaggagggtcaccatcctctgcagtgggancacgctaccaacagtcggggacaaggtaatggtatacgtactacgtcggtaccaggctacgtctaccgaacggaacctacccgtaccccctaaacgttccctacttaatttacgtacgtaacctaaacccctaacccgtaaacgtcccccggtacccccgttacggtaacccggggttccccctccgggtacccccgttaactttcccgtaccgtccgggtacccctccggttaacgggtcccgttacgggaccctacccgtactacccggtcccccgttcccggtcggaccctacgtcccgacggtccgggtacccgtccgggtctagggaggtactggggtacgtctacggtttaattaccgtacttaccgaccgtacgtaccctagaccgacgcgtaccacggccgtaacgtgtcgtcgtcgttacgggtaccgggacggaccggaacacgtcccgg

SEQ ID NO: 300865 - DNA, 610 bp, Homo sapiens
  misc_feature: GZ8MTXP02I7XW7.51.75.G09.1.454.CMB.2.raw
  modified_base (246)..(246): a, c, t, g, unknown or other
  misc_feature (246)..(246): n is a, c, g, or t
  modified_base (259)..(259): a, c, t, g, unknown or other
  misc_feature (259)..(259): n is a, c, g, or t
  modified_base (386)..(386): a, c, t, g, unknown or other
  misc_feature (386)..(386): n is a, c, g, or t
  modified_base (472)..(472): a, c, t, g, unknown or other
  misc_feature (472)..(472): n is a, c, g, or t
  modified_base (479)..(479): a, c, t, g, unknown or other
  misc_feature (479)..(479): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacgagggtcctgggcccagtctgtgctgaccgcacgcccgccctcgagtcgtccgtcggggccccagggcaggacgggtcaccatcctccgtgcacggtgggancacgcctaccaanggtcggggcaaggtatgatcgtacacgtacggtacagcacgtctaccgaacgaaccaccgtacccaactctactattacataccaccacctacgtccgacctcggaccggtcctcgccgtacttccncgtcgtctaccggtaggtcccgtacgaccctaccgtaccgccctcccgtcccgtcgacctcgtaccgcgtccggggtacctccggngtacggngtacgtggacgttctacgtatttccgtacgcggtacgtccgtactacggacgaacgtcgtaccgtacgtccgtacggtgttcgtcgtccgggttcgggaccggggacgacccggggtacctacggtcccgg

SEQ ID NO: 300866 - DNA, 652 bp, Homo sapiens
  misc_feature: GZ8MTXP02I0CRC.51.75.G09.1.454.CMB.2.raw
  modified_base (232)..(232): a, c, t, g, unknown or other
  misc_feature (232)..(232): n is a, c, g, or t
  modified_base (245)..(245): a, c, t, g, unknown or other
  misc_feature (245)..(245): n is a, c, g, or t
  modified_base (269)..(269): a, c, t, g, unknown or other
  misc_feature (269)..(269): n is a, c, g, or t
  modified_base (325)..(325): a, c, t, g, unknown or other
  misc_feature (325)..(325): n is a, c, g, or t
  modified_base (364)..(364): a, c, t, g, unknown or other
  misc_feature (364)..(364): n is a, c, g, or t
  modified_base (397)..(397): a, c, t, g, unknown or other
  misc_feature (397)..(397): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcagcccgccctcagtgtcgtcggggccccagggcaggagggtcaccatctcctgcacgtgggancagcctaccaagngtcggggcaaggtaatgatgtacncgtaggaccagcagccttaccgaaggaaccacgtaccccaaactcctactatttancgacctaaccacaactccccgccctacgacgggtccccngtccccgtattcctcgtggcctaccgtaggtcncgggaccctaccgtccgacgcccctcccgtcggaccctacgtccacgtccggggcccgtccgggtacgtagggaggtacgtaggtacggtccgttaggttaacttaacgttccgtaccgaccgtaccgttaccccagttacgaaccgtacgacctacggtccgtagggttacgttcggtccggttacggttaccgggttccggggacggggaaccggtaaccgtaacgtccggtacccggtacccggtttacccg

SEQ ID NO: 300867 - DNA, 766 bp, Homo sapiens
  misc_feature: GZ8MTXP02GUEJQ.51.75.G09.1.454.CMB.2.raw
  modified_base (185)..(185): a, c, t, g, unknown or other
  misc_feature (185)..(185): n is a, c, g, or t
  modified_base (240)..(240): a, c, t, g, unknown or other
  misc_feature (240)..(240): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcccagtctgtgctgacgcacgcccgccctnagtcgtcgtcggggccccagggcaggacgggtcaccatctcctgcacgtgggacncacgctacgaacacgtcgggcaggtaatgatagtacacgtacgacagcacgcttaccgagaactaccgtacccctaactcctactatttacacgtactaaaccgacctaacgtccggtaccctacggtaccggggttccctccgggtacctactttccgtaccgtcggtacctccggtacggttccgtacggtaccctaccctaccgtacccgtccccgtttcccgtaccgggtaccttaccgtaaccgttccgggtccggggttacccgggttcccggggtaccggttacggggacgggttaaccggttacggggtaacggttaccgttaacggttaacgtttttaaaccgttaccggttacgtaccccggtttaaccgggtaaccccttaaggttaccgaaaccggttacggaccgtaaacgtttccggggttacgtccggtttaacggtcgggtttccggttaccggggttaaccgggggtacccggggaaaccggttaaccgggtaaccgtttaccccgggg

SEQ ID NO: 300868 - DNA, 588 bp, Homo sapiens
  misc_feature: GZ8MTXP02JBWWO.51.75.G09.1.454.CMB.2.raw
  modified_base (226)..(226): a, c, t, g, unknown or other
  misc_feature (226)..(226): n is a, c, g, or t
  modified_base (257)..(257): a, c, t, g, unknown or other
  misc_feature (257)..(257): n is a, c, g, or t
  modified_base (264)..(264): a, c, t, g, unknown or other
  misc_feature (264)..(264): n is a, c, g, or t
  modified_base (282)..(282): a, c, t, g, unknown or other
  misc_feature (282)..(282): n is a, c, g, or t
  modified_base (320)..(320): a, c, t, g, unknown or other
  misc_feature (320)..(320): n is a, c, g, or t
  modified_base (403)..(403): a, c, t, g, unknown or other
  misc_feature (403)..(403): n is a, c, g, or t
  modified_base (412)..(412): a, c, t, g, unknown or other
  misc_feature (412)..(412): n is a, c, g, or t
  modified_base (505)..(505): a, c, t, g, unknown or other
  misc_feature (505)..(505): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcccagtctgtgctgacgcacgccgccctcagtcgtcgtcggggccccagggcagacggtcaccgatctccngcacgtggagcagctaccaagcgtcgggganaggtaangatcgtacacgtgtaccngcagctacgagacacgtaccccaaatcctatagtttancgaacctaaacccgacctaacgtcccgacccttacggaccgggttcccctcgggcccttattctcgtcgctccgtaagttccncgccctacnccgacgtcccctccgtcgacctacgtccgacgtccggggcctcccgggtaaagtcggaagtagtgggaaagtcgtaagttacttaccgtaacnccgtaccgtacgactacgtacgacgacgcgtacgtcgtacgtagtcgtcgtcggtacggtacggacggacggaccgacgtacg

SEQ ID NO: 300869 - DNA, 714 bp, Homo sapiens
  misc_feature: GZ8MTXP02JK45F.51.75.G09.1.454.CMB.2.raw
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacgagggtcctgggcccagtctgtgctgacgcacgcccgcctcagtcgtccgtcggggccccagggcaggacggtccaccattcctcctgctacgtgggacgccagcctaccaaacgtcggtacggggacaagggttaatgtacgtacgtaacctaccgttacgggtaaccaagaccgacgtaccgttaacccgaaaggaaaccctaacccgtaacccccctaaaacttcccctaacgtttaatttaacgcgtaaacccttaaaccgaacccgtaaacgtccccccggtaccccgtacggtaaccggggtcccctacggacccgttacgtttcctcgtcggcccttaccgtaggttcccgtcggtaccctaccctcacccgtcccgtacccgtcggaccctacgtcccgtacggtcgggtcccgtaccgggtcgtaggacggtagtcggtacgtcgttagtacttacgtacgtcgtaccgtacgtacccagtacgacgtaacgccgcgtccgtaggtcggtcgtcggtcgttacggggcggtacgggacgtaccgacgtccgtaccggacctaccg

SEQ ID NO: 300870 - DNA, 726 bp, Homo sapiens
  misc_feature: GZ8MTXP02IOXPT.51.75.G09.1.454.CMB.2.raw
  modified_base (228)..(228): a, c, t, g, unknown or other
  misc_feature (228)..(228): n is a, c, g, or t
  modified_base (318)..(318): a, c, t, g, unknown or other
  misc_feature (318)..(318): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcagccgccctcagtgtctcggggccccagggcagaggtcaccatctcctgcacgtgggancagctccaacagtcgggcaggtaatgatgtacactggtaccagcagcttaccaaggaaccacgtaccccaaaactcctactaagtttacncgtacctaaaccacctaacgtcccccggtcccctacgtaccggggtccctcggaccccttattcctcgttcgcctaccgaggtcctcggccctaccctacgacccgtccctacccgtcggaccctacgtccacggttcggggcccgttccggggcgtagggaagggtacgtcgggtagggtaccgttagttaaacgtttaccgtttaaaccgtccggtaacccgtaaccgttacccgttaacgtacgtaaacccgacggaaccgtaaccgtcccggttaaagggtaccgggtttacggttaccggttaccggtttcgggggttaaaccgggggtaccgggggaaaaccggggttacccggaaaaggttccccggtttaaaccgggtacccccggtttaaaccccgggg

SEQ ID NO: 300871 - DNA, 667 bp, Homo sapiens
  misc_feature: GZ8MTXP02IS55C.51.75.G09.1.454.CMB.2.raw
  modified_base (254)..(254): a, c, t, g, unknown or other
  misc_feature (254)..(254): n is a, c, g, or t
  modified_base (352)..(352): a, c, t, g, unknown or other
  misc_feature (352)..(352): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcacgcccgccctcagtgtccgtcgggggccccagggcaggacgggtccaccattcctcctgcacgtgggacgcacgcctaccaacnggtcggggacaggttaatggatgtaacacgtcggtaaccagaccacgtcttaccgaacggtaaccctaaccgtaccccaaaacttcctacttatttanacgtacctaaccaaacctacgtccccggcccctacgtaccggggtcccctcggtaccccttacttccgtcgtacgcctaccgtacggtcacgggccctaccgtcgaccgtccctccgcgtaccactccgacggtcggccgttcgggcgtaggacggtagtacggcgttacgtagtacttacgttacgtacgaccgtacgtaccacgttacgacgtacgtacgtaacggtccgtaaggtcggttcggtcggtccgttcgggtaacggggacggggaacggaacgtacggttccgtacccggaccgtttaacccggg

SEQ ID NO: 300872 - DNA, 638 bp, Homo sapiens
  misc_feature: GZ8MTXP02JQ1EP.51.75.G09.1.454.CMB.2.raw
  modified_base (219)..(219): a, c, t, g, unknown or other
  misc_feature (219)..(219): n is a, c, g, or t
  modified_base (239)..(239): a, c, t, g, unknown or other
  misc_feature (239)..(239): n is a, c, g, or t
  modified_base (252)..(252): a, c, t, g, unknown or other
  misc_feature (252)..(252): n is a, c, g, or t
  modified_base (260)..(260): a, c, t, g, unknown or other
  misc_feature (260)..(260): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacgagggtcctgggcccagtctgtgctgacgcacgccgcctcagtgtcgtcggggccccagggcaggcggtcacctntctcctgcacggtggggacncagcctaccaagnggtcgggnaggtatgtatgtacacgtggtaccagcacgcttacgaacggaacctcccgtaaccccaaactccgtactaagtttacacgtacctaaaccccacgtaacgttcccggcccttacggaccggggttccctcgggacccttacgtccgtcgtcgtcccgtcgtacgggttccgcgacctacctccggactccccgtcccgtcggctactcgccggttcgggccgttcggcgaaggtcggagttcgggagtcttacggtatttacgtcgtaccgacctacggtcctagaccggacaccgggactaccgtccggtagttacggtccgtgtccggtttccgggtaccgggggacggtacccggaccggtaaacggttccccgg

SEQ ID NO: 300873 - DNA, 670 bp, Homo sapiens
  misc_feature: GZ8MTXP02IMDFI.51.75.G09.1.454.CMB.2.raw
  modified_base (233)..(233): a, c, t, g, unknown or other
  misc_feature (233)..(233): n is a, c, g, or t
  modified_base (269)..(269): a, c, t, g, unknown or other
  misc_feature (269)..(269): n is a, c, g, or t
  modified_base (344)..(344): a, c, t, g, unknown or other
  misc_feature (344)..(344): n is a, c, g, or t
  modified_base (404)..(404): a, c, t, g, unknown or other
  misc_feature (404)..(404): n is a, c, g, or t
  modified_base (446)..(446): a, c, t, g, unknown or other
  misc_feature (446)..(446): n is a, c, g, or t
  modified_base (492)..(492): a, c, t, g, unknown or other
  misc_feature (492)..(492): n is a, c, g, or t
  modified_base (507)..(507): a, c, t, g, unknown or other
  misc_feature (507)..(507): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcagcccgccctcagtgtccgtcggggccccagggcaggaggtcaccatctcctgcacgtgggacncacgcctaccaacgcggtccggggacaagggtaaanggatacgtacacgtacggtacagcgtagccgtacgaacggaaccaccgtacccctaaaactcctacttatttacncgaaacctaacaccgtaacgtcccccgacccgtacgaccggggttccctacgtacccgtntttccgtacgtcgtacctacgtacggtcgacggcctacctcnccgtccctccgtcgccctactccgacggtcgggccgtccgggtacngggaacgtgtacggnggtaccttagttaacttacgtaccgttacgaccgttcgaccctagggaaaccgcgtacgccgtaggtcgtacggttacgtcggttccggtacgggttccgggggtaacgggtacgggtaaaccggaccggtaccggtacccggttaccggtaaccccgtacgg

SEQ ID NO: 300874 - DNA, 578 bp, Homo sapiens
  misc_feature: GZ8MTXP02JT7NI.51.75.G09.1.454.CMB.2.raw
  modified_base (227)..(227): a, c, t, g, unknown or other
  misc_feature (227)..(227): n is a, c, g, or t
  modified_base (238)..(238): a, c, t, g, unknown or other
  misc_feature (238)..(238): n is a, c, g, or t
  modified_base (535)..(535): a, c, t, g, unknown or other
  misc_feature (535)..(535): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctgggccccagggcagaggtcacatctctgcacgtggancagctaccaangtcgggcaggtaatgatcgacacgtggtaccagcagccttaccgaggaaccaccgtacccccaaacttcctactaatttacgcgactaacccaccaatccggacccctcgaccggggttccctcgacccgtacttcgtccgtgtccgtccgtacgggtcctacggtcccaccgtcacgtcccctcccgtcgaccgactccgtacgcggtccgtccggtacgtcggagcgtacggaggcttaggtactttaattccgacgcccgttacgcccgtaagcgacacgcgacgtaccgtggngtccgggttgtcggtacggtcgggacggacggacgtacggtcc

SEQ ID NO: 300875 - DNA, 687 bp, Homo sapiens
  misc_feature: GZ8MTXP02G49YC.51.75.G09.1.454.CMB.2.raw
  modified_base (233)..(233): a, c, t, g, unknown or other
  misc_feature (233)..(233): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcacgcccgccctcagtcgtcgtcggggccccagggcaggaggtcaccatcctctgcacgtgggancagcctaccaacgcggtcggggacaaggtaatgatcgtacacgttggacagcacgtctaccgaggaaccacgtaccccaaactcctactatttacacgaactaaaccacctacgtcccccggacccctcggtaccggggtcccctcggtaccccgtatttccgtccgtcggtacccttccggtacgggttccgtacgggccctacccgtaccgtacccgtccccgttaccccgtcggacccctacttacccggtaccggtccgggggtcccgttaccggggcgttacgggacggtaaggtcgggtaacgtcgttaacggttaactttaccgttaccgttcccggaccgtacccggttacccaaggtaccgaacgacgtcgtacgtcggttaggtacgtcggtcgtcgttcggggcggacgggaacggtaccaggtccctacggtacccgtaccg

SEQ ID NO: 300876 - DNA, 555 bp, Homo sapiens
  misc_feature: GZ8MTXP02GZI7W.51.75.G09.1.454.CMB.2.raw
  modified_base (183)..(183): a, c, t, g, unknown or other
  misc_feature (183)..(183): n is a, c, g, or t
  modified_base (233)..(233): a, c, t, g, unknown or other
  misc_feature (233)..(233): n is a, c, g, or t
  modified_base (316)..(316): a, c, t, g, unknown or other
  misc_feature (316)..(316): n is a, c, g, or t
  modified_base (389)..(389): a, c, t, g, unknown or other
  misc_feature (389)..(389): n is a, c, g, or t
tcagcgatcgtatacacgaccggtgctcgatttagtatagacatcaggggctctgcttcagctgtgggcacaagaggcagcactcaggacaatctccagcatggcctggtctcctctcctcctcactctcctcgctcactgcacagggtcctgggcacagtctgtgctgacgcagccgccctnagtgtctcggggccccagggcagagggtcaccatctcctgcactggggancagctccaacagtcgggcaggtaatgactgtacactggtaccagcagcctcaggaacacgtccctaaactcctctagtttacngacctaacaccaactacgccgtcgacgggtccgtcgcccgactctctggcgtcctacgtcgtcgccgtacccncacgtcctcccgtccgcactacacgtcggccggtccgggtcgtacggaggtagtagacgtacgtagtacttattactacgccgtacgtaccgtacagtacacgacgacgccgtacggtacgtggtcggtcggttcggtccgggtaccgggacggggaaccgtaacg

SEQ ID NO: 300877 - DNA, 589 bp, Homo sapiens
  misc_feature: GZ8MTXP02I9JWS.51.75.G09.1.454.CMB.2.raw
  modified_base (223)..(223): a, c, t, g, unknown or other
  misc_feature (223)..(223): n is a, c, g, or t
  modified_base (230)..(230): a, c, t, g, unknown or other
  misc_feature (230)..(230): n is a, c, g, or t
  modified_base (240)..(240): a, c, t, g, unknown or other
  misc_feature (240)..(240): n is a, c, g, or t
  modified_base (326)..(326): a, c, t, g, unknown or other
  misc_feature (326)..(326): n is a, c, g, or t
  modified_base (395)..(395): a, c, t, g, unknown or other
  misc_feature (395)..(395): n is a, c, g, or t
  modified_base (408)..(408): a, c, t, g, unknown or other
  misc_feature (408)..(408): n is a, c, g, or t
  modified_base (439)..(439): a, c, t, g, unknown or other
  misc_feature (439)..(439): n is a, c, g, or t
  modified_base (460)..(460): a, c, t, g, unknown or other
  misc_feature (460)..(460): n is a, c, g, or t
  modified_base (494)..(494): a, c, t, g, unknown or other
  misc_feature (494)..(494): n is a, c, g, or t
tcagcgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcagcccgcctcagtgtcgtggggccccagggcaggacgggtcaccatctcctgcncgtggancagctacaangtcgggacagtaatgactgtacacgtcggtaaccagctacgtccttacgaaggaacctaccgtacccctaaatcctactatttacncgtaacctaaccaacgtacctcccggtacccctacgggaccggggttccctacggaccccttatccgtntacggcctaccgngtctacgcacctcgactccctcgagccctancctcggtcgtaccgccggttnagggactgacggacgtctagttacttacggtccnctaccgtacgtccagacgacacgctacgtacgtgtacggtcgtacgtcggtacggtcggaacggtacggactacggtaccgtaccggtacgtacg

SEQ ID NO: 300878 - DNA, 501 bp, Homo sapiens
  misc_feature: GZ8MTXP01D7S8U.38.36.D03.1.454.CMB.2.raw
  modified_base (428)..(428): a, c, t, g, unknown or other
  misc_feature (428)..(428): n is a, c, g, or t
tcagtcgatcacgtcacgaccggtgctcgatttagctgcgtcacgatctctcttgggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccagcagtgacattggtcattataactctgtctcgtggtaccaacaacacccaggccaacgccccaaactcattatttatgagtccgaatcggcctcaggatttctaatcgcttctctggctccaagtctggcaacacgcctccctgaccatctctggactccagctgagacgaggggctgattacactgcagtcatatacancaactacttcctcttctgttacttcgggcggttagggaaccaggggtcgacccgtcgttaagtcaagaacccg

SEQ ID NO: 300879 - DNA, 499 bp, Homo sapiens
  misc_feature: GZ8MTXP01B0OBB.38.36.D03.1.454.CMB.2.raw
  modified_base (228)..(228): a, c, t, g, unknown or other
  misc_feature (228)..(228): n is a, c, g, or t
tcagtcgatcacgtcacgaccggtgctcgatttagctgcgtcacgatctctcttgggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccngcagtgacattggtcattataactctgtctcgtggtaccaacaacacccaggccaacgcccccaaactcattatttatgagtccgaatcggcctcaggattctaatcgcttctctggctccaagtctggcaacacggcctccctgaccatctctggactccaggctgagacgaggggctgattactactgcagttcatatacaagcaactacttcctcttctgttattcggcggagggaaccagggtcgaccgtcttaagtcgaacgcccg

SEQ ID NO: 300880 - DNA, 507 bp, Homo sapiens
  misc_feature: GZ8MTXP01DXZW9.38.36.D03.1.454.CMB.2.raw
  modified_base (228)..(228): a, c, t, g, unknown or other
  misc_feature (228)..(228): n is a, c, g, or t
tcagtcgatcacgtcacgaccggtgctcgatttagctgcgtcacgatctctcttgggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccngcagtgacattggtcattataactctgtctcgtggtaccaacaaacacccaggccaacgacccccaaactcatttatttatgagtcgaatcggcctcaggtattctaatcgcttctctggtctccaagtctggcaacacgcctcctgaccatctctgactccagctgagacgaggggctgattacactgcagttcaatatacaagcaactacttctcgttctgttattcgggcggacgggaaccagggtcgacccgtcgttaacgtcgaacgaaccccg

SEQ ID NO: 300881 - DNA, 514 bp, Homo sapiens
  misc_feature: GZ8MTXP01AX6Z0.38.36.D03.1.454.CMB.2.raw
  modified_base (470)..(470): a, c, t, g, unknown or other
  misc_feature (470)..(470): n is a, c, g, or t
tcagtcgatcacgtcacgaccggtgctcgatttagctgcgtcacgatctctcttgggggggcctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccagcagtgacattggtcattataactctgtctcgtggtaccaacaacacccagccaagcccccaaatcattatttatgagtccgaatcggcctcaggtattctaatcgtcttctctggctccaagtctggctaacacggccctccctgaccatctctcggactccgaaggctggaggacgagggggctaggattacgtactgcagttacatatacagcaactacttctcgttctgttattcggnggttacggcctagggtcgaccgtccttaagtccgaagaaccccg

SEQ ID NO: 300882 - DNA, 512 bp, Homo sapiens
  misc_feature: GZ8MTXP01CCQLJ.38.36.D03.1.454.CMB.2.raw
  modified_base (229)..(229): a, c, t, g, unknown or other
  misc_feature (229)..(229): n is a, c, g, or t
  modified_base (307)..(307): a, c, t, g, unknown or other
  misc_feature (307)..(307): n is a, c, g, or t
  modified_base (505)..(505): a, c, t, g, unknown or other
  misc_feature (505)..(505): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccngcagtgacattggtcattataactctgtctcgtggtaccaacaacaccccaggccaacgcccccaaatcattatttangagtccgaatcggcctcaggtatttctaatcgcttctctggctaccaagtctggacaacaccggcctccctgaccatctctcggactccgaggctagaggacgagggggctagattactatgactagttacatataacaagcaactacttcctcttctgttattcggcggttagggaaccagggtcgaccgtcagtcngaacccg

SEQ ID NO: 300883 - DNA, 501 bp, Homo sapiens
  misc_feature: GZ8MTXP01BWO5F.38.36.D03.1.454.CMB.2.raw
  modified_base (471)..(471): a, c, t, g, unknown or other
  misc_feature (471)..(471): n is a, c, g, or t
tcagtcgatcacgtcacgaccggtgctcgatttagctgcgtcacgatctctcttgggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccagcagtgacattggtcattataactctgtctcgtggtaccaacaacacccaggccaacgcccccaaactcattatttatgaggtccgaatcggcctcaggaatttctaatcgacttctctggctccaagtctggcaacacgcctcctgaccatctctggactccaggctgaggacgaggggctgtattactactgcagttcatatacaagcaactacttctcttctgttattcggcggaggaaccngggtcgaccgtcttaagtcaacgtaacccg

SEQ ID NO: 300884 - DNA, 495 bp, Homo sapiens
  misc_feature: GZ8MTXP01ED32I.38.36.D03.1.454.CMB.2.raw
tcagtcgatcacgtcacgaccggtgctcgatttagctgcgtcacgatctctcttggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccagcagtgacattggtcattataactctgtctcgtggtaccaacaacacccaggccaagcccccaaactcattatttatgaggtccgaatcggcctccaggatttctaatcgcttctctgctccagtctggcaacacgcctcctgaccatctctggactccaggctgagacgaggggctgattactactgcagttcatatacaagcaactacttctcttctgttattcggcggttagggccagggtcgaccgtcttaagtcaagaacccg

SEQ ID NO: 300885 - DNA, 495 bp, Homo sapiens
  misc_feature: GZ8MTXP01DZR40.38.36.D03.1.454.CMB.2.raw
tcagtcgatcacgtcacgaccggtgctcgatttagctgcgtcacgatctctcttggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccagcagtgacattggtcattataactctgtctcgtggtaccaacaaacacccaggccaacgcccccaaatcattatttatgagtccgaatcggcctcaggaattctaatcgcttctctggctccaagtctggcaacacggcctccctgaccatctctggactccaggctgagacgaggggctgattactactgcagttcatatacaagcaactacttcctcttctgttattcggcggagggccagggtcgaccgtcttaagtcaagcccg

SEQ ID NO: 300886 - DNA, 597 bp, Homo sapiens
  misc_feature: GZ8MTXP01BWBNF.38.36.D03.1.454.CMB.2.raw
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctcgagtctgcgtctcctggacagtcgatcaccatctctgcactggaaccagcagtgacattggtcattataactctgtctcgtgtaccaacaacacccaggccaacgacccccaaatctattatttatgagtccgaatcggcctcaggtaatttctaatcgtcttctctggtcctaccaagtctacggactaaccgaccggtccctccctacgacctactctacgtcggactccgaggctaggacggacgaggggcttagtaacttactactgacctagttacctaatactaacaacgactaaccttaccttccttacctttcgttacggtttaacgttccggggttcggggttaacgggtaacccggtagggggtccgtaaccccggttacgttaacgttccgaaccggtaacccccgg

SEQ ID NO: 300887 - DNA, 499 bp, Homo sapiens
  misc_feature: GZ8MTXP01D0DS6.38.36.D03.1.454.CMB.2.raw
  modified_base (382)..(382): a, c, t, g, unknown or other
  misc_feature (382)..(382): n is a, c, g, or t
tcagtcgatcacgtcacgaccggtgctcgatttagctgcgtcacgatctctcttgggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccagcagtgacattggtcattataactctgtctcgtggtaccaacaaacaccccaggccaaagcccccaaatcattatttatgagtccgaatcggcctcaggattcaatcgcttctctggctccaagtctggcaacacggcctccctgaccatctcnggactccagctgagacgaggggctgattacactgcagttcatatacaagcaactacttcctcttcgtgttattcgggcggttagggccagggtcaccgtcttaagtcaagaaccccg

SEQ ID NO: 300888 - DNA, 511 bp, Homo sapiens
  misc_feature: GZ8MTXP01D899B.38.36.D03.1.454.CMB.2.raw
  modified_base (229)..(229): a, c, t, g, unknown or other
  misc_feature (229)..(229): n is a, c, g, or t
  modified_base (427)..(427): a, c, t, g, unknown or other
  misc_feature (427)..(427): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccngcagtgacattggtcattataactctgtctcgtggtaccaacaacacccaggccaacgcccccaaactcattatttatgagtccgaatcggcctcaggtaattctaatcgcttctctgctccagtctggcacacgcctcctgaccatctctgactccagctgagcgaggggctgattacatgcagttacatatacaancaactacttcctcttcgtgttaacttcgggcggttacgggaaccgtaggggtcgacccgtcgttaagttccgaacgtaaccccg

SEQ ID NO: 300889 - DNA, 486 bp, Homo sapiens
  misc_feature: GZ8MTXP01EBHY9.38.36.D03.1.454.CMB.2.raw
  modified_base (228)..(228): a, c, t, g, unknown or other
  misc_feature (228)..(228): n is a, c, g, or t
tcagtcgatcacgtcacgaccggtgctcgatttagctgcgtcacgatctctcttgggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccngcagtgacatggtcatataactctgtctcgtgtaccaacaacacccagccaagcccccaaatcattatttatgagtccgaatcggcctcaggatttctaatcgcttctctgctcaagtctggcaacacgcctcctgaccatctactgactcagctgagcgagggctgatactatgcagttacatatacaagcaactacttctcgttctgttacttcggcggagggaaccaggtcgaccgtacttagtcaagaaccccg

SEQ ID NO: 300890 - DNA, 499 bp, Homo sapiens
  misc_feature: GZ8MTXP01BXXXS.38.36.D03.1.454.CMB.2.raw
  modified_base (228)..(228): a, c, t, g, unknown or other
  misc_feature (228)..(228): n is a, c, g, or t
  modified_base (442)..(442): a, c, t, g, unknown or other
  misc_feature (442)..(442): n is a, c, g, or t
tcagtcgatcacgtcacgaccggtgctcgatttagctgcgtcacgatctctcttgggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccngcagtgacattggtcattataactctgtctcgtggtaccaacaacaccaggccaagcccccaaatcattatttatgagtccgaatcggcctcaggattctaatcgacttctctggctccaagtctggcaacacggcctccctgaccatctctggactccagctgaggacgaggggctggattacactgcagttcatatacagcaactcttcctnttctgttattcggcggagggaacccagggtcgaccgtcttaacgtcgaacgaacccg

SEQ ID NO: 300891 - DNA, 679 bp, Homo sapiens
  misc_feature: GZ8MTXP01CVMSD.38.36.D03.1.454.CMB.2.raw
  modified_base (228)..(228): a, c, t, g, unknown or other
  misc_feature (228)..(228): n is a, c, g, or t
  modified_base (307)..(307): a, c, t, g, unknown or other
  misc_feature (307)..(307): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctctgcactggaaccngcagtgacattggtcattataactctgtctcgtggtaaccaacaacacccaggccaacgcccccaaatcatttatttangagtccgaatcggcctcaggtattctaatcgtaacttctctcggcctaccgaagtcgtacgggacaaaccgaccgggtacccctcccctacggaccctaacttcccgttacgttaccggggaaccttcccgaaagggtccttacgggaacggggtaaccggaaggggggtacccttagggtaaactttaacctaaaccgtcggtaccctaaggtttaccaaattaacttaaaccggaaacgtacctaaccttaaccttccctttacctttaccgttaggtttacgtttaccggggcggggttaacggggtaacccgtaagggggttccgtaacccggttccgttaaacggttcccgaacggtaacccccggg

SEQ ID NO: 300892 - DNA, 506 bp, Homo sapiens
  misc_feature: GZ8MTXP01AHL93.38.36.D03.1.454.CMB.2.raw
  modified_base (474)..(474): a, c, t, g, unknown or other
  misc_feature (474)..(474): n is a, c, g, or t
tcagtcgatcacgtcacgaccggtgctcgatttagctgcgtcacgatctctcttgggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccagcagtgacattggtcattataactctgtctcgtggtaccaacaacacccaggccaagccccaaactcattatttatgagtcgaatcggcctcaggtattcgtaatcgacttctctggctcaagtctggcaacacgcctccctgaccatctctgactcgaggctgagacgaggggctgattactactgctagttcatatacaagcaactacttctccttgtgttattcgggcggttagggaacccgngggtcgaccgtcgttaacgtcgaacgaacccg

SEQ ID NO: 300893 - DNA, 512 bp, Homo sapiens
  misc_feature: GZ8MTXP01CAHJU.38.36.D03.1.454.CMB.2.raw
  modified_base (227)..(227): a, c, t, g, unknown or other
  misc_feature (227)..(227): n is a, c, g, or t
  modified_base (465)..(465): a, c, t, g, unknown or other
  misc_feature (465)..(465): n is a, c, g, or t
tcagtcgatcacgtcacgaccggtgctcgatttagctgcgtcacgatctctcttggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccngcagtgacattggtcattataactctgtctcgtggtaccaacaaacacccaggccaagcccccaaatcattattatgagtcgaatcggcctcaggatttctaaatcgcttctctggctcccaagtctggacaacacgcctccctgaccatctactggactccagctgagacgaggggctggacttactactgcagttcatatacaagcaactacttcctacttcgtgttaattcgggnggttacgggcccagggtcgaccgtcccttaaagtcaaggtaaccccg

SEQ ID NO: 300894 - DNA, 724 bp, Homo sapiens
  misc_feature: GZ8MTXP01CPY9A.38.36.D03.1.454.CMB.2.raw
  modified_base (229)..(229): a, c, t, g, unknown or other
  misc_feature (229)..(229): n is a, c, g, or t
  modified_base (255)..(255): a, c, t, g, unknown or other
  misc_feature (255)..(255): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccngcagtgactattggtcattataactntgtctcgtgtaaccaacaaccacccgacgacccaaaccgacccccccaaaactcctaaattttaacttttaacgacggtaacgggttacccgggtaaaacgttcccggggtacccccttacccgtaaacgggttaaacttttaccttaaaacgtcccggtaccttttaccttcgttcgggtaccctacccgtaaacggttctaccggggaccaaacccgtacccgggtccccttaccccgttacgaaccctacttacccgttccgtaccgggtaaccttcccgaagggccttaggaacggggaccgagggggtcttaggtaactttacctacgttcggactacgttacaataactaacgaactaccaaccttacttcccttacttcgttacgttcgttaccgggacgggttacgggtaacccggtaggggtcgtaacccgttcgttaaacggtccgaacgtaaccccgg

SEQ ID NO: 300895 - DNA, 505 bp, Homo sapiens
  misc_feature: GZ8MTXP01BWZ0Z.38.36.D03.1.454.CMB.2.raw
  modified_base (375)..(375): a, c, t, g, unknown or other
  misc_feature (375)..(375): n is a, c, g, or t
tcagtcgatcacgtcacgaccggtgctcgatttagctgcgtcacgatctctcttgggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccagcagtgacattggtcattataactctgtctcgtgtaccaacaacacccaggccaacgccccaaactcattatttatgaggtccgaatcggcctacaggtaatttctaatcgtcttctctgctcaagtctggacaacaccgcctcccngaccatctctcggactccaggctggacgacgaggggctgacttactactgcagttcatatacaagcaactacttcctcttctgttattcggcggagggccagggtcgccgtacttagtcgaacgaacccg

SEQ ID NO: 300896 - DNA, 505 bp, Homo sapiens
  misc_feature: GZ8MTXP01BK5BP.38.36.D03.1.454.CMB.2.raw
  modified_base (453)..(453): a, c, t, g, unknown or other
  misc_feature (453)..(453): n is a, c, g, or t
  modified_base (464)..(464): a, c, t, g, unknown or other
  misc_feature (464)..(464): n is a, c, g, or t
  modified_base (498)..(498): a, c, t, g, unknown or other
  misc_feature (498)..(498): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccagcagtgacattggtcattataactctgtctcgtggtaccaacaacacccaggccaacgcccccaaatcattatttatgagtcgatcggcctcaggattctaatcgtcttctctggctccaagtctggcaacacggcctccctgaccatctctcggactccgaggctggaggacgaggggctggattactactgctagttcatatacaagcaactacttctcttntgttattcggnggacggaaccgagggtcgaccggtcttacggtcngaacccg

SEQ ID NO: 300897 - DNA, 515 bp, Homo sapiens
  misc_feature: GZ8MTXP01EE2PG.38.36.D03.1.454.CMB.2.raw
  modified_base (429)..(429): a, c, t, g, unknown or other
  misc_feature (429)..(429): n is a, c, g, or t
  modified_base (439)..(439): a, c, t, g, unknown or other
  misc_feature (439)..(439): n is a, c, g, or t
  modified_base (454)..(454): a, c, t, g, unknown or other
  misc_feature (454)..(454): n is a, c, g, or t
tcagtcgatcacgtcacgaccggtgctcgatttagctgcgtcacgatctctcttgggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccagcagtgacattggtcattataactctgtctcgtgtaccaacaacacccagccaacgcccccaaatcattatttatgagtccgaatcggcctcaggtattcgtaatcgcttctctgctaccagtctggacaacacggcctccctgacctatctctgactccaggctggagacgaggggctgattacgactgcctagttactntaataccaanctaacttcttccttnttcgtgttacgttcgggcggttacgggaacgtagggtcgaccgtacgttagtcgaacgccg

SEQ ID NO: 300898 - DNA, 501 bp, Homo sapiens
  misc_feature: GZ8MTXP01AM8GU.38.36.D03.1.454.CMB.2.raw
  modified_base (434)..(434): a, c, t, g, unknown or other
  misc_feature (434)..(434): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccagcagtgacattggtcattataactctgtctcgtggtaccaacaacacccaggccaagcccccaaaactcattatttatgagtccgaatcggcctcaggattctaatcgcttctctggctccaagtctggcaaacacgcctccctgaccatctctggactccaggctgagacgaggggctgattacactgcagttcatatacaaancaactcttctcttcgtgttgttcgggcggacggaacgagggtcgaccgtacgttacgtcgcgaaccg

SEQ ID NO: 300899 - DNA, 588 bp, Homo sapiens
  misc_feature: GZ8MTXP01D9SFG.38.36.D03.1.454.CMB.2.raw
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctctgcactggaaccagcagtgacattggtcattataactctgtctcgtacggtaccaacaaaccaccccaggacccaaacgacccccaaatctaatttatttagtaggacggttaccggaatccggaccctacaaggtaatttacgtaatccgtcttctcgtgcctccaagtctaggacaacaccggcctcctagacctatctctggacctccgaggtcctggaggacgaggggtctagtacttacgtactcgactagttacaatataacacgctaaccttacttccttctttgttcgttaacgttccggggcggttacgggtaaccggtacgggttcgtaacccggtaccgttaacgtcgaaccggtaaccccg

SEQ ID NO: 300900 - DNA, 504 bp, Homo sapiens
  misc_feature: GZ8MTXP01CECZ0.38.36.D03.1.454.CMB.2.raw
  modified_base (250)..(250): a, c, t, g, unknown or other
  misc_feature (250)..(250): n is a, c, g, or t
  modified_base (435)..(435): a, c, t, g, unknown or other
  misc_feature (435)..(435): n is a, c, g, or t
  modified_base (452)..(452): a, c, t, g, unknown or other
  misc_feature (452)..(452): n is a, c, g, or t
  modified_base (468)..(468): a, c, t, g, unknown or other
  misc_feature (468)..(468): n is a, c, g, or t
  modified_base (478)..(478): a, c, t, g, unknown or other
  misc_feature (478)..(478): n is a, c, g, or t
tcagtcgatcacgtcacgaccggtgctcgatttagctgcgtcacgatctctcttggggggtctcaggatgcagcgctctcaggacatctccaccatggcctgggctctgctgctcctcaccctcctcactcagggcacagagtcctgggcccagtctgccctgactcagcctgcctccgagtctgcgtctctggacagtcgatcaccatctctgcactggaaccagcagtgacattggtcattataactntgtctcgtgtaccaacaacaccagccaacgccccaaactcatttattatgaggtccgaatcggcccctcaggtatttctaatcgcttctctggctaccaagtctaggcaacacggcctcctgaccatctctggactccgagctgaggacgggaggctagtattacacgtgctagttcaatactanaagctacttactccttnttctgttagttcgggngtaacgggcngggtcgaccgttctaagttcgaaccg

SEQ ID NO: 300901 - DNA, 531 bp, Homo sapiens
  misc_feature: GZ8MTXP01BCY78.38.36.D03.1.454.CMB.2.raw
tcagtcgatcacgtcacgaccggtgctcgatttagctgcgtcacgatctctcttgggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccagcagtgacattggtcattataactctgtctcgtgtaccaacaacacccaggccaacgcccccaaactcattatttatgagtccgaatcggcctcaggatttctaatcgcttctctgtctccaagtctgggcaacacggcctccctgaccatctctggactccaggctgaggacgaggggctggtaattacgtactgcagttcatatacaagcaacttacttcctctttcgtgtttacttcggggcggttacggggtaaccaggggtcgtacccggttcttaaacggtcccgaacggaaccccg

SEQ ID NO: 300902 - DNA, 540 bp, Homo sapiens
  misc_feature: GZ8MTXP01C2YRE.38.36.D03.1.454.CMB.2.raw
  modified_base (309)..(309): a, c, t, g, unknown or other
  misc_feature (309)..(309): n is a, c, g, or t
  modified_base (362)..(362): a, c, t, g, unknown or other
  misc_feature (362)..(362): n is a, c, g, or t
  modified_base (367)..(367): a, c, t, g, unknown or other
  misc_feature (367)..(367): n is a, c, g, or t
  modified_base (383)..(383): a, c, t, g, unknown or other
  misc_feature (383)..(383): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccagcagtgacattggtcattaataactctagtctcgtggtaccaacaacacccaggccaacgcccccaaactcattatttangagtccggaatcggcctccaggtaatttctaatcgtacttctctgctcagtcngcacncgcctcctgaccatcnctggactccgagctgagacgagggctgtattactatcgactagttcaatataacaagctaacttacttcccttacttgttagttacgtttcgggcggttacggggaaccgtacggggtcgtaacccggttccgttaaagttccgaacggtaaccccg

SEQ ID NO: 300903 - DNA, 553 bp, Homo sapiens
  misc_feature: GZ8MTXP01DVE7Y.38.36.D03.1.454.CMB.2.raw
  modified_base (461)..(461): a, c, t, g, unknown or other
  misc_feature (461)..(461): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctggctcagcctgcctccgtgtctggtctcctggacagtcgatcaccatctcctgcactggaaccagcagtgacgttggtggttataaatttgtctctggtaccaacagcacccggcaatcgacccccaaaatcatgatttatgagtcactcactcggccctcgtacggggtttctaatcgtcttctctgctatccaaagtctggacaacaccggtccctccctgacctatcctctcgggctccgaggctagaggacgaggtacttaatttatttctgctagttcataatacaacctanacaacaactcttagtcttagttccgggacgggacgggttaccacggtcctacggtaacccgtacctacgttcgtaaccgcccgtaacccggg

SEQ ID NO: 300904 - DNA, 527 bp, Homo sapiens
  misc_feature: GZ8MTXP01BC3WM.38.36.D03.1.454.CMB.2.raw
  modified_base (226)..(226): a, c, t, g, unknown or other
  misc_feature (226)..(226): n is a, c, g, or t
  modified_base (252)..(252): a, c, t, g, unknown or other
  misc_feature (252)..(252): n is a, c, g, or t
  modified_base (451)..(451): a, c, t, g, unknown or other
  misc_feature (451)..(451): n is a, c, g, or t
  modified_base (455)..(455): a, c, t, g, unknown or other
  misc_feature (455)..(455): n is a, c, g, or t
tcagtcgatcacgtcacgaccggtgctcgatttagctgcgtcacgatctctcttgggggggtctcaggaggcagcgctctcaggacatctccaccatggcctgggctctgctgctcctcaccctctcactcagggcacagagtcctgggcccagtctgccctgactcagcctgcctccgagtctgcgtctcctggacagtcgatcaccatctctgcactggaaccngcagtgacatggtcattataactctntctcgtcgtaccaacaacacccacggaccaacgacccccaaactcatttatttatagagtaccgaatcggcctaccaggtaatttctaatcgtacttctctcggtctccgaagtcgtacgacaacaccgtcctccctgaccactctctcggactccgagctgagtacgagggtctagtactactactgctagttcatanacancaactacttcctcttcgtgttattcggttcggaggaaccgaggtcgaccgtcgttaacgtcgaacgaacccg

SEQ ID NO: 300905 - DNA, 529 bp, Homo sapiens
  misc_feature: GZ8MTXP01ESC31.38.36.D03.1.454.CMB.2.raw
  modified_base (229)..(229): a, c, t, g, unknown or other
  misc_feature (229)..(229): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccngcagtgacattggtcattataactctgtctcgtggtaaccaacaaaccaccccaggccaaacgcccccaaatcattatttatgaggtccgaatcgcctcaggtaatttctaatcgtacttctctgctcaagtctggcaacacggcctccctgaccatctctggacctccgaggctggaggacgaggggctggattacgtactgccgtattacatatacaagcaactacttcctcttctgttaacgttcgggcggagggaaccgtagggtcgacccgtcgttaagtccgaacgaaccccgg

SEQ ID NO: 300906 - DNA, 515 bp, Homo sapiens
  misc_feature: GZ8MTXP01AD6SC.38.36.D03.1.454.CMB.2.raw
  modified_base (229)..(229): a, c, t, g, unknown or other
  misc_feature (229)..(229): n is a, c, g, or t
  modified_base (435)..(435): a, c, t, g, unknown or other
  misc_feature (435)..(435): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccngcagtgacattggtcattataactctgtctcgtggtaaccaacaacacccaggaccaacgcccccaaatcattatttatgagtcgaatcgcctcaggtattctaatcgtcttctctgctcaagtctggcacacgcctcctgaccatctcgtgactcgagtctggaggacgaggggctagtatactacgtgcagttcattagaacanctaactacttccttcttcgttagttattccggggcgttacggggcaggggtcaccgtcgttaagtccgaacgtaacccgg

SEQ ID NO: 300907 - DNA, 655 bp, Homo sapiens
  misc_feature: GZ8MTXP01D3LBM.38.36.D03.1.454.CMB.2.raw
  modified_base (232)..(232): a, c, t, g, unknown or other
  misc_feature (232)..(232): n is a, c, g, or t
  modified_base (448)..(448): a, c, t, g, unknown or other
  misc_feature (448)..(448): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtccgatcaccatctcctgcactggaaccccngcagtgactattggtacattaataactctgtctcgtacgtaaccaaacaaccacccacggacccaaacgacccccaaactcctaatttatttaagtggacggtaccgaagtccggacctacgaaggtaactttacgtaactcgtcttctcgtcggtacctaccaagttcctagggaccaaacgcccgtccctcccgtacgaccctatccctgtccnctaccgacgacgtacggaacgggacggacggggtacgttacgttaacttacgtacgtacgtacgttacgttaactaactaaacgtaactaacgtaacctaacctttaccttcctttcgtttacgtttacggttacggttacgggttacgggttacgggtaaccggtacggtaaccgtaaccgtacgttacgtaaccgaaccgaaccg

SEQ ID NO: 300908 - DNA, 493 bp, Homo sapiens
  misc_feature: GZ8MTXP01C24X1.38.36.D03.1.454.CMB.2.raw
  modified_base (304)..(304): a, c, t, g, unknown or other
  misc_feature (304)..(304): n is a, c, g, or t
  modified_base (485)..(485): a, c, t, g, unknown or other
  misc_feature (485)..(485): n is a, c, g, or t
tcagtcgatcacgtcacgaccggtgctcgatttagctgcgtcacgatctctcttgggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccagcagtgacattggtcattataactctgtctcgtggtacaacaacacccaggccaacgcccccaaatcattatttangagtccgaatcgccctcaggatttctaatcgcttctctgctcaagtctggcaacacgctccctgaccatctctgactccagctgaggacgaggggctgtattacgtactgctagttcatatacaagcaactacttcctcttcgtgttacttcggcgagggccaggtcgacctcgttagtcncgaacccg

SEQ ID NO: 300909 - DNA, 550 bp, Homo sapiens
  misc_feature: GZ8MTXP01EEMVM.38.36.D03.1.454.CMB.2.raw
  modified_base (230)..(230): a, c, t, g, unknown or other
  misc_feature (230)..(230): n is a, c, g, or t
  modified_base (315)..(315): a, c, t, g, unknown or other
  misc_feature (315)..(315): n is a, c, g, or t
  modified_base (407)..(407): a, c, t, g, unknown or other
  misc_feature (407)..(407): n is a, c, g, or t
tcagtcgatcacgtcacgaccggtgctcgatttagctgcgtcacgatctctcgttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccngcagtgacattggtcattataactctgttctcgtggtaccaacaaccacccaggaccaacgacccccaaatcctatttactttangaggtccgaatcggcctcaggtaatttctaatccgcttctctggctaccaagtctggcaacacgcctccctgaccatctctgactcgagtcngaggacgaggggtctaggacttacgtactgctagttaccaatataacaagcctaacttccttcttctttcgtgttttaacgttccgggcgggacgggtaaccgtaaggggtcgtacccgtcgttaacgtcgaaccggtccccg

SEQ ID NO: 300910 - DNA, 532 bp, Homo sapiens
  misc_feature: GZ8MTXP01CXSPD.38.36.D03.1.454.CMB.2.raw
  modified_base (291)..(291): a, c, t, g, unknown or other
  misc_feature (291)..(291): n is a, c, g, or t
  modified_base (380)..(380): a, c, t, g, unknown or other
  misc_feature (380)..(380): n is a, c, g, or t
  modified_base (421)..(421): a, c, t, g, unknown or other
  misc_feature (421)..(421): n is a, c, g, or t
  modified_base (447)..(447): a, c, t, g, unknown or other
  misc_feature (447)..(447): n is a, c, g, or t
tcagtcgatcacgtcacgaccggtgctcgatttagctgcgtcacgatctctcttggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccagcagtgacattggtcattataactctgtctcgtggtacaacaacaccagccaacgccccaaacncattacttttatgaggtaccggagtacggccctccaggtattctaatcgcttctctgtctccaagtctggcaacacggctcctgcatcnctgactcaggctagggagacgaggtgtacgtacgttaactntcgacgttctaactatactaacgacnctaactacttcttacttgttaacgttcgttgggcgggttaccggaacggtggccgtaccgtacgttacgtccgaacgtaacccgg

SEQ ID NO: 300911 - DNA, 557 bp, Homo sapiens
  misc_feature: GZ8MTXP01DP1VK.38.36.D03.1.454.CMB.2.raw
  modified_base (228)..(228): a, c, t, g, unknown or other
  misc_feature (228)..(228): n is a, c, g, or t
  modified_base (485)..(485): a, c, t, g, unknown or other
  misc_feature (485)..(485): n is a, c, g, or t
  modified_base (508)..(508): a, c, t, g, unknown or other
  misc_feature (508)..(508): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctcgagtctgcgtctcctggacagtcgatcaccatctcctgcactggaaccngcagtgactattggtcattataactctgtctcgtggtaaccaacaaaccacccacggaccaaccgacccccaaactctatttatttatggacggtaccgaatcggcctacgaggtaatttctaactcgtcttctctgtcctccaagtctcggacaaacgcggcctcctacgactactctctcggacctccgaggctaggacggaccgaggggtcctaggtaacttacgtacgtcgctagtttacaataactaacganctaactcttcttcttcgttgttnttcgggcggacggaacgtagggtcacccgtacttacgtcaacgtaaccg

SEQ ID NO: 300912 - DNA, 557 bp, Homo sapiens
  misc_feature: GZ8MTXP01AOVCM.38.36.D03.1.454.CMB.2.raw
tcagtcgatcacgtcacgaccggtgctcgatttagctgcgtcacgatctctcttgggggggtctcaggaggcagcgctctcaggacatctccaccatggcctgggctctgctgctcctcaccctcctcactcagggcacagagtcctgggcccagtctgccctgactcagcctgcctcgagtctgcgtctcctggacagtcgatcaccatctcctgcactggaaccagcagtgacattggtcattataactctgtctcgtggtaccaacaacacccagccaacgccccaaactcattatttatgagtccgatcggcctcaggtattctaatcgacttctctggtctccaagtctaggtcaacaccggccctccctcgaccagtctcgtcggtactccaggctaggaggacgacggggctggtaacttaccgtactcgctaggtttcaattactaacaacgctaacctacttccgtactttcgtagttaacgtttcgggcggttacgggtaaccgacggggtcgtacccggtcttaaacgttcgaacggtaaccccgg

SEQ ID NO: 300913 - DNA, 606 bp, Homo sapiens
  misc_feature: GZ8MTXP01BWUDE.38.36.D03.1.454.CMB.2.raw
  modified_base (227)..(227): a, c, t, g, unknown or other
  misc_feature (227)..(227): n is a, c, g, or t
  modified_base (313)..(313): a, c, t, g, unknown or other
  misc_feature (313)..(313): n is a, c, g, or t
  modified_base (403)..(403): a, c, t, g, unknown or other
  misc_feature (403)..(403): n is a, c, g, or t
tcagtcgatcacgtcacgaccggtgctcgatttagctgcgtcacgatctctcgttgggggggtctcaggaggcagcgctctcaggacatctccaccatggcctgggctctgctgctcctcaccctcctcactcagggcacagagtcctgggcccagtctgccctgactcagcctgcctcgagtctgcgtctcctggacagtcgatcaccatctctgcactggaaccngcagtgacattgcattataactctagtctcgtcggtaaccaacaaaccaccccaggacccaaacgcccccaaaatcaattatttangaggtccgaatccggcctacgaggtaatttccaaatccgtaacttctctcgggtcttacccaaagtctgggacaaaacgccgcccttccnacctatccgtcgtacggaccttcccgaaggcctaggaggtaaaccggaggtactagtacttaacgtagtcgacttagtactaaactaacgtaacaacgtcctaacttccttccgtttacttacgttacggttaacggttcgggacgggttacggtaacgtacgggtaaccgtacccggtacgttaacgtccgaacgtaacccg

SEQ ID NO: 300914 - DNA, 525 bp, Homo sapiens
  misc_feature: GZ8MTXP01BLANG.38.36.D03.1.454.CMB.2.raw
  modified_base (495)..(495): a, c, t, g, unknown or other
  misc_feature (495)..(495): n is a, c, g, or t
  modified_base (515)..(515): a, c, t, g, unknown or other
  misc_feature (515)..(515): n is a, c, g, or t
tcagtcgatcacgtcacgaccggtgctcgatttagctgcgtcacgatctctcttgggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccagcagtgacatggtcattataactctgtctcgtggtaccaacaacacccacggaccaacgacccccaaactctatttatttatgaggtccgaatccggccctcaggtaatttctaatcgtcttctctgcctaccaagtctacggcaaacaccggcctccctgaccatctctgactcaggctggaggacgaggggctgattactactgctagttacatatacaacgcaataccttcctcttcgtgttacttcgggcggttacgggaacnggggtcgaccgtcttagtcncgtaaccccg

SEQ ID NO: 300915 - DNA, 534 bp, Homo sapiens
  misc_feature: GZ8MTXP01CWOKD.38.36.D03.1.454.CMB.2.raw
  modified_base (231)..(231): a, c, t, g, unknown or other
  misc_feature (231)..(231): n is a, c, g, or t
  modified_base (311)..(311): a, c, t, g, unknown or other
  misc_feature (311)..(311): n is a, c, g, or t
  modified_base (455)..(455): a, c, t, g, unknown or other
  misc_feature (455)..(455): n is a, c, g, or t
  modified_base (487)..(487): a, c, t, g, unknown or other
  misc_feature (487)..(487): n is a, c, g, or t
tcagtcgatcacgtcacgaccggtgctcgatttagctgcgtcacgatctctcgttggggggggtctcaggaggcagcgctctcaggacatctccaccatggcctgggctctgctgctcctcaccctcctcactcagggcacagagtcctgggcccagtctgccctgactcagcctgccctccgagtctgcgtctcctggacagtcgatcaccatctcctgcactggaaccngcagtgacattggtcattataactctgtctcgtaggtaccaacaacacccaggcccaaagcccccaaatcatttatttangacggtaccgaatcggcctacaaggtaatttctaaatcgactttctctcgctccaagtctcggcaaacgacgccctcctcgaccatctactcggactccgagctgaggacgaggggctagtattactatgctatcatatacaancaactaaccttcttcttcgttgtcgttcgggnggttacgggaactaggggtcaccgtacttaagtccgaacgtaacccg

SEQ ID NO: 300916 - DNA, 666 bp, Homo sapiens
  misc_feature: GZ8MTXP01DVCOB.38.36.D03.1.454.CMB.2.raw
  modified_base (231)..(231): a, c, t, g, unknown or other
  misc_feature (231)..(231): n is a, c, g, or t
  modified_base (322)..(322): a, c, t, g, unknown or other
  misc_feature (322)..(322): n is a, c, g, or t
tcagtcgatcacgtcacgaccggtgctcgatttagctgcgtcacgatctctcgttgggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccngcagtgacattggtacattataactctgtctcgtacggtaaccaaacaaaccacccacggaccaaacgacccccaaatctaatttatttanggacgtaccgaatccggccctacgaaggtaatttactaatccgtacttctcgtcgtcctaccaaagtctagggacaaaccaccggtccctccctagacctatctaccgtgggacctcccgaaggtccgtaggaacgggacgacgggggtactaggtaactttaactacgtcggtacgttaacgtttaccaattaacgttaaaccgaaacgtaccctaaaccctttaaacccgtttccctttaaccccttttgttaacggttttacgtttaccggggccgggttaacgggtaaccggtacgggtaacgtaccccgtacgttaaacgtcgaacccggtaaccccgg

SEQ ID NO: 300917 - DNA, 497 bp, Homo sapiens
  misc_feature: GZ8MTXP01ALU3K.38.36.D03.1.454.CMB.2.raw
  modified_base (371)..(371): a, c, t, g, unknown or other
  misc_feature (371)..(371): n is a, c, g, or t
  modified_base (379)..(379): a, c, t, g, unknown or other
  misc_feature (379)..(379): n is a, c, g, or t
  modified_base (431)..(431): a, c, t, g, unknown or other
  misc_feature (431)..(431): n is a, c, g, or t
  modified_base (443)..(443): a, c, t, g, unknown or other
  misc_feature (443)..(443): n is a, c, g, or t
  modified_base (468)..(468): a, c, t, g, unknown or other
  misc_feature (468)..(468): n is a, c, g, or t
tcagtcgatcacgtcacgaccggtgctcgatttagctgcgtcacgatctctcttgggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccagcagtgacattggtcattataactctgtctcgtggtaccaacaacacccaggcccaacgcccccaaactcattatttatgagtcggaatcggcctcaggatttctaatcgcttctctggctcagtctggcaacacgcctcccngaccatcnctgactcaggctgagacgaggctgattacgtactgcagtttcatatacaagnaactacttcctnttctgttattcggcggagggaaccngggtcaccgtcttaagtccgaagaacccg

SEQ ID NO: 300918 - DNA, 603 bp, Homo sapiens
  misc_feature: GZ8MTXP01EOEKR.38.36.D03.1.454.CMB.2.raw
  modified_base (229)..(229): a, c, t, g, unknown or other
  misc_feature (229)..(229): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccngcagtgacattggtcattataactctgtctcgtgtaccaacaacacccaggccaacgccccaaatcattattatgagtccgaatcgcctcaggtattctaatcgtacttactcgtcggctaccaagtctacgggacaaaccgccggtccctcccgtacgaccctatcctacgtggtacctccgagctaggacggacgaggggtctaggtaacttactaacgtgacctagttaccataataacgaaactctaacttaaccttcccttactttcgttacggtttaacgttccggggttacgggaaccggggtaaccggtacggggttaaccgtaaccccggttaccgttaaacggttccgaaccggtaacccccgg

SEQ ID NO: 300919 - DNA, 508 bp, Homo sapiens
  misc_feature: GZ8MTXP01A5G3X.38.36.D03.1.454.CMB.2.raw
tcagtcgatcacgtcacgaccggtgctcgatttagctgcgtcacgatctctcttgggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccagcagtgacattggtcattataactctgtctcgtggtaccaacaacacccaggccaagcccccaaactcattatttatgagtccgaatcggcctcgaggaatttctaatcgacttctctgctcaagtctggacaacacggcctccctgaccatctctggactcagctggagacgaggggctgattacgtactgcagttcatatacagcaactacttcctacttctgttattcgggcggagggaacccagggtcaccggtccttaagtccgaacgaacccgg

SEQ ID NO: 300920 - DNA, 595 bp, Homo sapiens
  misc_feature: GZ8MTXP01AHG8B.38.36.D03.1.454.CMB.2.raw
  modified_base (308)..(308): a, c, t, g, unknown or other
  misc_feature (308)..(308): n is a, c, g, or t
  modified_base (346)..(346): a, c, t, g, unknown or other
  misc_feature (346)..(346): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcacgtggaaccagcagtgacattggtacattataactctgtctcgtgtaaccaacaacacccagaccaacgccccaaatctattatttangaggtacgatcggcctacgaggtattcaatcgtcttcnctggcctccaagtctgacacaccgccctcctgaccatctacgtgacctccgaggtccaggagacgaggggtctagtaacttaccgaactggcctaagtttcaaattacaaaccgaactccctaaaccttccctttccctaccgtttcgttaacggttttacgttccgggggccgggttacgggtaaccccgggtggggtaacccgtaacccgggttacccttaaaggtccccgaaccggtaacccccgg

SEQ ID NO: 300921 - DNA, 497 bp, Homo sapiens
  misc_feature: GZ8MTXP01AR12I.38.36.D03.1.454.CMB.2.raw
  modified_base (449)..(449): a, c, t, g, unknown or other
  misc_feature (449)..(449): n is a, c, g, or t
  modified_base (472)..(472): a, c, t, g, unknown or other
  misc_feature (472)..(472): n is a, c, g, or t
tcagtcgatcacgtcacgaccggtgctcgatttagctgcgtcacgatctctcttgggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctctgcactggaaccagcagtgacattggtcattataactctgtctcgtgtaccaacaacacccaggccaacgcccccaaactcattatttatgagtccgaatcggcctcaggattctaatcgcttctctgctccaagtctggcaacacgcctccctgaccatctactggacctcgacggctagaggacgaggggtctggtattactactgctagtcatatacagcaactacttcctnttcgtgttagttcggcgaggccngggtcacgtcttagtcgcgaacccg

SEQ ID NO: 300922 - DNA, 536 bp, Homo sapiens
  misc_feature: GZ8MTXP01AD6RQ.38.36.D03.1.454.CMB.2.raw
  modified_base (229)..(229): a, c, t, g, unknown or other
  misc_feature (229)..(229): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccngcagtgacattggtcattataactctgtctcgtggtaccaacaaccacccaggccaacgcccccaaatcaatttatttatgaggtaccggaatcggcctcaggtatttcgtaatcgtcttctctggtcctccaagtctggaccaacgaccgcctccctcgaccatctacgtggactccgaggcctaggaggacgaggggtctgtaacttactactgctagttacatatacagcaactcttcgtcttgttagtagttcgggcgggacggtaaccggtggtccgtacgtacgttacgtcgcgaacccgg

SEQ ID NO: 300923 - DNA, 625 bp, Homo sapiens
  misc_feature: GZ8MTXP01AFYOX.38.36.D03.1.454.CMB.2.raw
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatcctctgcactggaaccagcagtgactattgtacattatactctgtctcgtacgtaccaacaaccacccacgacccaacgaccccaaactctattatttatggacggtccgaatccggacctacgaggtaatttcgtaactcgtacttcctcgtcggctaccgaagtcgtggacaaaccgtcccggccctcccctagaccctacttccgtccgtcgggtaccctccggacggtaccgtagggaacggacggacgggggtctaggtaacttaccgtacgtcggactaagttaccaatactaaacaacgtacctaacctaccttccttaccgttgttcgttaacgttcgggacgggttaccggggaaccgtaggggtaaccgtacccggtacgttaacggtccgaacggaaccccg

SEQ ID NO: 300924 - DNA, 564 bp, Homo sapiens
  misc_feature: GZ8MTXP01AF7DM.38.36.D03.1.454.CMB.2.raw
  modified_base (318)..(318): a, c, t, g, unknown or other
  misc_feature (318)..(318): n is a, c, g, or t
  modified_base (320)..(320): a, c, t, g, unknown or other
  misc_feature (320)..(320): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgctctctggacagtcgatcaccatctcctgcactagacagcagtgacatggtcattataactctgtctcgtggtaccaacacaccacgccaacgaccccaactcatattatgagtcgatcgcctccagtatntntaaaacgcttactctgctcagtctgcaacacgcctcctcgaccatctacgtcgacctccgacggctacggacggacggacggggtcgtacgtattaccgtactcgcgtacggttactaataactaacaaacgtaccaacctaacccttccttcctttacgttcgtttaacgttcgggttcggggttacgggtaaccggtacggggtaacgtacccggtaccgttacgtaacgcgtaacccccgg

SEQ ID NO: 300925 - DNA, 552 bp, Homo sapiens
  misc_feature: GZ8MTXP01AQ57R.38.36.D03.1.454.CMB.2.raw
  modified_base (229)..(229): a, c, t, g, unknown or other
  misc_feature (229)..(229): n is a, c, g, or t
  modified_base (306)..(306): a, c, t, g, unknown or other
  misc_feature (306)..(306): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccngcagtgacattggtcattataactctgtctcgtggtaccaacaacacccaggccaacgcccccaaatcattatttangaggtcgatcggactcaggtattctaatcgtacttctctggctccaagtctggacaacaccggcctccctgaccattctacgtcggacctccgaggcctaggacgggacgaggggctaggtacttactactcgctagttccaatactacaagcctaactaccttccttcttcgttgttaacgttcgggcggttacggggaacctagggggtcacccggttaccgttaagtccgaacgtaaccccgg

SEQ ID NO: 300926 - DNA, 648 bp, Homo sapiens
  misc_feature: GZ8MTXP01DOYN8.38.36.D03.1.454.CMB.2.raw
  modified_base (229)..(229): a, c, t, g, unknown or other
  misc_feature (229)..(229): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccngcagtgacattggtcattataactctgtctcgtcggtaaccaacaaaccacccaggacccaaacgacccccaaactctaatttatttataggtacggtaccggaaatccggaccctacgaaggtaactttacgtaaactcgtacctttctcgtggtaccttaccaaagtccgtagggaccaaacctacccgggtccctcccgtacgaccctattcctacgtcggtaacctccgaagggtccgtaggaacgggaccgaagggggtccttaggtactttaacgtactcggactagtttaccattactaacaaacgtcctaacttacttcccttcgtttacgttgtttaacgttccggggacggttacgggtaaccggtggggtcgtaacccgttacgttaacggtccgaacgtaaccccgg

SEQ ID NO: 300927 - DNA, 497 bp, Homo sapiens
  misc_feature: GZ8MTXP01ARCUQ.38.36.D03.1.454.CMB.2.raw
  modified_base (343)..(343): a, c, t, g, unknown or other
  misc_feature (343)..(343): n is a, c, g, or t
  modified_base (359)..(359): a, c, t, g, unknown or other
  misc_feature (359)..(359): n is a, c, g, or t
tcagtcgatcacgtcacgaccggtgctcgatttagctgcgtcacgatctctcttgggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatcctcctgcactggaaccagcagtgacattggtcattataactctgtctcgtggtaccaacaacacccaggcccaacgcccccaaatcattatttatgagtcgaatcggcctcaggattctaatcgtcttctntgctcagtctgcaacnccgcctcctgaccatctcgtgactcagctgagcgaggggctgattactactgctagtacatatacaagcaactcttcctcttctagttattcgggcggacgggtccagggtcgtaccgtcgttaagtcgaacgtcccg

SEQ ID NO: 300928 - DNA, 533 bp, Homo sapiens
  misc_feature: GZ8MTXP01DXSAL.38.36.D03.1.454.CMB.2.raw
  modified_base (229)..(229): a, c, t, g, unknown or other
  misc_feature (229)..(229): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccngcagtgacattggtcattataactctgtctcgtggtaccaacaaccacccaggaccaacgacccccaaactcatttatttatgaggtaccgaatcggccctcaggtaatttctaatcgtcttctctgctaccaagtctggcaacacgcctccctgacctatctactggactcagctgaggacgaggggctgattacgtactgctagttacatatacagcaacttacttcctctttcgtagtttacttcgggcggacgggtaacccgaggggtcgacccgtccgttaagtcccgaagtaaccccg

SEQ ID NO: 300929 - DNA, 534 bp, Homo sapiens
  misc_feature: GZ8MTXP01BPSBV.38.36.D03.1.454.CMB.2.raw
  modified_base (247)..(247): a, c, t, g, unknown or other
  misc_feature (247)..(247): n is a, c, g, or t
  modified_base (427)..(427): a, c, t, g, unknown or other
  misc_feature (427)..(427): n is a, c, g, or t
tcagtcgatcacgtcacgaccggtgctcgatttagctgcgtcacgatctctcttgggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccagcagtgacattggcattanaactctgtctcgtggtaccaacaacacccaggccaagcccccaaatcattatttatgagtccggaatcggccctcaggaatttctaatcgcttctctggctcagtctggcacacgcctcctgacatctactcgggctcccgaactgacggtacgaggcctacacttattattgcagctanatatacaagcaagtcgttactacgttggggtcgttcgggacgggttacggggaccgtaacccgtggtaacccgttcgttacggttccaacggttccccgtaacgggg

SEQ ID NO: 300930 - DNA, 494 bp, Homo sapiens
  misc_feature: GZ8MTXP01BOTF9.38.36.D03.1.454.CMB.2.raw
  modified_base (451)..(451): a, c, t, g, unknown or other
  misc_feature (451)..(451): n is a, c, g, or t
  modified_base (461)..(461): a, c, t, g, unknown or other
  misc_feature (461)..(461): n is a, c, g, or t
  modified_base (463)..(463): a, c, t, g, unknown or other
  misc_feature (463)..(463): n is a, c, g, or t
  modified_base (469)..(469): a, c, t, g, unknown or other
  misc_feature (469)..(469): n is a, c, g, or t
  modified_base (473)..(473): a, c, t, g, unknown or other
  misc_feature (473)..(473): n is a, c, g, or t
tcagtcgatcacgtcacgaccggtgctcgatttagctgcgtcacgatctctcttgggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccagcagtgacattggtcattataactctgtctcgtggtaccaacaacacccaggccaaacgcccccaaactcatttatttatgaggtccgaatcggccctcaggaatttctaatcgacttctctggctccaagtctggcaacacggcctccctgaccatctctgactcagctgagcgaggggctgattactactgctagttcatatacagcaactacttctcttntgtattcggngnggaacngggngacgtcttaatcgaagtcccg

SEQ ID NO: 300931 - DNA, 520 bp, Homo sapiens
  misc_feature: GZ8MTXP01ADKZY.38.36.D03.1.454.CMB.2.raw
  modified_base (230)..(230): a, c, t, g, unknown or other
  misc_feature (230)..(230): n is a, c, g, or t
  modified_base (346)..(346): a, c, t, g, unknown or other
  misc_feature (346)..(346): n is a, c, g, or t
  modified_base (370)..(370): a, c, t, g, unknown or other
  misc_feature (370)..(370): n is a, c, g, or t
  modified_base (379)..(379): a, c, t, g, unknown or other
  misc_feature (379)..(379): n is a, c, g, or t
  modified_base (428)..(428): a, c, t, g, unknown or other
  misc_feature (428)..(428): n is a, c, g, or t
  modified_base (478)..(478): a, c, t, g, unknown or other
  misc_feature (478)..(478): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatcctcctgcactggaaccngcagtgactattggtcattatactctgtctcgtggtaccaacaacacccaggccaacgcccccaaatcatttatttatgaggtccgaatccggcctcaggtatttcaatcgcttcnctgctcagtctgacacgacgtccncctgacctntctctggactccgagctagagaccgaggggctagtacttacgtactganacgtttaccattatacaagtcaacttacttcctgttctgttacttcgggnggttacggccgtaggtctaccggtacttaggtcaacgtcccg

SEQ ID NO: 300932 - DNA, 538 bp, Homo sapiens
  misc_feature: GZ8MTXP01BWZQL.38.36.D03.1.454.CMB.2.raw
  modified_base (273)..(273): a, c, t, g, unknown or other
  misc_feature (273)..(273): n is a, c, g, or t
  modified_base (312)..(312): a, c, t, g, unknown or other
  misc_feature (312)..(312): n is a, c, g, or t
  modified_base (331)..(331): a, c, t, g, unknown or other
  misc_feature (331)..(331): n is a, c, g, or t
  modified_base (353)..(353): a, c, t, g, unknown or other
  misc_feature (353)..(353): n is a, c, g, or t
  modified_base (388)..(388): a, c, t, g, unknown or other
  misc_feature (388)..(388): n is a, c, g, or t
  modified_base (452)..(452): a, c, t, g, unknown or other
  misc_feature (452)..(452): n is a, c, g, or t
tcagtcgatcacgtcacgaccggtgctcgatttagctgcgtcacgatctctcttgggggggtctcaggaggcagcgctctcaggacatctccaccatggcctgggctctgctgctcctcaccctcctcactcagggcacagagtcctgggcccaggtctgccctgactcagcctgcctccgagtctgcgtctcctggacagtcgatcaccatctcctgcactggaaccagcagtgacattggtcattataactctgtctcgtaggtaaccaanaaccacccaggccaaacgcccccaaatcatttactttangaggtccgaatcggccctnaggtatttcaatcgaacttctntggctcaagtctggcaacacgtcctcctgaacctntctcgtcggactccaggctgagacgagggcgtgtattactactcgcgacgttactatatacaanctaactaacttcctcttcttgttacgttcggttcgggacgggaacggtacgggtcgtaccgtaccgttacgtaacgcgtaacccgg

SEQ ID NO: 300933 - DNA, 533 bp, Homo sapiens
  misc_feature: GZ8MTXP01CESPE.38.36.D03.1.454.CMB.2.raw
  modified_base (378)..(378): a, c, t, g, unknown or other
  misc_feature (378)..(378): n is a, c, g, or t
  modified_base (487)..(487): a, c, t, g, unknown or other
  misc_feature (487)..(487): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctctgcactggaaccagcagtgacattggtcattataactctgtctcgtggtaccaacaacacccaggccaacgacccccaaactctatttatttatgaggtccgaatcggcctcaggtatttctaatcgtcttctctggctccagtctggacaacacgcctcccncgacctatctactcggactccgagctagacggacgaggggctaggtacttacgtactgctagttacataatacaactctaactcttccttcttcgtgttagttccgggnggttacgggaacgtgggtcgccgtacgttagtccgaacgtaacccg

SEQ ID NO: 300934 - DNA, 502 bp, Homo sapiens
  misc_feature: GZ8MTXP01BQZEP.38.36.D03.1.454.CMB.2.raw
  modified_base (224)..(224): a, c, t, g, unknown or other
  misc_feature (224)..(224): n is a, c, g, or t
  modified_base (426)..(426): a, c, t, g, unknown or other
  misc_feature (426)..(426): n is a, c, g, or t
  modified_base (451)..(451): a, c, t, g, unknown or other
  misc_feature (451)..(451): n is a, c, g, or t
  modified_base (456)..(456): a, c, t, g, unknown or other
  misc_feature (456)..(456): n is a, c, g, or t
  modified_base (478)..(478): a, c, t, g, unknown or other
  misc_feature (478)..(478): n is a, c, g, or t
tcagtcgatcacgtcacgaccggtgctcgatttagctgcgtcacgatctctcttgggggggtctcaggaggcagcgctctcaggacatctccaccatggcctgggctctgctgctcctcaccctcctcactcagggcacagagtcctgggcccagtctgccctgactcagcctgcctcgtgtctggtctcctggacagtcgatcaccatctcctgcactggaancagtagtgacattggtggttataactatgtctctgtaccaacaacaccaggcaaacgccccaaactcatcatttatgacgtcactcatcgccccctctaggggtttctactcgtcttctctggcctcgaagtttggcaacgacggccctccctgacctatttctgggctcccgaggctggagcgagctgggattctactgcngttcattatacaagcactactcctnttctnttagttcggcgagggcagggtnccgtcagtcacgcccgaagtcccg

SEQ ID NO: 300935 - DNA, 701 bp, Homo sapiens
  misc_feature: GZ8MTXP01BE4QC.38.36.D03.1.454.CMB.2.raw
  modified_base (225)..(225): a, c, t, g, unknown or other
  misc_feature (225)..(225): n is a, c, g, or t
tcagtcgatcacgtcacgaccggtgctcgatttagctgcgtcacgatctctcttgggggggtctcaggaggcagcgctctcaggacatctccaccatggcctgggctctgctgctcctcaccctcctcactcagggcacagagtcctgggcccagtctgccctgactcagcctgcctcgagtctgcgtctcctggacagtcgatcacatctctgcactggaaccngcagtgacatgtcattatactctgtctcgtacgtaccaacaaccaccacgaccaaccgaccccaaatctatttattagtagtacggtacgactccggcctacgagttattactatccgtacttctcgtcgtacctacgacgtcgtacggaccaaccgtaccggtccctcccgtacaacctacttccgttaccgtacggtacctacccggacgggaccgtagggaaacgggaacggacgggggtacgtttaacgggtaaacctttaccggtaaacccttggaaccgtttacgtttaacctaaactttaaacgttaaaccgaaaccgtacccttaaaccttaaccctttccctttaacctttcgtttaaacggttttcggttaccgggggttacgggttaaccgggttaacccgggtaggggttaacccgtaacccggttacccgttaaacggttcccggttaaaccggtaaccccgg

SEQ ID NO: 300936 - DNA, 621 bp, Homo sapiens
  misc_feature: GZ8MTXP01D4MEW.38.36.D03.1.454.CMB.2.raw
  modified_base (302)..(302): a, c, t, g, unknown or other
  misc_feature (302)..(302): n is a, c, g, or t
tcagtcgatcacgtcacgaccggtgctcgatttagctgcgtcacgatctctcttgggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccagcagtgacattggtcattataactctgtctcgtgtaccaacaacacccagccaacgccccaaatcattatttangagtccgaatcggcctcaggtatttcgtaatcgtacttctctggctccaagtctggacaacacggccctcctcgaccattcctactcggtacctccgagggacctggaacgggaccgaagggggtcccttgggtaactttacgtaacgttcggacctaggtttacccaattactaaacaacgtacctaacttaacccgttaccttccgtttcctttaggtttaaccggttttccggggttcggggaacggggtaaccccgtaagggggttcgtaaccccggttaccgttaaaacgttcccgttaaccgggtaacccccg

SEQ ID NO: 300937 - DNA, 490 bp, Homo sapiens
  misc_feature: GZ8MTXP01CK9LL.38.36.D03.1.454.CMB.2.raw
  modified_base (303)..(303): a, c, t, g, unknown or other
  misc_feature (303)..(303): n is a, c, g, or t
  modified_base (437)..(437): a, c, t, g, unknown or other
  misc_feature (437)..(437): n is a, c, g, or t
  modified_base (455)..(455): a, c, t, g, unknown or other
  misc_feature (455)..(455): n is a, c, g, or t
tcagtcgatcacgtcacgaccggtgctcgatttagctgcgtcacgatctctcttggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccagcagtgacattggtcattataactctgtctcgtggtaccaacaacacccaggccaagcccccaaatcattatttangagtccgaatcggcctcaggatttcaatcgacttctctggctccaagtctggcaacacggcctccctgaccatctctggactccagctgagacgaggggctgattacactgcagttcatatacaagcaactacncctcttctgttattcggnggaggccagggtcaccgtcttaagtcaagaacccg

SEQ ID NO: 300938 - DNA, 612 bp, Homo sapiens
  misc_feature: GZ8MTXP01C0P7T.38.36.D03.1.454.CMB.2.raw
  modified_base (227)..(227): a, c, t, g, unknown or other
  misc_feature (227)..(227): n is a, c, g, or t
  modified_base (319)..(319): a, c, t, g, unknown or other
  misc_feature (319)..(319): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctcgagtctgcgtctcctggacagtcgatcaccatctctgcactggaaccngcagtgactattggtcattataactctgtctcgtacgtaaccaacaaaccacccgacggacccaaccgacccccaaatctaatttaatttangtacggtaccgaatcggaccctacaggtaatttctaatccgtctttactcgtggtccttaccgaacgttccgtacgggaccaaacccgtacccggtcccttacccctacgaccctacttcctacgtcggacctccgaggctaggacggacgaggggtctagtaacttactactgactagttacatactacaagcctaactacttccgttcttcgttacgttaacgttcgggcggttaaccgggtaaccgtagggttccgacccgttacgttaacgtccgaaccgtaaccccgg

SEQ ID NO: 300939 - DNA, 552 bp, Homo sapiens
  misc_feature: GZ8MTXP01DXKDQ.38.36.D03.1.454.CMB.2.raw
  modified_base (201)..(201): a, c, t, g, unknown or other
  misc_feature (201)..(201): n is a, c, g, or t
  modified_base (230)..(230): a, c, t, g, unknown or other
  misc_feature (230)..(230): n is a, c, g, or t
  modified_base (236)..(236): a, c, t, g, unknown or other
  misc_feature (236)..(236): n is a, c, g, or t
  modified_base (320)..(320): a, c, t, g, unknown or other
  misc_feature (320)..(320): n is a, c, g, or t
  modified_base (338)..(338): a, c, t, g, unknown or other
  misc_feature (338)..(338): n is a, c, g, or t
  modified_base (468)..(468): a, c, t, g, unknown or other
  misc_feature (468)..(468): n is a, c, g, or t
tcagtcgatcacgtcacgaccggtgctcgatttagctgcgtcacgatctctcttgggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacngtcgatcaccatctctgcacgtggaaccngcagtnactattggtcaattataactctgtctcgtacgtaaccaacaaccacccgacggaccaaccgacccccaaatctaatttatttangacgtccgaatcgcctanaggtatttctatcgtcttctcgtgcctacagtctcggacaaccgaccgccctcccgtgacccattctcgtcgacctcgagcgtaggacgacgagggcttagtattaccagtgactagttcaatacacacnctaacttcttccttctttcgttgttaacgttcgggcggacggtaaccgaggtccgtaccgtacttacgtcgaaccggtaacccg

SEQ ID NO: 300940 - DNA, 538 bp, Homo sapiens
  misc_feature: GZ8MTXP01AZWTS.38.36.D03.1.454.CMB.2.raw
  modified_base (229)..(229): a, c, t, g, unknown or other
  misc_feature (229)..(229): n is a, c, g, or t
  modified_base (472)..(472): a, c, t, g, unknown or other
  misc_feature (472)..(472): n is a, c, g, or t
  modified_base (511)..(511): a, c, t, g, unknown or other
  misc_feature (511)..(511): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccngcagtgactattggtcattataactctgtctcgtggtaccaacacacccaggccaacgcccccaaatcattatttatgagtcgaatcggcctcaggtatttcaatcgcttctctggctcaacgtctgggactaaccgaccggtcctaccccgtagaccctattcctacgtcgggaacctcccgaaggcctaggacggacgagggggctgaacttactactgcctagttacattacacaaaccnctaactcttctcttcgtgttcgttcggcggacggaacgnggtcgaccgtacttacgtcgaacgccg

SEQ ID NO: 300941 - DNA, 684 bp, Homo sapiens
  misc_feature: GZ8MTXP01AV0H1.38.36.D03.1.454.CMB.2.raw
  modified_base (229)..(229): a, c, t, g, unknown or other
  misc_feature (229)..(229): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccngcagtgacattggtcattataactctgtctcgtcgtaccaacaaccacccagccaacgacccccaaactctatttatttataggacggtaccggaatccggtccctacgaggtaatttctaatccgtaacttctcgtcgggtcctaccaacgtcgtacggacaaacccgaccgggtcccttaccccgtacgtaaccctactcccttcgtcgggtaccttcccgaagggtccctagggaacgggacccggaaggggtcgttacggtaactttaacccgtaacgttcgtaaccgtaagtttaccgaattaaactaaaccaaacggtcctaaacccttaacccgttccttacccttttcgtacggttttaacggttccggggaccgggttacggggtaaccccggtagggttccggtaccccgttaccgttaaacggtccgttaacccggaaccccgg

SEQ ID NO: 300942 - DNA, 725 bp, Homo sapiens
  misc_feature: GZ8MTXP01A3C0P.38.36.D03.1.454.CMB.2.raw
  modified_base (317)..(317): a, c, t, g, unknown or other
  misc_feature (317)..(317): n is a, c, g, or t
tcagtcgatcacgtcacgaccggtgctcgatttagctgcgtcacgatctctcttgggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactgaaccagcagtgactattgtacattactaactctgtctcgtacgtaaccaacaaccacccacggaccaaccgacccccaaatcatactatttangactcactcacctccgcctgtacggttctaactcgtcttctctcggtcctacgtaaggtttcgacccaaccgtacccggtccccttacccgtacggtaacccttacgttttccggtacggggtcccttacccggagggtccgttaaggggaacggggtaaccggtacgggggttactttaagggtttaaactttttacgtccgttacccttaccttacgtaaacttacgtaaccgtacgggtcctaacggaacctaaccggttaccccttaaacccccgtttagttacccgggtttaaccgtttaacccggggaaccggttaaccggggtaaaccccgtaaacggggttaaccccctaacccgggttaccccgttaaccggtcccgaaaccccggtaaaccccccggg

SEQ ID NO: 300943 - DNA, 658 bp, Homo sapiens
  misc_feature: GZ8MTXP01DFHSY.38.36.D03.1.454.CMB.2.raw
  modified_base (229)..(229): a, c, t, g, unknown or other
  misc_feature (229)..(229): n is a, c, g, or t
  modified_base (320)..(320): a, c, t, g, unknown or other
  misc_feature (320)..(320): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccngcagtgactagttggtcattaataactctagtctcgtaggtaaccaacaacacccaggacccaaaccgcccccaaatctatttactttagngtacggtccgaactcggccctacaaggtaatttctaatcgtctttctcgtcggtacctaccgtaagtccgtacgggaccaaacccgtacccgggtacccttccccgtacggtaacccaacgttcctaaccggttacgggtaacccttacccggaacgggccgttagggaacgggaaccggaagggggtccttaggtaacctttaacgacgtcgacctagttaccaattaacgacaaacgcctaacttacttcctttcgttcgtttaggtttaacgttccggggcggttaacgggtaacgacggggttcgtacccggtcttaacgccgaacgtaacccg

SEQ ID NO: 300944 - DNA, 492 bp, Homo sapiens
  misc_feature: GZ8MTXP01AEL93.38.36.D03.1.454.CMB.2.raw
  modified_base (228)..(228): a, c, t, g, unknown or other
  misc_feature (228)..(228): n is a, c, g, or t
  modified_base (381)..(381): a, c, t, g, unknown or other
  misc_feature (381)..(381): n is a, c, g, or t
tcagtcgatcacgtcacgaccggtgctcgatttagctgcgtcacgatctctcttgggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccngcagtgacattggtcattataactctgtctcgtggtaccaacaacaccccaggcccaaacgcccccaaactcattatttatgagtccgaatcggcctcaggatttctaatcgcttctctggctcaagtctggcaacacgcctcctgaccatcnctggactccagctgagacgagggctgattacactgctagttcatatacagcaactcttctcttctgttattcggcggacggaaccagggtcgacgtcaagtcgcgaacccg

SEQ ID NO: 300945 - DNA, 590 bp, Homo sapiens
  misc_feature: GZ8MTXP01BLXXV.38.36.D03.1.454.CMB.2.raw
  modified_base (230)..(230): a, c, t, g, unknown or other
  misc_feature (230)..(230): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcacgtggaaccngcagtgacattggtcattataactctgtctcgtggtaaccaacaaccacccaggccaacgcccccaaatcattatttatgaggtccgaatccggccctacgaggtaatttctaatccgtacttctcgtgcctccaagtctgggtacaacaccggtccctccctacgacctatctactggacctccgaggctggacggtaccggaggggccttaggacttactacgtcgacctagttacaatactacaacgctaaccttacttccttccgtttcgttggtttaacgttccggggttcgggttacggggtaaccgtggggtaaccgtaccggttaccgttaaaggtccaacgggtaaccccg

SEQ ID NO: 300946 - DNA, 566 bp, Homo sapiens
  misc_feature: GZ8MTXP01CHRPR.38.36.D03.1.454.CMB.2.raw
  modified_base (314)..(314): a, c, t, g, unknown or other
  misc_feature (314)..(314): n is a, c, g, or t
  modified_base (481)..(481): a, c, t, g, unknown or other
  misc_feature (481)..(481): n is a, c, g, or t
  modified_base (495)..(495): a, c, t, g, unknown or other
  misc_feature (495)..(495): n is a, c, g, or t
  modified_base (522)..(522): a, c, t, g, unknown or other
  misc_feature (522)..(522): n is a, c, g, or t
  modified_base (539)..(539): a, c, t, g, unknown or other
  misc_feature (539)..(539): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctctgcactggaaccagcagtgactagttggtacattataactctgtctcgtggtaaccaacaaccaccccaggacccaacgacccccaaatcatttattangaggtccgaatcggcctacaggtaatttctaagtcgtaccttctcgtcgggtaccttacccgtaaagtccgtagggacctaaaccgccccggtcccttacccgtagaccctattcctcgtacggaccctccgaaggctaggaggacgagggtctagtacttactacngactagtacattanacagctaactacttcttcttgtagttnttcgggcggagtaacgnggtcaccggtcttagtccgaacgcccg

SEQ ID NO: 300947 - DNA, 516 bp, Homo sapiens
  misc_feature: GZ8MTXP01AQ0M7.38.36.D03.1.454.CMB.2.raw
  modified_base (305)..(305): a, c, t, g, unknown or other
  misc_feature (305)..(305): n is a, c, g, or t
  modified_base (353)..(353): a, c, t, g, unknown or other
  misc_feature (353)..(353): n is a, c, g, or t
tcagtcgatcacgtcacgaccggtgctcgatttagctgcgtcacgatctctcttgggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccagcagtgacattggtcattataactctgtctcgtggtaccaacaacacccaggaccaacgcccccaaatcattattangagtcgaatcggcctcaggtattcatcgcttctctgctcatctgcacncgcctcctgaccatctctgactccgagctgagacgaggggctagacttacactgctaggttacataactacaagctaactaccttcctcttcgtacgttacgttcgggcggttacgggaaccgtagggtcgtacccggtcgttaacgtccgaacgtaacccgg

SEQ ID NO: 300948 - DNA, 543 bp, Homo sapiens
  misc_feature: GZ8MTXP01AKRGD.38.36.D03.1.454.CMB.2.raw
  modified_base (228)..(228): a, c, t, g, unknown or other
  misc_feature (228)..(228): n is a, c, g, or t
  modified_base (234)..(234): a, c, t, g, unknown or other
  misc_feature (234)..(234): n is a, c, g, or t
  modified_base (309)..(309): a, c, t, g, unknown or other
  misc_feature (309)..(309): n is a, c, g, or t
  modified_base (476)..(476): a, c, t, g, unknown or other
  misc_feature (476)..(476): n is a, c, g, or t
  modified_base (505)..(505): a, c, t, g, unknown or other
  misc_feature (505)..(505): n is a, c, g, or t
  modified_base (515)..(515): a, c, t, g, unknown or other
  misc_feature (515)..(515): n is a, c, g, or t
tcagtcgatcacgtcacgaccggtgctcgatttagctgcgtcacgatctctcttgggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccngcagtnacattggtcattataactctgtctcgtggtaccaacaaccacccgaggcccaaacgcccccaaatcattatttangagtccggaatccggcctacgaggtatttcgtaatcgacttctctggctaccaagtcctgggaccaaacgaccggcctcccgtgaccctatctacgtcggacctccgaggcctggaacggaccgaggggtctaggtacttacgtactgcgtagttcaatagtaacancctaactcttactcttgtcgttattcggnggacggccgngggtcgaccgtcgaagtccgcgaacccg

SEQ ID NO: 300949 - DNA, 501 bp, Homo sapiens
  misc_feature: GZ8MTXP01A1ZCR.38.36.D03.1.454.CMB.2.raw
  modified_base (228)..(228): a, c, t, g, unknown or other
  misc_feature (228)..(228): n is a, c, g, or t
  modified_base (303)..(303): a, c, t, g, unknown or other
  misc_feature (303)..(303): n is a, c, g, or t
  modified_base (356)..(356): a, c, t, g, unknown or other
  misc_feature (356)..(356): n is a, c, g, or t
  modified_base (369)..(369): a, c, t, g, unknown or other
  misc_feature (369)..(369): n is a, c, g, or t
  modified_base (447)..(447): a, c, t, g, unknown or other
  misc_feature (447)..(447): n is a, c, g, or t
  modified_base (471)..(471): a, c, t, g, unknown or other
  misc_feature (471)..(471): n is a, c, g, or t
tcagtcgatcacgtcacgaccggtgctcgatttagctgcgtcacgatctctcttgggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccngcagtgacattggtcattataactctgtctcgtgtaccaacaacaccacgccaacgcccccaactcattatttangagtccgatcgcctcaggtattctaatcgcttctctgctcaagtctggcaacncgcctcctgaccntctctcgactccgagctagaggacgaggggctggacttacgtactgctagttcatatacaagctaactcttcctcttntgttaacttcggcggacggaaccngggtcaccgtcgttaagtcgaacgaacccg

SEQ ID NO: 300950 - DNA, 675 bp, Homo sapiens
  misc_feature: GZ8MTXP01C69KP.38.36.D03.1.454.CMB.2.raw
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctctgcactggaaccagcagtgacattgtcattataactctgtctcgtaggtaaccaacaaacacccgaggaccaaaccgacccccaaactctaatttactttagcggtaggtaccggaatccggaccctacgaggtaactttctaaactccgtacttctcgtcggtcctaccgaagtcctacgggacaaaccgtaccggtccctacccgtacgaaccctacttcctacgtacgggtaccttacccggaaggtcgtacgggaacgggaccggtagggggaccttaggtaaactttaccgtaacgtcggacttaggtttaccaattaaactaaccaaacgtcctaaaccttaaccttccctttctttccgtttaggtttacgtttaccgggggccgggttaacggggtaaccggtaacggggtcgtaacccggtaccgttaacgttccgaaccggtaaccccgg

SEQ ID NO: 300951 - DNA, 644 bp, Homo sapiens
  misc_feature: GZ8MTXP01ESJJP.38.36.D03.1.454.CMB.2.raw
  modified_base (319)..(319): a, c, t, g, unknown or other
  misc_feature (319)..(319): n is a, c, g, or t
tcagtcgatcacgtcacgaccggtgctcgatttagctgcgtcacgatctctcttgggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctctgcactggaaccagcagtgactattggtacattataactctgtctcgtacgtaaccaacaaccacccgacgaccaaacgacccccaaactctaatttatttanggtacggtccgaactccgcctacgacggtatttacgtaatccgtacttctcgtcggtcctacctaagtcctacgggacctaaaccgtacccggtcccttaccccacgtaccctacttccttccgtacggtacctccgacggtcgtacggaacggtacggaggggtcgttaggtaacttaccgtaacgtcgacttacgttacctaaataactaactaactccctaacctttaccttcccttctttcgtaggtttaacgttccgggacggggttacggtaaccgtagggtccgtacccggtacgttaacgtccgaacgtaaccccgg

SEQ ID NO: 300952 - DNA, 646 bp, Homo sapiens
  misc_feature: GZ8MTXP01CPK95.38.36.D03.1.454.CMB.2.raw
  modified_base (199)..(199): a, c, t, g, unknown or other
  misc_feature (199)..(199): n is a, c, g, or t
  modified_base (318)..(318): a, c, t, g, unknown or other
  misc_feature (318)..(318): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctcgagtctgcgtctcctggacngtcgatcaccatctcctgcactggaaccagcagtgactattggtcaattataacttctgtctcgtacggtaaccaacaaccacccaggacccaacgacccccaaatctaatttatttancggagtccgaatccggcctacgaggtaatttctaatccgtacttctcgtcggtacctaccgaacgtcgtacgggacctaaaccgacccgggtcccttacccgtacgacctacttcccgtacgtcgggtacctccgaaggtcgtaggaacggtaccggaggggtccttaggtaacttacctacgtgtaccgtagtttaccattaactaaacaaacgtctaacttaccttccgttctttccgttaaagtttcggttaccgggcgggacggggtaaccgtaggggttaaccgaacccggttacgttaacggttcccgaacgtaaccccggg

SEQ ID NO: 300953 - DNA, 624 bp, Homo sapiens
  misc_feature: GZ8MTXP01AUCOO.38.36.D03.1.454.CMB.2.raw
  modified_base (229)..(229): a, c, t, g, unknown or other
  misc_feature (229)..(229): n is a, c, g, or t
  modified_base (309)..(309): a, c, t, g, unknown or other
  misc_feature (309)..(309): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccngcagtgacagttggtacattataactctgtctcgtgtaaccaacaacacccaggccaacgacccccaaatccattattangagtccgaatcggcctcaggtaatttctaatcgtacttctctgtcctacgaacgtctggcaacaccggcctaccctcgaccctagtcccttacgtcggtaacctccgaacggtcgtagggaacgggacggaacgggggtccttaggtaatttacctaaccgtgtaccgtagtttaccaattaactaactaaacgtcctaaccttaacgttcccctttacttcgttacggtttaacgtttcgggggacgggttaccgggaacccggtaaggggtccgtaacccgggtacttaaacggttccgaacggtaaccccgg

SEQ ID NO: 300954 - DNA, 595 bp, Homo sapiens
  misc_feature: GZ8MTXP01DCI6G.38.36.D03.1.454.CMB.2.raw
  modified_base (304)..(304): a, c, t, g, unknown or other
  misc_feature (304)..(304): n is a, c, g, or t
  modified_base (529)..(529): a, c, t, g, unknown or other
  misc_feature (529)..(529): n is a, c, g, or t
  modified_base (539)..(539): a, c, t, g, unknown or other
  misc_feature (539)..(539): n is a, c, g, or t
tcagtcgatcacgtcacgaccggtgctcgatttagctgcgtcacgatctctcttgggggggtctcaggaggcagcgctctcaggacatctccaccatggcctgggctctgctgctcctcaccctcctcactcagggcacagagtcctgggcccagtctgccctgactcagcctgcctcgagtctgcgtctcctggacagtcgatcaccatctcctgcactggaaccagcagtgactattggtcattataactctgtctcgtggtacaacaacaccaggccaacgccccaaactcatttatttangagtccgaatcgccctcaggtaatttctaactcgcttctcgtgtctaccaagtctgggacctaaacaccggtccctcccgtacgaccacttctcttacgggaccttccgaacggtcgtaggacgggacggaacgggggtctaggtaactttaccgtaactcggtactaggttacctaattactaacaaacgtctaaacttaaccttccttcttcgttacggtttntttaccgggnggttacgggtaaccgacggggtcgtaaccgtccgttaagttcgaacggtaaccccg

SEQ ID NO: 300955 - DNA, 629 bp, Homo sapiens
  misc_feature: GZ8MTXP01B5QTJ.38.36.D03.1.454.CMB.2.raw
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctcgagtctgcgtctcctggacagtcgatcaccatctctgcactaggaaccagcagtgactattggtacattataactctgtctcgtacgtaccaacaaccacccgacgaccaacgacccccaaactctaatttactttatgtattgtacaggaactcccggccctagaagtaactttctaaaacttccgtcttctcgtcggcctaccgtaagtcgtacggaccaacgaccggtccctccgtacaaccctactcctacgtcggaccttccgacggtcgtacggacggggacggtacggtctagtaacgttactaacgtgtactagttacactaactaacgaactaccttacttaacccttccgtttctttcgttacggtttaggttcccggggtaacgggacggggtaaccgtacgggggtacgttaccccggttaacgttaacgtaacccgg

SEQ ID NO: 300956 - DNA, 541 bp, Homo sapiens
  misc_feature: GZ8MTXP01DMI5U.38.36.D03.1.454.CMB.2.raw
  modified_base (230)..(230): a, c, t, g, unknown or other
  misc_feature (230)..(230): n is a, c, g, or t
  modified_base (307)..(307): a, c, t, g, unknown or other
  misc_feature (307)..(307): n is a, c, g, or t
  modified_base (378)..(378): a, c, t, g, unknown or other
  misc_feature (378)..(378): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgacctcagcctgcctccgagtctgcgtctcctggacagtcgatcaccatctcctgcactggaaccngcagtgacattggtcattataactctgtctcgtgtaccaacaaccacccagccaacgaccccaaatctattatttangagtccgaatcggcctcgaggtaatttctaatcgcttctcgtggctccaagtctggcaaacacgccctccngacctatctcgtggacctccgagcgtagacggacgaggggtctagtacttaactacgtgctagttaccatatacagcctaactcttcttcttcgtacgtttacttcgggcgggttaacggccgtagggtcgaaccgttcccttaagtccgaacggtaaccccg

SEQ ID NO: 300957 - DNA, 663 bp, Homo sapiens
  misc_feature: GZ8MTXP01BFFQ4.38.36.D03.1.454.CMB.2.raw
  modified_base (227)..(227): a, c, t, g, unknown or other
  misc_feature (227)..(227): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctcgagtctgcgtctcctggacagtcgatcaccatctctgcactggaaccngcagtgacattggtacattataactctgtctcgtacggtaccaacaaccacccacggaccaacgacccccaaactctattatttatgacggtccgaatccgcctcaggtaatttctaatcgtacttctcgtcggtacctaccgaagttcgtcgggactaaaccgtacccggtccctcccgtacgacctacttccgtacgtcgggtaaccttcccggaacggtccgtacgggaacgggacccggagggggtacccgttaggtaactttaaccgtaacgtcggtactaggtttaccaattaactaacgaacgtcctaaccttaaccttcccttctttcgttacggtttacgtttccgggggcgggttaacggggtaaccgtaacgggggtccgtaacccggttaccgttaaacggttccgttaaccggtaaccccggg

SEQ ID NO: 300958 - DNA, 599 bp, Homo sapiens
  misc_feature: GZ8MTXP01EYW3D.38.36.D03.1.454.CMB.2.raw
  modified_base (567)..(567): a, c, t, g, unknown or other
  misc_feature (567)..(567): n is a, c, g, or t
tcagtcgatcacgtcacgaccggtgctcgatttagctgcgtcacgatctctcttgggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctctgcactggaaccagcagtgacattggtcattataactctgtctcgtaggtaaccaaacaaaccacccaggacccaaacgcccccaaaactctactttaatttagtagacggtaccgaagtccggaccctacgaacggtaatttacctaaatccgtacttctctcggactccaagtctacgggaccaaacgacccgtccctccctacgaccattcctaccgtagggtacctccgaaggcctagggacggacggagggggcttaggtaacttactaccgtgtactactttacataatacaacgactaacctacttcctactttcgtgttacttcggggcggttacggaaccgngggtcgaccgtaccgaagtccgaacgaacccg

SEQ ID NO: 300959 - DNA, 726 bp, Homo sapiens
  misc_feature: GZ8MTXP01CKYYN.38.36.D03.1.454.CMB.2.raw
  modified_base (198)..(198): a, c, t, g, unknown or other
  misc_feature (198)..(198): n is a, c, g, or t
  modified_base (310)..(310): a, c, t, g, unknown or other
  misc_feature (310)..(310): n is a, c, g, or t
  modified_base (321)..(321): a, c, t, g, unknown or other
  misc_feature (321)..(321): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctcgagtctgcgtctctggacngtcgatcacatctctgcactggaaccagcagtgacattggtcattataactctagtctcgtggtaccaacaaccacccacggaccaacgacccccaaactcactctaattangactcactacnctcggcctgtacgggtttctaacttcgtcttctcgtcgtctaccgtagttcgaccaacgccggaccctcctacggtacctagtttccgtcgggtactccgtagggcttacgggacgggaacggtaggggtcgttaagtttaaacgttttacgtttcggtacccttccttactaacgttaacttaaacgacgggttaccaggtaacccgtaaccgggttaccccttaaacccccgtttaaggtttacccgggtttaacccggttttacccggggttaaaaccgggtttacccgggggaaaaacccccggtttaaaggggtttaaccccccggtttaaacccccgggttacccgttaaaccccggggtttaacccgttaaaaccccggggtaaaacccccccccggg

SEQ ID NO: 300960 - DNA, 593 bp, Homo sapiens
  misc_feature: GZ8MTXP01BJWNO.38.36.D03.1.454.CMB.2.raw
  modified_base (201)..(201): a, c, t, g, unknown or other
  misc_feature (201)..(201): n is a, c, g, or t
  modified_base (335)..(335): a, c, t, g, unknown or other
  misc_feature (335)..(335): n is a, c, g, or t
  modified_base (400)..(400): a, c, t, g, unknown or other
  misc_feature (400)..(400): n is a, c, g, or t
  modified_base (478)..(478): a, c, t, g, unknown or other
  misc_feature (478)..(478): n is a, c, g, or t
tcagtcgatcacgtcacgaccggtgctcgatttagctgcgtcacgatctctcttgggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacngtcgatcaccatctctgcactggaaccagcagtgactattggtacattataactctgtctcgtcggtaaccaacaaccacccacggaccaacgacccccaaatctatttatttatgagtccgaatccggccctnaggtatttcgtaatcgtcttctcgtgcctaccaagtctcggacaaccgaccggtccctacccgtnacctagtctacgtcggtacctcgagcgtaggacggacgaggggtcctaggtaacttacactcgactagttacaattanaacgtaagccctaaccttacttcccttacttcgtcgtacttacggttccggggacgggtaacggggacccaagggggtttcccacccggttaccgtaacggttccgaaccccggg

SEQ ID NO: 300961 - DNA, 677 bp, Homo sapiens
  misc_feature: GZ8MTXP01ELHF0.38.36.D03.1.454.CMB.2.raw
  modified_base (200)..(200): a, c, t, g, unknown or other
  misc_feature (200)..(200): n is a, c, g, or t
  modified_base (227)..(227): a, c, t, g, unknown or other
  misc_feature (227)..(227): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcaggcacagagtcctgggcccagtctgccctgactcagcctgcctccgagttctgcgtctcctggacngtcatcaccatctctgcactggaaccngcagtgacattggtcattataactctgtctcgtacgtaccaacgaacacccgacggaccaacgacccccaaatctaactttatttagtggtacggttaccggaactccgggaccccttagacggtaaactttcgtaaatccgtcctttaccgtcgtcggtacctaccgtaagtccgtacgggacctaaccgacccggttccctacccgttacgacctacttacgttccgtacggtacccttaccggacggtaccgttagggaacgggtacccggtaagggggtccttaggtaaactttactaacgtcggtacttacgttactaactaattaaccgaactcctaaacttccttccttccgtttaccttgggtttaaccgttcggggaccggttacggggaaccgtacggggtccgtacccgttacgttaaagttccgaaccggtaacccgg

SEQ ID NO: 300962 - DNA, 572 bp, Homo sapiens
  misc_feature: GZ8MTXP01C0IZV.38.36.D03.1.454.CMB.2.raw
  modified_base (227)..(227): a, c, t, g, unknown or other
  misc_feature (227)..(227): n is a, c, g, or t
  modified_base (232)..(232): a, c, t, g, unknown or other
  misc_feature (232)..(232): n is a, c, g, or t
  modified_base (241)..(241): a, c, t, g, unknown or other
  misc_feature (241)..(241): n is a, c, g, or t
  modified_base (299)..(299): a, c, t, g, unknown or other
  misc_feature (299)..(299): n is a, c, g, or t
tcagtcgatcacgtcacgaccggtgctcgatttagctgcgtcacgatctctcgttggggggggtctcaggaggcagcgctctcaggacatctccaccatggcctgggctctgctgctcctcaccctcctcactcagggcacagagtcctgggcccagtctgccctgactcagcctgcctcgagtctgcgtctctggacagtcatcacatctcctgcactggaaaccngcagnatagtgtanatatactctgtctcgtacgaacaacaacaccgacgaccaacacccaatctattattanagtacgtacgatcgactacgagtattactatcgtcttctcgtcgtactacgtacgtcgacgacaaccgtaccgtccctccgacactactcgtacgtacgactacgaggtcgtaggacggacgagggtcgtagtactacgtacgtacgtacgtacgtactaactaactaactaacactaactaccttccttcttcgttacgttacggttacgggttcgggacgggtaacggtacgggtaaccggtaccgtaccgttacgtaacgaacgtaaccg

SEQ ID NO: 300963 - DNA, 648 bp, Homo sapiens
  misc_feature: GZ8MTXP01CLW3G.38.36.D03.1.454.CMB.2.raw
  modified_base (200)..(200): a, c, t, g, unknown or other
  misc_feature (200)..(200): n is a, c, g, or t
  modified_base (324)..(324): a, c, t, g, unknown or other
  misc_feature (324)..(324): n is a, c, g, or t
tcagtcgatcacgtcacgaccggtgctcgatttagctgcgtcacgatctctcttgggggggggtctcaggaggcagcgctctcaggacatctccaccatggcctgggctctgctgctcctcaccctcctcactcagggcacagagtcctgggcccagtctgccctgactcagcctgcctcgagtctgcgtctcctggacngtcgatcaccatctctgcactggaaccagcagtgactagttggtacattataactctgtctcgtacggtaaccaacaaccacccaacggacccaaaccgacccccaaatcctaatttatttagnggtacggtaccggaaacgtccggtaccctacgtaaggtaactttactaaatccgtactttcctcgtcggtacctaccgtaagtcgtacgggaccaaaccgtccggtcccctacccgtacgaccctactccctcgtaccggacctccgtaggctaggacgggaccgaggggtccttaggtacttaactacgtcgactagttacaatacgtaacaacgtcctaacttaccttcttacttcgtttaggttacgttcgggcgggttaacgggtaaccggtacgggtaacgtaccggttaccgttacggtaaccgaaccggtaacccgg

SEQ ID NO: 300964 - DNA, 665 bp, Homo sapiens
  misc_feature: GZ8MTXP01AUK0U.38.36.D03.1.454.CMB.2.raw
  modified_base (229)..(229): a, c, t, g, unknown or other
  misc_feature (229)..(229): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccngcagtgacattggtcattataactctgtctcgtggtaccaacaaccacccaggccaacgcccccaaatcatttatttatgagtccgaatcggcctcaggtatttctaatcgtacttctcgtggtcctaccaagtctacgggacctaaaccgaccgggtcccttaccccgtacgaccctaacttcccttccgttcgggtaacccttccccggaagggtcccttagggaacgggaaccggtaacggggggtcccttagggtaactttacccgttaaccgtggtaccctagtttaccaattaacttaacaaacgtcctaacttacccttccttcctttacgttcgtttaacgtttccggggccgggttaacggggtaacccgtagggggttccgtaaccccgggttaccgttaaacggttcccgaacggtaacccccgg

SEQ ID NO: 300965 - DNA, 621 bp, Homo sapiens
  misc_feature: GZ8MTXP01EGSLL.38.36.D03.1.454.CMB.2.raw
  modified_base (200)..(200): a, c, t, g, unknown or other
  misc_feature (200)..(200): n is a, c, g, or t
tcagtcgatcacgtcacgaccggtgctcgatttagctgcgtcacgatctctcttgggggggggtctcaggaggcagcgctctcaggacatctccaccatggcctgggctctgctgctcctcaccctcctcactcagggcacagagtcctgggcccagtctgccctgactcagcctgcctcgagtctgcgtctcctggacngtcgatcaccatctcctgcactggaaccagcagtgactattggtcattataactctgtctcgtcggtaccaacaaccacccaggacccaacgacccccaaactctatttatttatggagtccggaatcggcctacaggtaattctaatcgtcttctctggctccgaagtctggcaacacggcctccctagaccatcctacgtcggtacctcgaacggctggaacggtacgacgggggtctaggtaactttacctacgttcgactacgttacctattaaacgtaacaaacgtccctaaactttaacccttccctttccttttacgttacgtttaaaccggtttcggggccgggttaacggggtaacccgtacgggggtcgtaaccccggttaccgttaacggttccgaaccgtaaccccggg

SEQ ID NO: 300966 - DNA, 688 bp, Homo sapiens
  misc_feature: GZ8MTXP01AHCJ0.38.36.D03.1.454.CMB.2.raw
  modified_base (226)..(226): a, c, t, g, unknown or other
  misc_feature (226)..(226): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgcgtctctggacagtcgatcacatctcctgcactggaacngcagtgacattggtcattataactctgtctcgtcgtaccaacaaccacccacggacccaaccgacccccaaactcctaatttatttagtagacggtaccgaacgtccggccctacgaaggtaatttactaactccgtactttctcgtggcctaccacgtcgtacgggacaaaccgccggtccctaccccgtcgacctacttcctaccgtacgggtacctcccgaaggtcgtagggacgggacgaggggtctaggtaacctttaccgtaacgtggaccgttagttacctaagttaacgtaaaccgaaacgcccttaaaccttaaccctttcccggtttccttttcgtttacggttttacggttccgggggaccggggttaacggggtaacccggtacgggggtttaacccggaccccggttaacccggtttaaacggtccgttaaccccggtaacccccgggg

SEQ ID NO: 300967 - DNA, 614 bp, Homo sapiens
  misc_feature: GZ8MTXP01DE25F.38.36.D03.1.454.CMB.2.raw
  modified_base (200)..(200): a, c, t, g, unknown or other
  misc_feature (200)..(200): n is a, c, g, or t
  modified_base (226)..(226): a, c, t, g, unknown or other
  misc_feature (226)..(226): n is a, c, g, or t
  modified_base (276)..(276): a, c, t, g, unknown or other
  misc_feature (276)..(276): n is a, c, g, or t
tcagtcgatcacgtcacgaccggtgctcgatttagctgcgtcacgatctctcttgggggggggtctcaggaggcagcgctctcaggacatctccaccatggcctgggctctgctgctcctcaccctcctcactcagggcacagggtcctgggcccagtctgccctggctcagcctgcctccgtgtctggtctcctggacngtcatcaccatctctgcactggaacngcagtgacgttggtgttataaattgctcgtggtaccaacagccacccggnaactacgacccccaaatcatagtatttatgagtcactcactccgcctacgtacgggttctatctcttctctgcatcctaaagtctacgacaacgaccggtccctacctacgacctacttccgttcgtcgggtcctaccgacggcgtacgacgggaacgtaggtactttaaacgtttacgtttcgtacggtactaacgttacaagttaaacctaaccaaaccctacgacctaaacctcctcgttacgtaccgttacggttaccggggaccggttaacgggaaccttaacggtcctaaccggtaacccgtacgtacgttaccgaacgccccgtaaccggg

SEQ ID NO: 300968 - DNA, 604 bp, Homo sapiens
  misc_feature: GZ8MTXP01A8SQN.38.36.D03.1.454.CMB.2.raw
  modified_base (201)..(201): a, c, t, g, unknown or other
  misc_feature (201)..(201): n is a, c, g, or t
  modified_base (230)..(230): a, c, t, g, unknown or other
  misc_feature (230)..(230): n is a, c, g, or t
  modified_base (236)..(236): a, c, t, g, unknown or other
  misc_feature (236)..(236): n is a, c, g, or t
  modified_base (240)..(240): a, c, t, g, unknown or other
  misc_feature (240)..(240): n is a, c, g, or t
  modified_base (594)..(594): a, c, t, g, unknown or other
  misc_feature (594)..(594): n is a, c, g, or t
tcagtcgatcacgtcacgaccggtgctcgatttagctgcgtcacgatctctcttgggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacngtcgatcaccatcctctgcactggaaccngcagtnactnttgtcattataactctgtctcgtacggtaaccaacaaccaccccgacggacccaaaccgacccccaaaatctaatttaactttagtggtacggtaccgaatccggacctacgaggtaactttcaatccgtacttctcgtcgctaccgagtctcggacaaccaccgccctccgtacgacctatccgttacctcggtacctccgacggtctacgggacggacgacgggggtcttaggtactttaaccgtctcggacttaagttactaataactaacgaactactaaccttaccttcttccttacgtgtttaacttcgggcgttacgggaactagggcgttacccgtacttagtccnccggaacccg

SEQ ID NO: 300969 - DNA, 536 bp, Homo sapiens
  misc_feature: GZ8MTXP01BNPC9.38.36.D03.1.454.CMB.2.raw
  modified_base (387)..(387): a, c, t, g, unknown or other
  misc_feature (387)..(387): n is a, c, g, or t
  modified_base (406)..(406): a, c, t, g, unknown or other
  misc_feature (406)..(406): n is a, c, g, or t
  modified_base (432)..(432): a, c, t, g, unknown or other
  misc_feature (432)..(432): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctctgcactggaaccagcagtgacattggtcattataactctgtctcgtggtaccaacaaaccaccccaggccaacgccccctaaactcatttatttatgaggtccggaatcggccctcaggtatttcaatcgcttctctggctccagtctggcacacggcctccctgaccatcnctggctccagctgagacgnggctgacttacactgcctagttcatntacaagccaacttacgttccttctttcgtgtttacgttcgggcggttacggggtaacccgtagggtcgtacccggttacttaacggttccgaacgtaaccccgg

SEQ ID NO: 300970 - DNA, 780 bp, Homo sapiens
  misc_feature: GZ8MTXP01AQ156.38.36.D03.1.454.CMB.2.raw
  modified_base (227)..(227): a, c, t, g, unknown or other
  misc_feature (227)..(227): n is a, c, g, or t
  modified_base (312)..(312): a, c, t, g, unknown or other
  misc_feature (312)..(312): n is a, c, g, or t
tcagtcgatcacgtcacgaccggtgctcgatttagctgcgtcacgatctctcttgggggggggtctcaggaggcagcgctctcaggacatctccaccatggcctgggctctgctgctcctcaccctcctcactcagggcacagagtcctgggcccagtctgccctgactcagcctgcctcgagtctgcgtctctggacagtcgatcaccatctctgcactggaaccngcagtgactagttggtacattataacttctgtctcgtacgtaccaacaaccacccagaccaacgacccccaatctattatttagngacggtccgatcggacctcgaggtatttctaatcgtacttctcgtgacctacaacgtcgtcggaccaacgacccggtccctaccctcgaccctacttccgttaccgtacgggtacccttcccggaacgggtcccgttagggaaccgggtaaccgggtacgggggtaccgtacgtttaacgtttaacccgtacgttacggtaccttaacggtttacctaaacgttaacctaaaccccgtaaacggtccccttaaacccgtttaaccccgttttcccccttttaccgtttttacccggtttaaacggggtttttaaccccgggttaccccggggggttaacccggggggttaacccgggggtttaaaccccgggttacccggggggttaacccggttaaaccccccggggtttaacccggttaaaccggggtttaaccccgaaaccccggggttaaacccccccccgggg

SEQ ID NO: 300971 - DNA, 732 bp, Homo sapiens
  misc_feature: GZ8MTXP01A6V0Z.38.36.D03.1.454.CMB.2.raw
  modified_base (393)..(393): a, c, t, g, unknown or other
  misc_feature (393)..(393): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctcgagtctgctctcctggacagtcgatcacatctctgcactgaaccagcagtgacattgtacattataactctgtctcgtacgtaccaacaacacccaggacccaacgcccccaaatctatttatttatgacggttaccgaatccggccctacaaggtaactttctaatccgtaacttctcgtaggtccttaccgaagttccgtggacccaaaccncccggtcccttaccccgtacgaaccctattccgttaccgtacgggtaaccttccccgagggccttacgggaacgggaccgggaacggggtccgtttaagggtaaaccttttaaccgtaaccggttacggtaccttaacggtttaacctaaagttttaaacaaaccggtaaacgtacccctaaaactttaccctttaccccgggtttcttttacccgttaagggtttttaacggtttccccgggggcggggttaaaccgggggtaacccgtaacgggggttccggtaaaccccggtttacccgttaaaacgggttcccgaaccgggttaaaccccccggg

SEQ ID NO: 300972 - DNA, 552 bp, Homo sapiens
  misc_feature: GZ8MTXP01A0IZ4.38.36.D03.1.454.CMB.2.raw
  modified_base (462)..(462): a, c, t, g, unknown or other
  misc_feature (462)..(462): n is a, c, g, or t
  modified_base (544)..(544): a, c, t, g, unknown or other
  misc_feature (544)..(544): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgatctgcgtctcctggacagtcgatcaccatctcctgcactggaaccagcagtgacattggtcattataactctagtctcgtggtaaccaacaaaccacccacgacccaaaccgcccccaaaactcaatttatttaatggacggtccggaatcggaccctacaggtatttctaactcgtcttctctcggctacagtctggacacacgcctccctgaccatctacgtacgacctccgtaggctggaacggaccgaggggctgtacttactacttgctagttanaacttataacagcaactacttcctcttacgtgttaacgttcgcgggacggtaacgacgggtcgtaccgtaccgttaagtccncgaacccg

SEQ ID NO: 300973 - DNA, 535 bp, Homo sapiens
  misc_feature: GZ8MTXP01D3XGJ.38.36.D03.1.454.CMB.2.raw
  modified_base (230)..(230): a, c, t, g, unknown or other
  misc_feature (230)..(230): n is a, c, g, or t
  modified_base (236)..(236): a, c, t, g, unknown or other
  misc_feature (236)..(236): n is a, c, g, or t
  modified_base (314)..(314): a, c, t, g, unknown or other
  misc_feature (314)..(314): n is a, c, g, or t
  modified_base (456)..(456): a, c, t, g, unknown or other
  misc_feature (456)..(456): n is a, c, g, or t
  modified_base (491)..(491): a, c, t, g, unknown or other
  misc_feature (491)..(491): n is a, c, g, or t
tcagtcgatcacgtcacgaccggtgctcgatttagctgcgtcacgatctctcttgggggggggtctcaggaggcagcgctctcaggacatctccaccatggcctgggctctgctgctcctcaccctcctcactcagggcacagagtcctgggcccagtctgccctgactcagcctgcctcgagtctgcgtctccgtggacagtcgatcaccatctcctgcactggaaccngcagtnactattggtcattataactctgtctcgtgtaaccaacaaccacccaggaccaaccgacccccaaatctattatttagngacggtccgaatcggccctcaggtaatttcaatcgtcttctcgtgcctacagtctggacacacgcctcctgaccattctcgtgacctcgagtcaggaggaccgaggggtctagttattacgtatgctgtactatataacgancctaacttccttctctttcgtagttacgttcgggnggttacgggaacgtgggtcgaccgtcgttaagtcgcgtaacccg

SEQ ID NO: 300974 - DNA, 678 bp, Homo sapiens
  misc_feature: GZ8MTXP01ANYFN.38.36.D03.1.454.CMB.2.raw
  modified_base (229)..(229): a, c, t, g, unknown or other
  misc_feature (229)..(229): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccngcagtgacattggtcattataactctagtctcgtacggtaccaacaaccacccaggacccaaacgcccccaaaactctaatttactttagtacggtacggtacccggaaacttccgggtacccctacgtaacgggtaacttttaccgtaaacttccggtacctttcctcgttcgggtacccttaccgtaaagttcctacggggacctaaacccgacccgggtcccctacccgtacgtaacctacttccgtaccgtcgggtaccttcccgaagggtccgtagggacgggacggaggggtcttaggtaacttacgtacgtggtctagttaccaagtaactacaacgtcctaacttaaccgttccttctttcgttacggttaacgttcgggacgggttaccgggtaaccgtaggggtccgtacccgttacgttaacgtccgcgtaaccccgg

SEQ ID NO: 300975 - DNA, 610 bp, Homo sapiens
  misc_feature: GZ8MTXP01BGTRK.38.36.D03.1.454.CMB.2.raw
  modified_base (198)..(198): a, c, t, g, unknown or other
  misc_feature (198)..(198): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgcgtctctgacngtcgatcacatctctgcactggaaccagcagcgactattggtacattataactctgtctcgtgtaccaacaacaccagccaacgccccaaatctattattatgacgtcgaatcggcctacgaggtattctaatcgtcttactctggtctaccagtctcggacaacaccggtccctcccgtagacctatcccgtactcggacctccgaggtccgtaggacgggaccgtagggggtacttacggtaactttaccgtacgtcgtacgtacgttaccaaattactaaactaacgtctaaccttaccttccctttactttccgttaagtttcgggtttaccggggcggggttaccggggtaaccgtacggggttccgacccggttaacgttacggttaaccgaaccggtaaccccgg

SEQ ID NO: 300976 - DNA, 587 bp, Homo sapiens
  misc_feature: GZ8MTXP01DW5F4.38.36.D03.1.454.CMB.2.raw
  modified_base (313)..(313): a, c, t, g, unknown or other
  misc_feature (313)..(313): n is a, c, g, or t
  modified_base (379)..(379): a, c, t, g, unknown or other
  misc_feature (379)..(379): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccagcagtgactattggtcattataactctgtctcgtcgtaccaacaaccacccaggaccaacgacccccaaactctatttatttangacggtaccgaatcggccctcaggtatttctaatcgtcttctcgtggctaccagtctcggacaacncgaccctccgtcgaccatctactcggactccgaggtctaggacggcggaggggtctggtaactttaccgtaactcggtacttagttaccaattaactaacaacgcctaaaccttaccttccttccgtttcgttacggtttacgttccgggacgggttacggggaaccgtagggtcgtacccgtcgttaacggtccgaacgtaaccccg

SEQ ID NO: 300977 - DNA, 545 bp, Homo sapiens
  misc_feature: GZ8MTXP01BXOHB.38.36.D03.1.454.CMB.2.raw
  modified_base (228)..(228): a, c, t, g, unknown or other
  misc_feature (228)..(228): n is a, c, g, or t
  modified_base (512)..(512): a, c, t, g, unknown or other
  misc_feature (512)..(512): n is a, c, g, or t
tcagtcgatcacgtcacgaccggtgctcgatttagctgcgtcacgatctctcttgggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccngcagtgacatggtcattataactctgtctcgtggtaccaacaacacccagccaacgcccccaaactcattattatgagtccgaatcggcctcaggtatttcgtaatcgtacttctcgtggtcctccaagtctagggcaaacgccgcctcccgtgaccacttctactcggacctccgaggactggaacgggacgacggggggtctggtaacttactaacctgtaccagttcaatatacaagcaactacttcctcttcgtgttacttcgggcggacgggtaaccgngggtcgtaccgtcttaacgtccgttaacgcccg

SEQ ID NO: 300978 - DNA, 715 bp, Homo sapiens
  misc_feature: GZ8MTXP01A2W92.38.36.D03.1.454.CMB.2.raw
  modified_base (213)..(213): a, c, t, g, unknown or other
  misc_feature (213)..(213): n is a, c, g, or t
  modified_base (238)..(238): a, c, t, g, unknown or other
  misc_feature (238)..(238): n is a, c, g, or t
  modified_base (321)..(321): a, c, t, g, unknown or other
  misc_feature (321)..(321): n is a, c, g, or t
tcagtcgatcacgtcacgaccggtgctcgatttagctgcgtcacgatctctcttgggggggggtctcaggaggcagcgctctcaggacatctccaccatggcctgggctctgctgctcctcaccctcctcactcagggcacagagtcctgggcccagtctgccctgactcagcctgcctccgagtctgcgtctccgtggacagtcgatcaccntctctgacactaggaaccagcagtnactgttgtactattatactctgtctcgtacgtaccaacaaccacccacgacccaaccgaccccctaaatactatttagtttanacggtacggtaccggaacttcccggacccttacgtaacggttaactttacgtaacttccgtaactttccgtcgtcgtccctaccgtaacgtccgtacggaccaaccgtacccggtcccttacccgtcgtaccctacgttcccgttacgtaccgggtaccctaccgggacggtacgtacgggaacgggtaccggtacgggggtacctttaagggtaacctttaccgtaaccgtggtaccttaagttaacaactaacgtaacctaaacgacccttaaccttaccttccctttcgttacgtttacggttaaccgggttccgggttaccggggacgggtaaccgggtacgggtccgttaaccccggtacgttaaccgtaacccggaacgtaaccccgg

SEQ ID NO: 300979 - DNA, 643 bp, Homo sapiens
  misc_feature: GZ8MTXP01DNDYV.38.36.D03.1.454.CMB.2.raw
  modified_base (228)..(228): a, c, t, g, unknown or other
  misc_feature (228)..(228): n is a, c, g, or t
  modified_base (385)..(385): a, c, t, g, unknown or other
  misc_feature (385)..(385): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctctgcactggaaccngcagtgactattggtcattataactctagtctcgtacggtaaccaacaaccacccaggaccaaacgacccccaaatctatttatttatgagtccgaatccgcctcaggtatttctaatcgtcttctcgtggcctactaagtctacgggactaaaccnccggtcccttcccgtagaaccctaagttcctaccgtacgggtaccttccgacgggttctagggaacggaccggagggggtaccttaggtaactttaacgtaccgtgtacctaaggttaccaattaaactaaccaaacgtcctaaaccttaacccgttccttactttacccgttaggtttaaccgttcggggacgggttaccgggaaccggtacggggtcgtaacccgttacggttaacgttccgaaccgtaaccccgg

SEQ ID NO: 300980 - DNA, 827 bp, Homo sapiens
  misc_feature: GZ8MTXP01DPHQX.38.36.D03.1.454.CMB.2.raw
tcagtcgatcacgtcacgaccggtgctcgatttagctgcgtcacgatctctcttgggggggggtctcaggaggcagcgctctcaggacatctccaccatggcctgggctctgctgctcctcaccctcctcactcagggcacagagtcctgggcccagtctgccctgactcagcctgcctcgagtctgcgtctcctggacagtcgatcaccatctcctgcacgtggaaccagcagtgactagttggtactaattaataacttcgtgttcctacggtacggtaaacccaaacaaacccaccccgaacggaccccaaaccgaccccccctaaaatctaaattttaagtttaagtcggaacggttacccggaaactcccggtaccccttaacgtaacgggttaaactttttaccgtaaacttcccgttaacctttccgttcgttacggtacccttacccgtaaacggttccgtacgggaacctaaaacccgtacccgggtccccttaccccgttacggaaccccttaagttcccgttaccgttaccggggtaacccttaccccggaaacggggtccccgttaaggggaaaccggggtaacccgggttaaacggggtacccgtttaacggggttaaaccttttaaacccgtaccgttacggtaacccttaaggttttaacccaaatttaaaccgttaaaccaaaccggtcccttaaaacctttacccttccctttaccgttttacgttaggtttacggttaccggggcggggttaaccgggtaaccgtaacggggtcgtaacccgtacgttaaggtccgaacggtaaccccg

SEQ ID NO: 300981 - DNA, 576 bp, Homo sapiens
  misc_feature: GZ8MTXP01AH90W.38.36.D03.1.454.CMB.2.raw
  modified_base (229)..(229): a, c, t, g, unknown or other
  misc_feature (229)..(229): n is a, c, g, or t
  modified_base (303)..(303): a, c, t, g, unknown or other
  misc_feature (303)..(303): n is a, c, g, or t
  modified_base (360)..(360): a, c, t, g, unknown or other
  misc_feature (360)..(360): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccngcagcgacattggtcattataactctgtctcgtgtaccaacaacacccagccaacgccccaaatcattatttangagtcgaatcgcctcaggtattctaatcgtcttctctggcctcgaagtcgtgcaacnccgtccctccctgacccatcctcgtcggaactccgaggtctaggacgacggaggggtctaggtaacttacgtactgctagttaccaatataacgaacgcctaacttccttacccgttctttaccgttgtttaacgttcggggcgggttaacgggggtaaccctagggggttaaccgtaacccggtaccgttaaaggtcccgaacggtaaccccggg

SEQ ID NO: 300982 - DNA, 633 bp, Homo sapiens
  misc_feature: GZ8MTXP01DMOR6.38.36.D03.1.454.CMB.2.raw
  modified_base (228)..(228): a, c, t, g, unknown or other
  misc_feature (228)..(228): n is a, c, g, or t
  modified_base (463)..(463): a, c, t, g, unknown or other
  misc_feature (463)..(463): n is a, c, g, or t
  modified_base (565)..(565): a, c, t, g, unknown or other
  misc_feature (565)..(565): n is a, c, g, or t
tcagtcgatcacgtcacgaccggtgctcgatttagctgcgtcacgatctctcttgggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcatcaccatctctgcactggaaccngacagtgacagttgtacattatactctgtctcgtacgtaaccaacaaccaccacgaccaaccgaccccctaaactctatttatttagtacggacggtaccgaacgtccggaccctacgtaaggtaatttactaacgtccgtaccttcctcgtacggtcctaccgtaacgtccgtacgacgtaacccaccggtccctccctacgacctacttcctcgtacggacctccggaggtcnggacggacgtaggggcttagtacttacgtacgtcgacgtattaaccagttacaactacgactaaccttaccttccttcttcgttacggttacgttaccgggnggggttaaccgggaaccggtagggtaaccgtaaccggttacgttaaaccggtccgaaccggaaccccg

SEQ ID NO: 300983 - DNA, 673 bp, Homo sapiens
  misc_feature: GZ8MTXP01DQ5YK.38.36.D03.1.454.CMB.2.raw
  modified_base (201)..(201): a, c, t, g, unknown or other
  misc_feature (201)..(201): n is a, c, g, or t
  modified_base (229)..(229): a, c, t, g, unknown or other
  misc_feature (229)..(229): n is a, c, g, or t
tcagtcgatcacgtcacgaccggtgctcgatttagctgcgtcacgatctctcttgggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacngtcgatcaccatctctgcactggaaccngcagtgactagttggtactattactaactctcgtcgtcggttacggtaaccaaccaaaccacccgacgacccaaaccgacccccaaatcctaatctaatttagtcacgttacactacacccgtccggtaccttcggtaacgggtttcctaaaccgttcgttccttctccgtcgtaccttaccgtaacgtttcgggaacctaaccgtccggtacccctccgtacgacctttacgtttccgcgggtacctacccgaggtcgtacgggaaacgggtacggtaaacggggttccgtttaaagtttaacgtttttacgtcgtccctttactaacggtaacttacgtaacgacgaacgtcgaactcgttacctaccccgttgtcgtacgttacggacgttaccgggaactacggtaaccctccgtacgttaccgtcgaaccggaaccccg

SEQ ID NO: 300984 - DNA, 611 bp, Homo sapiens
  misc_feature: GZ8MTXP01EZNYI.38.36.D03.1.454.CMB.2.raw
  modified_base (228)..(228): a, c, t, g, unknown or other
  misc_feature (228)..(228): n is a, c, g, or t
  modified_base (514)..(514): a, c, t, g, unknown or other
  misc_feature (514)..(514): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcatcaccatctcctgcactggaaccngcagtcgactattggtcaattataactctgtctcgtacggtaaccaaacaaccacccacggcccaaacgaccccctaaaactctaatttactttaagtcggaggttaccggaactccgggtacccctaccgtaaggtaaactttctaaactccgtactttctcgtggtcctaccgaagtccgtaggaccaaacgcccgtccctccctagaccatctacgtagactccgagctaggagacgagggtcgtagtacttactactcggataggttacataactacaaacnctaacttacttctactttcgttagttaacgttcggggcggacgggtaacccgtaggggttccgtaacccggtcggttaactcgaaccgtaaccccgg

SEQ ID NO: 300985 - DNA, 553 bp, Homo sapiens
  misc_feature: GZ8MTXP01EQRAM.38.36.D03.1.454.CMB.2.raw
  modified_base (381)..(381): a, c, t, g, unknown or other
  misc_feature (381)..(381): n is a, c, g, or t
  modified_base (420)..(420): a, c, t, g, unknown or other
  misc_feature (420)..(420): n is a, c, g, or t
  modified_base (443)..(443): a, c, t, g, unknown or other
  misc_feature (443)..(443): n is a, c, g, or t
  modified_base (503)..(503): a, c, t, g, unknown or other
  misc_feature (503)..(503): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctcgagtctgcgtctcctggacagtcgatcaccatctcctgcactggaaccagcagtgacattggtcattataactctgtctcgtgtaaccaacaaccacccaggccaacgcccccaaatcatttattatgagtccgaatccggcctacaggtaatttctaatcgcttctctgctcatctggcacacgcctccctgaccatctcncggactcgagctgagggacaggggctaggtactactacngaccgtagttcatatacgaaacncctaacttacccttcctctttcgtcggtttaattccgggggcggttacggggtaacccgngggggtttaaccgaccccggttacttaacggtcccgaaggtaacccccgg

SEQ ID NO: 300986 - DNA, 600 bp, Homo sapiens
  misc_feature: GZ8MTXP01A057M.38.36.D03.1.454.CMB.2.raw
  modified_base (310)..(310): a, c, t, g, unknown or other
  misc_feature (310)..(310): n is a, c, g, or t
  modified_base (384)..(384): a, c, t, g, unknown or other
  misc_feature (384)..(384): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcacctatctcctgcactggaaccagcagtgacattggtcattataactctgtctcgtagtaccaacaacacccaggaccaacgacccccaaactcattatttanggtacggtacgaactcggcctacgaggtatttactaatcgtaacttctctggtcctcaacgtctacggacaacnccggtccctccctcgacctactctacgtcggacctccgaggtctacggacgaccggaggggtctaggtaacttacctacgtcgtactagttacctataatacaaactctaacttaaccttccttctttccgttggtttaacgttccggggcgggttacgggtaaccggtagggggtccgtacccgttacgttaacgttcccgaacgtaacccccgg

SEQ ID NO: 300987 - DNA, 563 bp, Homo sapiens
  misc_feature: GZ8MTXP01DO5RC.38.36.D03.1.454.CMB.2.raw
  modified_base (232)..(232): a, c, t, g, unknown or other
  misc_feature (232)..(232): n is a, c, g, or t
  modified_base (311)..(311): a, c, t, g, unknown or other
  misc_feature (311)..(311): n is a, c, g, or t
  modified_base (326)..(326): a, c, t, g, unknown or other
  misc_feature (326)..(326): n is a, c, g, or t
  modified_base (365)..(365): a, c, t, g, unknown or other
  misc_feature (365)..(365): n is a, c, g, or t
tcagtcgatcacgtcacgaccggtgctcgatttagctgcgtcacgatctctcgttggggggggtctcaggaggcagcgctctcaggacatctccaccatggcctgggctctgctgcctcctcaccctcctcactcagggcacagagtcctgggcccagtctgccctgactcagcctgcctcgagtctgcgtctcctggacagtcgatcaccatcctcctgcactggaaaccngcagtgactattggtacattataactctgtctcgtagtaccaacaaccacccagccaacgaccccaatctattatttangagtcgaatcgcctnaggtattctaattgacttctctgctcaagtctggcaacncgcctacctgaccatctctcgactcgagctaggacggacgaggggtctaggtaacttacgtacttcggactagttaacatactaacgaacgtcctaaacttccgttccttacgtttcgtagtttacgttcggggacggttaacggggtcctaaggggttcgtaaccccggttacgttaacgtccgaacggtaaccccg

SEQ ID NO: 300988 - DNA, 672 bp, Homo sapiens
  misc_feature: GZ8MTXP01BSI0G.38.36.D03.1.454.CMB.2.raw
  modified_base (229)..(229): a, c, t, g, unknown or other
  misc_feature (229)..(229): n is a, c, g, or t
  modified_base (271)..(271): a, c, t, g, unknown or other
  misc_feature (271)..(271): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccngcagtgtacgttggtagttaataattgtctctagtaccaacncgaccgaccggacaatccgaaccccctaaaatccatgtaatttagtggtacgtctactcgtacgtcccggtccttacggtacggggtttactaagtccgtctttctcgtcggtcctaccgtaacgtcgtcggtaccaaccgaccggtccctacccgtacgtacccctatccgtcgtacgggtaccctaccggtaagggtccgtttaagggacgtaggtacgtacgttacgggttaactttacgtaactcggtacttagtactaataacgtaactacctacctaacttccttcttcgttcgttacggttacggtacggggtacgggttaacgggttcgggttacgggtaacccgtaccggttaaccgtaacggccgaaccggtaacccgttaacgtcccccg

SEQ ID NO: 300989 - DNA, 537 bp, Homo sapiens
  misc_feature: GZ8MTXP01BRVPP.38.36.D03.1.454.CMB.2.raw
  modified_base (456)..(456): a, c, t, g, unknown or other
  misc_feature (456)..(456): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccagcagtgacattggtcattataactctgtctcgtggtaaccaacaacacccagaccaacgacccccaaatcattatttatgagtccgaatcggcctcaggtatttctaatcgcttctctggcctacaagtctaggacaacaccgcctccctgacctatctctaggactccgaggctaggacggacgaggggctaggtaacttactacgtgctagttcaatataacaancaactacttcctcttcgtagttcgttcgggcggttacgggaaccagggtaacgaccgtacttaaagtccgaacgaaccccg

SEQ ID NO: 300990 - DNA, 691 bp, Homo sapiens
  misc_feature: GZ8MTXP01AO981.38.36.D03.1.454.CMB.2.raw
  modified_base (209)..(209): a, c, t, g, unknown or other
  misc_feature (209)..(209): n is a, c, g, or t
  modified_base (226)..(226): a, c, t, g, unknown or other
  misc_feature (226)..(226): n is a, c, g, or t
tcagtcgatcacgtcacgaccggtgctcgatttagctgcgtcacgatctctcttgggggggggtctcaggaggcagcgctctcaggacatctccaccatggcctgggctctgctgctcctcaccctctcactcaggcacagagtcctgggcccagtctgccctgactcagcctgcctccgagtctgcgtctcctggacagtcatcaccntctcctgcactgaaccngcagtgacattggcattataactctgtctgtacgaaccaacaccaccgacgaccaaccgacccctaaatctaatttatttacgagtacggtaccgtaacgtcccggcctacgaaggtactttactaacgtcgttaccttctccgtggtaccctactaacgtcgtacgacctaaaccgcccgtccctacccgtacgacctatccgtacgtaccggaccttacggacgtccgtaggggacggtaacggtaacgggggttacctttaaaatttccgttttaacgcggtacgttactttaccgaaacttaaaccttaaacccgaaaccctaacggtaaacaaaaccccttcgttacccgttaggttaaccgttaccgggttaccggggaaccggggttaccggaaaaccggcgtaccgtaaccggtaaccccggttacttaaccggttaaccaacccggtaaccccggg

SEQ ID NO: 300991 - DNA, 789 bp, Homo sapiens
  misc_feature: GZ8MTXP01CABJY.38.36.D03.1.454.CMB.2.raw
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgcgtctctggacagtcgatcaccatctctgcactggaaccagcagtgactatggtacattataacttctgtctcgtacgtaaccaacaaccgtaccacggtacccaaaccgacccccctaaaatcgtaattttaacgtttagtcgggtaacggttacccggtaaatcccgggtacccccttaggtaaacgggttaacttttaccgtaaacttccggtaaacccttttcgtaaccgttcgggtacccttaaccccgtaaagggttccctacggggtaccaaaacccgtccccgggtaccttaccccgtagaccctactttcccgtacgttacgaaccgttcccgaaggccgtaggaacgggacccgggtaggggttctaggtaactttaccgtaacgtcggtactaacggttttaccaaagttaacctaacggtaaacgtacccttaacctttaaccctttcccggtttaccttttcccgtttaaagggtttccggtttaccggggggttaccgggaaaccgggggtaacccgtagggggtttaacccggtaaccccggttacccggtttaagggtaacccgttaaccgggtaaccccccgggg

SEQ ID NO: 300992 - DNA, 503 bp, Homo sapiens
  misc_feature: GZ8MTXP01EXU44.38.36.D03.1.454.CMB.2.raw
  modified_base (372)..(372): a, c, t, g, unknown or other
  misc_feature (372)..(372): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctctgcactggaaccagcagtgacattggtcattataactctgtctcgtggtaccaacaacacccaggccaacgccccaaactcattattatgagtcgatcgcctcaggtattctatcgtacttctctgctcagtctgcaacacgctcctgacatctacncgactcgagctgagacgaggggctagattacactgctagttacatatacaagcaacttacttccttcttcgtgttaagttcgggcgggttacgggaaccgtgggtcgaccggtcaacggtcaacgaacccg

SEQ ID NO: 300993 - DNA, 733 bp, Homo sapiens
  misc_feature: GZ8MTXP01D15DL.38.36.D03.1.454.CMB.2.raw
  modified_base (229)..(229): a, c, t, g, unknown or other
  misc_feature (229)..(229): n is a, c, g, or t
tcagtcgatcacgtcacgaccggtgctcgatttagctgcgtcacgatctctcttgggggggggtctcaggaggcagcgctctcaggacatctccaccatggcctgggctctgctgctcctcaccctcctcactcagggcacagagtcctgggcccagtctgccctgactcagcctgcctcgagtctgcgtctcctggacagtcgatcaccatctctgcactaggaaccngcagtgactattgtacattatactctgtctcgtagtaaccaacaaccacccacggaccaaccgacccccaaatctaatttatttagagtacggtaccgaactccggaccctacgaggttaatttactaactccgtaacttctcgtcgtcctaccgaagttccgtacgggaccaaaccgtacccgggtcccttacccgtacgaaccctgttacccttccggtacggaacccttccgaacgggtctacgggaacgggacggtacggggtacgttaggttaaactttaccgtaacgttacggaccgttaagttttaccaaagtttaacgtaaaccgtaaaccgtaccttaaaccctttaaaccggttcccctttcccttttagttaacggtttttaaccgggttcccgggggaacgggttaaccgggggtaacccgtaacggggggtttaaccctaaccccgggtttaccgttaaaccggttcccgttaaacccgggtaacccccgg

SEQ ID NO: 300994 - DNA, 656 bp, Homo sapiens
  misc_feature: GZ8MTXP01BMDPA.38.36.D03.1.454.CMB.2.raw
  modified_base (229)..(229): a, c, t, g, unknown or other
  misc_feature (229)..(229): n is a, c, g, or t
  modified_base (394)..(394): a, c, t, g, unknown or other
  misc_feature (394)..(394): n is a, c, g, or t
  modified_base (622)..(622): a, c, t, g, unknown or other
  misc_feature (622)..(622): n is a, c, g, or t
tcagtcgatcacgtcacgaccggtgctcgatttagctgcgtcacgatctctcttgggggggggtctcaggaggcagcgctctcaggacatctccaccatggcctgggctctgctgctcctcaccctcctcactcagggcacagagtcctgggcccagtctgccctgactcagcctgcctcgagtctgcgtctcctggacagtcgatcaccatctcctgcactggaaccngcagtgactagttggtacattactaactctagtctcgtacggtaaccaacaaaccaccccgaacggacccaaaccgacccccctaaaacttctaatttaactttagtggtacgggtaccggaactccggaccctacgaacggtaactttctaaactcgtctttcncgtcggcctaccgtagtccgtggaccaaacccgtccggtaccccttccccgtagaaccctacttccgtaccggttacgggtacccttaccggacgggtcctaggggaacgggtaccgtagggggtccttaggtaactttaacgtacgtcgtactacggttacaataactacaacgtcctaactaccttcttactttcgtacggttacgttcggggcgacggtaaccgngggtctacccgtacttacgtccgaacgtaacccg

SEQ ID NO: 300995 - DNA, 656 bp, Homo sapiens
  misc_feature: GZ8MTXP01BCVUJ.38.36.D03.1.454.CMB.2.raw
  modified_base (231)..(231): a, c, t, g, unknown or other
  misc_feature (231)..(231): n is a, c, g, or t
  modified_base (551)..(551): a, c, t, g, unknown or other
  misc_feature (551)..(551): n is a, c, g, or t
tcagtcgatcacgtcacgaccggtgctcgatttagctgcgtcacgatctctcttgggggggggtctcaggaggcagcgctctcaggacatctccaccatggcctgggctctgctgctcctcaccctcctcactcaggcacagagtcctgggcccagtctgccctgactcagcctcgcctccgagtctgcgtctcctggacagtcgatcacctatctcctgcactggaaccngcagtgactagttggtacaattactaacttctcgtcctcggtacggtaaccaacaaaccacccgaacggtaccccaacgaccccctaaatctaatttactttagtcggtaacggtaccggtaacgtccggtccctacggaaggttaactttactaactccgtacttctcgtcggtacctacgtacgtcgtacggactaaccgaccgtccctacctacgacctactccgttcgacggtacctaccgagtaccgtaggaacgggacgtacgggggtcttaacggtaacttaccgtacttcggcttaacgtactataactaanactcctaacttacttccttcttacggtgttaacgggttcgggttacggggacgggtaaccgtacgggtccgtaacccggtacttaggtcccgaacgtaaccccgg

SEQ ID NO: 300996 - DNA, 677 bp, Homo sapiens
  misc_feature: GZ8MTXP01D34DD.38.36.D03.1.454.CMB.2.raw
  modified_base (600)..(600): a, c, t, g, unknown or other
  misc_feature (600)..(600): n is a, c, g, or t
tcagtcgatcacgtcacgaccggtgctcgatttagctgcgtcacgatctctcgttgggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcacatctctgcactggaaccagcagtgacattggtcattataactctgtctcgtagtaaccaacaaaccaccaggacccaacgaccccaaatctattattatgagtcgaatcggcctacgagtaatttctaatccgtcttctcgtggacctaccaagttccgtacggaccaaaccgacccggtcccctacccgtacgacctacttcctaccgtacggtacccttaccgaagggccgttagggaaacggacccgggtagggggtcctttaaggtaaacctttaaccgtaaaccgtcggtacgtaacgtttaacctaaattaaacttaaaccaaacgtaccctaacctttaacccttcccgtttacctttcgttacgttttaggttccccgggngggggttaaccggggtaaccggtacggggttccgtaaccggttacccgttaaagtcccgttaacccggtaaccccgg

SEQ ID NO: 300997 - DNA, 719 bp, Homo sapiens
  misc_feature: GZ8MTXP01CUHO0.38.36.D03.1.454.CMB.2.raw
  modified_base (121)..(121): a, c, t, g, unknown or other
  misc_feature (121)..(121): n is a, c, g, or t
  modified_base (203)..(203): a, c, t, g, unknown or other
  misc_feature (203)..(203): n is a, c, g, or t
  modified_base (239)..(239): a, c, t, g, unknown or other
  misc_feature (239)..(239): n is a, c, g, or t
tcagtcgatcacgtcacgaccggtgctcgatttagctgcgtcacgatctctcgttgggggggggtctcaggaggcagcgctctcaggacatctccaccatggcctgggctctgctgctccncacctcctcactcagggcacagagtcctgggcccagtccttccctgactcagcctgcctccgagtctgcgtctccgtggacngtcgatccaaccattcctcctgcacgtacggaaccngctagtgactagttcggtactaattacgtaacttcgtgtccttacggtacgtaacccaaacaaccaccccgaggaccctaaaccgaccccctaaactactatttacgtttaagaggtacgggtaccgaactccggacctacgtaacggttaactttactaacgtccgtcttcttcgtcggtctaaccggtaacgttcgacgggacccaaaccgtacccggtccccttacccgacgtacctaattcccgtacgtaacgggtacccttccgaacggacgttacgggaacggacggtacggtctaacggttaacttaaccacgtagtacctatactaataacctaagacctaacttacctcctttcccttcgtttaccgttggtttacggttccgggggaacggttaccgggggttaccgttaacgggggtcctaacccggtttacggaacggttacccgaaccgttaaccccgggtaaccgg

SEQ ID NO: 300998 - DNA, 646 bp, Homo sapiens
  misc_feature: GZ8MTXP01E1GN1.38.36.D03.1.454.CMB.2.raw
  modified_base (314)..(314): a, c, t, g, unknown or other
  misc_feature (314)..(314): n is a, c, g, or t
tcagtcgatcacgtcacgaccggtgctcgatttagctgcgtcacgatctctcttgggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccagcagcgacattggtcattataactctgtctcgtggtacccaacaaccaccccacggcccaacgcccccaaactctattatttangtacggtaccggaactccggccctcgaggtaatttctaatcgacttctctggcctccgtaagtctgggaccaacgaccggccctccctcgacccactccgtctcgggtaacctccgaggtcctggacggacgacgggggtctagtacttacctacgtggccaaggtttaccaacttaataacccgaacgtaccctaaacccttaccctttccccttcgtttccgttaacgggtttaacgttccggggttaccggggacgggggtaaccccggagggggttaacccgtaccccgggttacccttaaaacggttccgaaccggtaacccccggg

SEQ ID NO: 300999 - DNA, 663 bp, Homo sapiens
  misc_feature: GZ8MTXP01B8WXS.38.36.D03.1.454.CMB.2.raw
  modified_base (234)..(234): a, c, t, g, unknown or other
  misc_feature (234)..(234): n is a, c, g, or t
  modified_base (555)..(555): a, c, t, g, unknown or other
  misc_feature (555)..(555): n is a, c, g, or t
tcagtcgatcacgtcacgaccggtgctcgatttagctgcgtcacgatctctcttgggggggggtctcaggaggcagcgctctcaggacatctccaccatggcctgggctctgctgctcctcaccctcctcactcagggcacagagtcctgggcccagtcctgccctgactcagcctgcctccgagtctgcgtctcctggacagtcgatcacctatctcctgcacgtaggaaccngacagtgactagttcggtactaattaactaactcttgtcttcggtacggtaaccaaacaaaccgacccgaacggacccaaaccgaccccctaaactactaatttaatttagtacggacggttaccgaacgtcccggacctacgaaggttactttactaactccgtacctttctcgtacggtccttaccgtaacgttcgtacgggacctaaaccgcccggtacccttcccgtacacctacttcgtacgtacgtacctccgagtcgaggacggacggtaggggcttaggtaacttacgtaacgtgtaccgttatactaattanaaacgactactaacttaccttccttcgtttcgttacggttcgttcggggttcggacgggtaacggtacggtcgtaaccccgtagttaaccgtccgaacgtaaccccgg

SEQ ID NO: 301000 - DNA, 751 bp, Homo sapiens
  misc_feature: GZ8MTXP01B23ME.38.36.D03.1.454.CMB.2.raw
tcagtcgatcacgtcacgaccggtgctcgatttagctgcgtcacgatctctcttgggggggggtctcaggaggcagcgctctcaggacatctccaccatggcctgggctctgctgctcctcaccctcctcactcaggcacagagtcctgggcccagtctgccctgactcagcctgcctcgagtctgcgtctctggacagtcgatcaccatctcctgcactgaaccagcagtgacattggtcattataactctgtcgtcgtaggtaccaacaaaccacccgaacggaccaaacgaccccctaaaactctaaactttaactttaagtcggtaacggttaccggtaaacgtcccgggtacccctaccgtaaacgggtaaacttttactaaaaccgttccgtaaaccctttccgtaacgttcgggtacctacccgtaaacgttccgtacgggaccaaaccgtaccggtccctaccctacgaccctacttacctccgtttacgggaccttaccgacggttccgtaggaaacgggttaccggaaggggggtcccttagggtaaactttaccttaaaccggtcgtacgttaaacgttttaccaaacgtttaaaactaaaccgtaaaccgtaccgttaaaccctttacccgtttacccgtttacgtttaccgtttaacggtttacggttacggggttacgggttacgggtaaccgtacgggtaaccgtaccgtaccgttacgtaaccgaacgtaacccg

SEQ ID NO: 301001 - DNA, 708 bp, Homo sapiens
  misc_feature: GZ8MTXP01AZHS0.38.36.D03.1.454.CMB.2.raw
  modified_base (201)..(201): a, c, t, g, unknown or other
  misc_feature (201)..(201): n is a, c, g, or t
tcagtcgatcacgtcacgaccggtgctcgatttagctgcgtcacgatctctcttgggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacngtcgatcaccatctctgcactggaaccagcagtgactattggtacattaactaactctgtctcgtacgtaaccaacaaccacccacggaccaaccgaccccaaactctatttattagtggtacggtaccgaactcggcctacaggtaactttactaatcgtacttctcgtcgtctaccaacgtcgtacggacctaaccgaccggtccctcctacgacctacttccgtaccgtacgtacctccgaagggtcgtacggaacgggacggtacgggggtactacgggttaacctttaacgttacgttcggtaccttaaggttaacctaaacttaacgtaaacctaaacgtccctttaaaccttaacccgtttccctttaccgtttaccgtttacgggttttaaaccgttcccggggggttaacggggttaccgggggtaaacccggttacgggggtaacccgttacccgggttaccccgttaaagggtcccgttaacgggttaaccccggg

SEQ ID NO: 301002 - DNA, 641 bp, Homo sapiens
  misc_feature: GZ8MTXP01DXXAZ.38.36.D03.1.454.CMB.2.raw
  modified_base (316)..(316): a, c, t, g, unknown or other
  misc_feature (316)..(316): n is a, c, g, or t
  modified_base (362)..(362): a, c, t, g, unknown or other
  misc_feature (362)..(362): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcaggcacagagtcctgggcccagtctgccctgactcagcctgcctccgagtctgccgtctcctggacagtcgatcaccatcctcctgcactagaaccagcagtgactattggtacaattataactctgtctcgtacgtaaccaacaacacccaggaccaacgacccctaaatctatttatttangagtcgaatcgcctcagtattcgaatcgtcttctcgtgctcagtcnggacacaccggcctccagacctattcgtacgtcggacctcgacggctacggaacgggtacgacggggtacttaggtaactttacgtaccgtggtacctaggtttaacaacgttaaactaaaccgtaaacgtccctaaaccctttaacccgttcccgtttaacttttccgttaaacggttttaacggttcccggggacgggggttaaccgggtaaccccggtaggggttaacccggtaaccccggttaccgttaacggttcccgaaccggtaacccccgg

SEQ ID NO: 301003 - DNA, 674 bp, Homo sapiens
  misc_feature: GZ8MTXP01EA5S6.38.36.D03.1.454.CMB.2.raw
  modified_base (232)..(232): a, c, t, g, unknown or other
  misc_feature (232)..(232): n is a, c, g, or t
  modified_base (238)..(238): a, c, t, g, unknown or other
  misc_feature (238)..(238): n is a, c, g, or t
  modified_base (248)..(248): a, c, t, g, unknown or other
  misc_feature (248)..(248): n is a, c, g, or t
tcagtcgatcacgtcacgaccggtgctcgatttagctgcgtcacgatctctcgttgggggggggtctcaggaggcagcgctctcaggacatctccaccatggcctgggctctgctgctcctcaccctcctcactcagggcacagagtcctgggcccagtctgccctgactcagcctgcctcgagtctgcgtctcctaggacagtcgatcacctatctcctgcactggaaccngcagtnactagtggtntattatactctgtctcgtcgtaaccaacaaccacccgacgaccaacgacccccaaatctatttatttagtgtacggtaccgatccggccctacaggtaatttactaatccgtcttctcgtgtcctaccgtaagtcgtacgggtaccaaaccgcccggtccctccctacgacctacttcctacgtacggtacctccgacggacgtacggacgggtacggtacgggggtactaggtttaacttaaaccgtcgtcgtaccgtaaagtttacctaattaaactaaccaacgtacctaacttaaaccctttccgttaccttttacgttacggtttacgggttaccgggcgggttaacccgggggtaaccgttagggggtcccgttacccggttaacgttaaccggttaacccgaaccggttaacccccggg

SEQ ID NO: 301004 - DNA, 653 bp, Homo sapiens
  misc_feature: GZ8MTXP01DCQNY.38.36.D03.1.454.CMB.2.raw
  modified_base (232)..(232): a, c, t, g, unknown or other
  misc_feature (232)..(232): n is a, c, g, or t
  modified_base (239)..(239): a, c, t, g, unknown or other
  misc_feature (239)..(239): n is a, c, g, or t
  modified_base (258)..(258): a, c, t, g, unknown or other
  misc_feature (258)..(258): n is a, c, g, or t
  modified_base (317)..(317): a, c, t, g, unknown or other
  misc_feature (317)..(317): n is a, c, g, or t
tcagtcgatcacgtcacgaccggtgctcgatttagctgcgtcacgatctctcttgggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatccacctatctctgcactaggaaccngactagngactgttgtcattatactntgtctcgtagtaaccaacaccacccacgaccaaccgaccccaatctaatttagttaagnggacggtacggactccgccctagtaaggtaactttctaatccgtcttcgtcgtcggtactacccgttaagtccgtacggaccaaacgtcccggtaccctccccgtacgacctacttccgtacctacgggtacctacggtacggcgtacgggaacgggacctacgggggtacgtttacggtaaacttaccgtacgtcgtaacctaggtttaccaaattaactaacgaactacctaaccttaaccttccggttcttacggtttacggttcgttcggggttcggttacgggaacggtaaggtccggtaccgttaccgaagttcccgaacggtaaccccg

SEQ ID NO: 301005 - DNA, 539 bp, Homo sapiens
  misc_feature: GZ8MTXP01A58K7.38.36.D03.1.454.CMB.2.raw
  modified_base (212)..(212): a, c, t, g, unknown or other
  misc_feature (212)..(212): n is a, c, g, or t
  modified_base (215)..(215): a, c, t, g, unknown or other
  misc_feature (215)..(215): n is a, c, g, or t
  modified_base (256)..(256): a, c, t, g, unknown or other
  misc_feature (256)..(256): n is a, c, g, or t
  modified_base (315)..(315): a, c, t, g, unknown or other
  misc_feature (315)..(315): n is a, c, g, or t
  modified_base (332)..(332): a, c, t, g, unknown or other
  misc_feature (332)..(332): n is a, c, g, or t
  modified_base (352)..(352): a, c, t, g, unknown or other
  misc_feature (352)..(352): n is a, c, g, or t
  modified_base (380)..(380): a, c, t, g, unknown or other
  misc_feature (380)..(380): n is a, c, g, or t
  modified_base (395)..(395): a, c, t, g, unknown or other
  misc_feature (395)..(395): n is a, c, g, or t
  modified_base (450)..(450): a, c, t, g, unknown or other
  misc_feature (450)..(450): n is a, c, g, or t
  modified_base (461)..(461): a, c, t, g, unknown or other
  misc_feature (461)..(461): n is a, c, g, or t
tcagtcgatcacgtcacgaccggtgctcgatttagctgcgtcacgatctctcttgggggggggtctcaggaggcagcgctctcaggacatctccaccatggcctgggctctgctgctcctcaccctcctcactcagggcacagagtcctgggcccagtctcgccctgactcagcctgcctcgagtctgcgtctcctggacagtcgatcaccntcnctgcactggaaccagcagtcgacagttgtacattataactntgtactcgtacgtaaccaacaacacccgaggaccaacgtccccaaatctatttattagngacgtcgaatcgacctnagtattcatcgtcttctcgngtcacagtctgactacaccgcctccganccatcctgcggtacnccgagggctaacgaggaccgaggggctaggtaatttacacggtcgctagtctaanaacgtacaaanctaaccttccgttactccttgtagttcttcgggggacgacgggtaacagggttcaccgttccagtccaagaaccccgg

SEQ ID NO: 301006 - DNA, 495 bp, Homo sapiens
  misc_feature: GZ8MTXP02FWVNZ.38.36.D03.1.454.CMB.2.raw
  modified_base (227)..(227): a, c, t, g, unknown or other
  misc_feature (227)..(227): n is a, c, g, or t
  modified_base (458)..(458): a, c, t, g, unknown or other
  misc_feature (458)..(458): n is a, c, g, or t
tcagtcgatcacgtcacgaccggtgctcgatttagctgcgtcacgatctctcttggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccngcagtgacattggtcattataactctgtctcgtggtaccaacaacacccaggccaagcccccaaaactcattatttatgaggtccgaatcggcctccaggatttctaatcgcttctctggctccaagtctggcaacacgcctccctgaccatctctggactccaggctgaggacgaggctgattacactgcagttcatatacaagcactactcctcttctgttacttcggnggtaggaaccagggtcaccggtcctaagtcagacccg

SEQ ID NO: 301007 - DNA, 481 bp, Homo sapiens
  misc_feature: GZ8MTXP02I7F99.38.36.D03.1.454.CMB.2.raw
  modified_base (432)..(432): a, c, t, g, unknown or other
  misc_feature (432)..(432): n is a, c, g, or t
tcagtcgatcacgtcacgaccggtgctcgatttagctgcgtcacgatctctcttggggggtctcaggaggcagcgctctcaggacatctccaccatggcctgggctctgctgctcctcaccctcctcactcaggcacagagtcctgggcccagtctgccctgactcagcctgcctccgagtctgcgtctcctggacagtcgatcaccatctcctgcactggaaccagcagtgacattggtcattataactctgtctcgtggtaccaacaacacccaggccaagcccccaaatcattattatgagtcgaatcggcctcagattcaatcgcttctctggctccaagtctggcaacacgcctccctgaccatctctggactcagctgagcgagctgattacatgcagttcatatacaagcactactcctcttctnttacttcggcggtaggaacccgagggtcaccgtctaaggtcaacgcccg

SEQ ID NO: 301008 - DNA, 491 bp, Homo sapiens
  misc_feature: GZ8MTXP02HLUW3.38.36.D03.1.454.CMB.2.raw
tcagtcgatcacgtcacgaccggtgctcgatttagctgcgtcacgatctctcttgggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccagcagtgacattggtcattataactctgtctcgtggtaccaacaacacccaggccaagcccccaaatcattatttatgagtccgaatcggcctccagaattctaatcgcttctctgctccaagtctgcaacacgcctccctgaccatctctgactccaggctgaggacgaggcttgattactactgcagttcatatacaagcaactactcctctcttgttacttcggcggtaggaaccagggtcaccgtactaacggtcagacccg

SEQ ID NO: 301009 - DNA, 492 bp, Homo sapiens
  misc_feature: GZ8MTXP02IFS78.38.36.D03.1.454.CMB.2.raw
  modified_base (407)..(407): a, c, t, g, unknown or other
  misc_feature (407)..(407): n is a, c, g, or t
  modified_base (425)..(425): a, c, t, g, unknown or other
  misc_feature (425)..(425): n is a, c, g, or t
tcagtcgatcacgtcacgaccggtgctcgatttagctgcgtcacgatctctcttggggggtctcaggaggcagcgctctcaggacatctccaccatggcctgggctctgctgctcctcaccctcctcactcagggcacagagtcctgggcccagtctgccctgactcagcctgcctcgagtctgcgtctcctggacagtcgatcaccatctcctgcactggaaccagcagtgacattggtcattataactctgtctcgtggtaccaacaacaccaggccaacgcccccaaatcattatttatgagtcgatcggcctcagtatttcaatcgcttctctggctccagtctggcaacacgcctccctgaccatctctcggactccagctgagacgaggctgattactacngacagttcatataacacnctactactcctcttactgtttactcggcgtaggaaccgtagggtcaccgtctaacggtcacgacccg

SEQ ID NO: 301010 - DNA, 539 bp, Homo sapiens
  misc_feature: GZ8MTXP02JJS26.38.36.D03.1.454.CMB.2.raw
  modified_base (254)..(254): a, c, t, g, unknown or other
  misc_feature (254)..(254): n is a, c, g, or t
tcagtcgatcacgtcacgaccggtgctcgatttagctgcgtcacgatctctcgttggggggtctcaggaggcagcgctctcaggacatctccaccatggcctgggctctgctgctcctcaccctcctcactcagggcacagagtcctgggcccagtctgtcctgactcagcctgcctccgagtctgccgtctcctggacagtcgatcaccatcctctgcactggaaccagcagtgacattggtcattataactntgtctcgtgtaccaacaacaccaggaccaacgcccccaaaactcaatttatttatagacggtaccgaatccggcctcgagtaactttactaatcgtacttctcgtcgctaccaagtctggaccaacaccgccctccgtacgacctatcctctcggaccttccgaggctaggacgggacgaggcctgtacttacgtactgctagttcatataacaagcactactctcttctgttacgttcggacggaggtaaccgaggtacgaccgtactagtaccgacgtacccg

SEQ ID NO: 301011 - DNA, 518 bp, Homo sapiens
  misc_feature: GZ8MTXP02G56FC.38.36.D03.1.454.CMB.2.raw
  modified_base (303)..(303): a, c, t, g, unknown or other
  misc_feature (303)..(303): n is a, c, g, or t
  modified_base (426)..(426): a, c, t, g, unknown or other
  misc_feature (426)..(426): n is a, c, g, or t
  modified_base (489)..(489): a, c, t, g, unknown or other
  misc_feature (489)..(489): n is a, c, g, or t
tcagtcgatcacgtcacgaccggtgctcgatttagctgcgtcacgatctctcttgggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccagcagtgacattggtcattataactctgtctcgtggtaccaacaacaccaggccaagcccccaaactcatttatttangacggtccgaatcggcctcaggaatttcaatcgcttctctggctccaagtctggcaacacgcctaccctgaccatcctctggactccaactgagacgaggctcactattattgcagctcatanacaagcaagcgtcacgttggggtcgttcggacgggaggacccgtaaccgtggaaccccggttntttaacgggtccaacggccccctaaaggg

SEQ ID NO: 301012 - DNA, 518 bp, Homo sapiens
  misc_feature: GZ8MTXP02FW0O3.38.36.D03.1.454.CMB.2.raw
  modified_base (229)..(229): a, c, t, g, unknown or other
  misc_feature (229)..(229): n is a, c, g, or t
tcagtcgatcacgtcacgaccggtgctcgatttagctgcgtcacgatctctcttgggggggtctcaggaggcagcgctctcaggacatcctccaccatggcctgggctctgctgctcctcaccctcctcactcagggcacagggtcctgggcccagtctgccctggctcagcctgcctccgtgtctgggtctcctggacagtcgatcaccatctcctgcactggaaccngcagtgacgttggtggttataaatttgtctctggtaccaacagcacccggcaatcgacccccaaaatcatgatttatgagtcactcatcggccctcgaggggtttctaatcgcttctctgcatccaagtctggacaacacggccctccctgaccatctcgtcggcctccgaggctagaggacgaggtacttaatttatttctgctagttcatataacaaccagacaacactctgctaagttcggacggaacggaccaaagcgtacgaccgtactaagtcacgccaacgg

SEQ ID NO: 301013 - DNA, 496 bp, Homo sapiens
  misc_feature: GZ8MTXP02IH6K7.38.36.D03.1.454.CMB.2.raw
tcagtcgatcacgtcacgaccggtgctcgatttagctgcgtcacgatctctcttggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccagcagtgacattggtcattataactctgtctcgtggtaccaacaacaccaggccaaagcccccaaatcattatttatgaggtccgaatcggccctcaggatttctaatcgcttctctggctccaagtctggcaacacgctccctgaccatctctggactcagctgaggacgaggctgattactactgcagttcatatacaagcactactcctcttactgttacttcgggcgtaggggaacctagggtcgaccggtcctaagtcagacccg

SEQ ID NO: 301014 - DNA, 505 bp, Homo sapiens
  misc_feature: GZ8MTXP02JZ8DH.38.36.D03.1.454.CMB.2.raw
  modified_base (342)..(342): a, c, t, g, unknown or other
  misc_feature (342)..(342): n is a, c, g, or t
tcagtcgatcacgtcacgaccggtgctcgatttagctgcgtcacgatctctcttgggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccagcagtgacattggtcattataactctgtctcgtggtaccaacaacacccaggcccaagcccccaaaatcattatttatgaggtccgaatcggccctcaggatttctaatcgcttcnctggctccagtctggcaacacggccctccctgaccatctctggactccaggctgaggacgaggctgattactactgcctagttcatatacaagctactactcctctttactgttacttcggcggtagggaaccgtagggtcgaccgtcctaagtccagacccg

SEQ ID NO: 301015 - DNA, 487 bp, Homo sapiens
  misc_feature: GZ8MTXP02IMX5A.38.36.D03.1.454.CMB.2.raw
  modified_base (427)..(427): a, c, t, g, unknown or other
  misc_feature (427)..(427): n is a, c, g, or t
tcagtcgatcacgtcacgaccggtgctcgatttagctgcgtcacgatctctcttggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccagcagtgacattggtcattataactctgtctcgtggtaccaacaacaccaggccaagcccccaaatcattatttatgaggtccgaatcggcctcagatttctaatcgcttctctggctccaagtctggcaacacgcctccctgaccatctctggactcaggctgaggacgaggctgattacgactgcagttcatatacaancactactcctcttctgttacttcggcgaggaaccagggtcgaccgtctaagtcagacccg

SEQ ID NO: 301016 - DNA, 479 bp, Homo sapiens
  misc_feature: GZ8MTXP02G6OE9.38.36.D03.1.454.CMB.2.raw
  modified_base (432)..(432): a, c, t, g, unknown or other
  misc_feature (432)..(432): n is a, c, g, or t
tcagtcgatcacgtcacgaccggtgctcgatttagctgcgtcacgatctctcttggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccagcagtgacattggtcattataactctgtctcgtgtaccaacaacaccaggccaagcccccaaatcatttattatgagtccgaatcggcctcagatttctaatcgcttctctgctccaagtctggcaacacgcctccctgaccatctctgactcagctgagcgagctgattacactgcagttcatatacaagctactactctcttntcgttactcggcgtaggccgaggtcgtaccgtctaagtccagacccg

SEQ ID NO: 301017 - DNA, 517 bp, Homo sapiens
  misc_feature: GZ8MTXP02I7LAW.38.36.D03.1.454.CMB.2.raw
  modified_base (228)..(228): a, c, t, g, unknown or other
  misc_feature (228)..(228): n is a, c, g, or t
tcagtcgatcacgtcacgaccggtgctcgatttagctgcgtcacgatctctcttgggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccngcagtgacattggtcattataactctgtctcgtggtaccaacaacaccaggccaacgcccccaaactcattatttatgacggtccgaatcggccctcaggtaatttctaactcgtcttctctggctccaagtctggcaacacgcctccctgaccatctctcggactccgagctgaggacgaggctgattactactgactagttcaatatacaagctaactctccttcttctcgttacttccggacggtaggaaccgtggggtacgtaccgtctaaacgtcacgtacccg

SEQ ID NO: 301018 - DNA, 492 bp, Homo sapiens
  misc_feature: GZ8MTXP02IUUY7.38.36.D03.1.454.CMB.2.raw
  modified_base (418)..(418): a, c, t, g, unknown or other
  misc_feature (418)..(418): n is a, c, g, or t
  modified_base (467)..(467): a, c, t, g, unknown or other
  misc_feature (467)..(467): n is a, c, g, or t
tcagtcgatcacgtcacgaccggtgctcgatttagctgcgtcacgatctctcttgggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccagcagtgacattggtcattataactctgtctcgtggtaccaacaacacccaggccaaagcccccaaaactcatttatttatgaggtccgaatcggcctcaggatttctaatcgcttctctggctccaagtctggcaacacgcctccctgaccatctctcggactccaggctgaggacgaggctgattactacngcagttcatatacaagcactactctctctgtacttcggcgtaggaaccngggtcgaccgtctaagtcagacccg

SEQ ID NO: 301019 - DNA, 515 bp, Homo sapiens
  misc_feature: GZ8MTXP02JQUFA.38.36.D03.1.454.CMB.2.raw
tcagtcgatcacgtcacgaccggtgctcgatttagctgcgtcacgatctctcttgggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccagcagtgacattggtcattataactctgtctcgtggtaccaacaacacccaggccaacgcccccaaactcattatttatgagtccgaatcggccctcagaatttctaatcgcttctctgctccaagtctcggcaacacgccctccctgaccatctctggactccagctagaggacgaggctagtacttactactgctagttcaatataacaagctactactcctacttctacgttacttcggacggacggaacgtacgggtcgaccggttctaaacgtccacgacccg

SEQ ID NO: 301020 - DNA, 537 bp, Homo sapiens
  misc_feature: GZ8MTXP02H5GPH.38.36.D03.1.454.CMB.2.raw
  modified_base (429)..(429): a, c, t, g, unknown or other
  misc_feature (429)..(429): n is a, c, g, or t
tcagtcgatcacgtcacgaccggtgctcgatttagctgcgtcacgatctctcttgggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccagcagtgacattggtcattataactctgtctcgtggtaccaacaacacccaggccaacgccccaaactcattattatgaggtccgaatcggcctcagatttcaatcgcttctctgctccaagtctggcaacacgcctccctgaccatctactcggactccaggctgaggacgaggctgattactagtgacagtttcaattanaactaacgactactacttccttcttacctggtttaacgttccggggcggtacggggtaacccgtacggggtacgaccccggttacgtaaacgttccgaaacggccccg

SEQ ID NO: 301021 - DNA, 504 bp, Homo sapiens
  misc_feature: GZ8MTXP02HNBV8.38.36.D03.1.454.CMB.2.raw
  modified_base (306)..(306): a, c, t, g, unknown or other
  misc_feature (306)..(306): n is a, c, g, or t
tcagtcgatcacgtcacgaccggtgctcgatttagctgcgtcacgatctctcttgggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccagcagtgacattggtcattataactctgtctcgtggtaaccaacaacacccaggccaacgcccccaaatcattatttangagtccgaatcggcctcaggtaatttctaatcgacttctctgctccaagtctggacaacacgccctccctgaccatctctggactcagctgaggacgaggctgattacgactgctagtcatatacaagctaactactcctcttctagttacgttcggcggtagggaaccagggtcgaccgcctaaacgtcacgacccg

SEQ ID NO: 301022 - DNA, 488 bp, Homo sapiens
  misc_feature: GZ8MTXP02G1ISI.38.36.D03.1.454.CMB.2.raw
  modified_base (463)..(463): a, c, t, g, unknown or other
  misc_feature (463)..(463): n is a, c, g, or t
tcagtcgatcacgtcacgaccggtgctcgatttagctgcgtcacgatctctcttgggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccagcagtgacattggtcattataactctgtctcgtgtaccaacaacacccaggccaacgcccccaaactcattatttatgaggtccgaatcggcctcagatttcaatcgcttctctgctccagtctggcaacacgcctccctgaccatctctcggactccagctgaggacgaggctgattactactgctagtcatatacaagctactactccttctctcgttactcggcgaggaacngggtacacgtcgacgtcacgacccg

SEQ ID NO: 301023 - DNA, 494 bp, Homo sapiens
  misc_feature: GZ8MTXP02H23UN.38.36.D03.1.454.CMB.2.raw
  modified_base (430)..(430): a, c, t, g, unknown or other
  misc_feature (430)..(430): n is a, c, g, or t
tcagtcgatcacgtcacgaccggtgctcgatttagctgcgtcacgatctctcttgggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccagcagtgacattggtcattataactctgtctcgtggtaccaacaacaccccaggccaacgcccccaaactcattatttatgagtccggaatcggcctcaggaatttctaatcgcttctctggctccaagtctggcaacacggcctccctgaccatctctgactcagctgaggcgaggctgattactatgcagttcatatacancactactcctcttctgttacttcggacggaggaaccagggtcgaccgtctaacgtcacgacccg

SEQ ID NO: 301024 - DNA, 491 bp, Homo sapiens
  misc_feature: GZ8MTXP02IXRG3.38.36.D03.1.454.CMB.2.raw
tcagtcgatcacgtcacgaccggtgctcgatttagctgcgtcacgatctctcttggggggcctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccagcagtgacattggtcattataactctgtctcgtggtaccaacaacaccaggccaagccccccaaaactcattatttatgacggtccgaatcggccctcgaggaatttctaaatcgcttctctgctccaagtctggcaacacgcctccctgaccatctctggactcagctgagacgaggctgattactactgcagttcatatacaagcaactactctcttctgttattcggcgtaggaaccagggtcacgtcacgtcacgacccg

SEQ ID NO: 301025 - DNA, 501 bp, Homo sapiens
  misc_feature: GZ8MTXP02H22TM.38.36.D03.1.454.CMB.2.raw
  modified_base (227)..(227): a, c, t, g, unknown or other
  misc_feature (227)..(227): n is a, c, g, or t
  modified_base (355)..(355): a, c, t, g, unknown or other
  misc_feature (355)..(355): n is a, c, g, or t
  modified_base (359)..(359): a, c, t, g, unknown or other
  misc_feature (359)..(359): n is a, c, g, or t
  modified_base (366)..(366): a, c, t, g, unknown or other
  misc_feature (366)..(366): n is a, c, g, or t
  modified_base (371)..(371): a, c, t, g, unknown or other
  misc_feature (371)..(371): n is a, c, g, or t
  modified_base (387)..(387): a, c, t, g, unknown or other
  misc_feature (387)..(387): n is a, c, g, or t
tcagtcgatcacgtcacgaccggtgctcgatttagctgcgtcacgatctctcttgggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctctgcactggaaccngcagtgacattggcattataactctgtctcgtgtaccaacaacaccaggccaacgccccaaactcattattatgaggtaccgatcggcctcagtatttctaatcgcttctctgctccagtctgcaacncgcncctgacntctcngactcagctgagacgnggctgattacactgcagttcatactacacgactactacttacctcttactgtttacgtcgggtacggacgggtaaccgtagggtacgaccggttactaaacggtcaacggcccg

SEQ ID NO: 301026 - DNA, 505 bp, Homo sapiens
  misc_feature: GZ8MTXP02G2GYO.38.36.D03.1.454.CMB.2.raw
  modified_base (228)..(228): a, c, t, g, unknown or other
  misc_feature (228)..(228): n is a, c, g, or t
  modified_base (305)..(305): a, c, t, g, unknown or other
  misc_feature (305)..(305): n is a, c, g, or t
  modified_base (459)..(459): a, c, t, g, unknown or other
  misc_feature (459)..(459): n is a, c, g, or t
tcagtcgatcacgtcacgaccggtgctcgatttagctgcgtcacgatctctcttgggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccngcagtgacatggtcattataactctgtctcgtggtaccaacaacaccaggccaacgcccccaaatcccattatttangaggtccgaatcggcctcaggtatttcaatcgacttctctggctccaagtctggacaacaccgcctccctgaccctatcctctcggaccttccgaggcctgaggaccgaggctagattacatgcagttcaatatacaagcaactactctcttcngtttactcggcgaggaaccgaggtcgacgtcctaagtcagtacccg

SEQ ID NO: 301027 - DNA, 512 bp, Homo sapiens
  misc_feature: GZ8MTXP02JO3N5.38.36.D03.1.454.CMB.2.raw
  modified_base (228)..(228): a, c, t, g, unknown or other
  misc_feature (228)..(228): n is a, c, g, or t
  modified_base (366)..(366): a, c, t, g, unknown or other
  misc_feature (366)..(366): n is a, c, g, or t
  modified_base (454)..(454): a, c, t, g, unknown or other
  misc_feature (454)..(454): n is a, c, g, or t
tcagtcgatcacgtcacgaccggtgctcgatttagctgcgtcacgatctctcttgggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccngcagtgacattggtcattataactctgtctcgtggtaccaacaacaccaggccaacgcccccaaactcattattatgaggtccgaatcggcctcaggtaatttctaatcgcttctctggctccaagtctggctaaacncgccctccctgaccatctctcggactccgaggctgaggacgaggctagattactactgctagttcatatacaagctactactctcttntacgttacgtcggtcggacggaaccgtagggtacgaccgtctaacgtcgacgaacccg

SEQ ID NO: 301028 - DNA, 495 bp, Homo sapiens
  misc_feature: GZ8MTXP02HQF98.38.36.D03.1.454.CMB.2.raw
  modified_base (228)..(228): a, c, t, g, unknown or other
  misc_feature (228)..(228): n is a, c, g, or t
  modified_base (468)..(468): a, c, t, g, unknown or other
  misc_feature (468)..(468): n is a, c, g, or t
tcagtcgatcacgtcacgaccggtgctcgatttagctgcgtcacgatctctcttgggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccngcagtgacattggcattataactctgtctcgtggtaccaacaacaccaggccaagcccccaaatcacttatttatgaggtccgaatcggcctcagatttcaatcgcttctctggctccagtctggcaacaccggcctccctgacccatcctctcggactccaggctgaggacgaggctgattactactgctagttcatatacaagcactactctcttctgttactcggcggaggaaccgnggtacgaccgtactacgtcacgacccg

SEQ ID NO: 301029 - DNA, 542 bp, Homo sapiens
  misc_feature: GZ8MTXP02JNLXK.38.36.D03.1.454.CMB.2.raw
  modified_base (372)..(372): a, c, t, g, unknown or other
  misc_feature (372)..(372): n is a, c, g, or t
  modified_base (455)..(455): a, c, t, g, unknown or other
  misc_feature (455)..(455): n is a, c, g, or t
tcagtcgatcacgtcacgaccggtgctcgatttagctgcgtcacgatctctcttgggggggtctcaggaggcagcgctctcaggacatctccaccatggcctgggctctgctgctcctcaccctcctcactcagggcacagagtcctgggcccagtctgccctgactcagcctgcctccgagtctgccgtctcctggacagtcgatcaccatctcctgcactggaaccagcagtgacattggtcattataactctgtctcgtgtaccaacaacaccaggaccaacgacccccaaactcaatttatttatgaggtccgaatccggcctccagtaatttctaatcgtcttctctgctccgaagtctggacaacncgccctccctgaccatctactcggactcgagctgacggcgaggctagtacttactacgtgactagttacatactaacgaaacncctactaccttccttcttacttagttacgttcggacggtacggaaccgtaggggtacgtaccgtactaacggtccgaacggtacccg

SEQ ID NO: 301030 - DNA, 502 bp, Homo sapiens
  misc_feature: GZ8MTXP02ILGG4.38.36.D03.1.454.CMB.2.raw
  modified_base (460)..(460): a, c, t, g, unknown or other
  misc_feature (460)..(460): n is a, c, g, or t
tcagtcgatcacgtcacgaccggtgctcgatttagctgcgtcacgatctctcttgggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatcctcctgcactggaaccagcagtgacattggtcattataactctgtctcgtggtacccaacaacacccaggccaaacgcccccaaatcatttatttatgaggtccgaatcggcctcagtatttcaatcgcttctctgctcagtctggacaacacgcctccctgaccatctactcggactccgagctgaggaccgaggctgattacactgctagtcatatacagctactactctcttctagttactcggngacggtaacgagggtcgtaccgtacgaacgtcaacgtacccg

SEQ ID NO: 301031 - DNA, 495 bp, Homo sapiens
  misc_feature: GZ8MTXP02JVGDQ.38.36.D03.1.454.CMB.2.raw
  modified_base (226)..(226): a, c, t, g, unknown or other
  misc_feature (226)..(226): n is a, c, g, or t
tcagtcgatcacgtcacgaccggtgctcgatttagctgcgtcacgatctctcttggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcatggaaccngcagtgacattggtcattataactctgtctcgtgtaccaacacaccagccaagccccaaatcattattatgagtccgaatcggcctcagtaattctaatcgcttctctgctccaagtctggccaacaccgcctcccgtgaccctatcctactcggactcccgagggctggacggacgaggctgattactactgcagttcatatacaagcactactctcttctgttatcggcggtagggaaccagggtcacggtctaacgtcacgacccg

SEQ ID NO: 301032 - DNA, 523 bp, Homo sapiens
  misc_feature: GZ8MTXP02JZDN2.38.36.D03.1.454.CMB.2.raw
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccagcagtcgacattggtcattataactctgtctcgtgtaccaacaaccaccaggaccaacgcccccaaaactcattattatgaggtaccgaatcggcctcgagtaatttcaatcgcttctctggctacaagtctggacaacaccgccctccctcgaccactctcgtggacctccgaggctaggaggacgaggctagattactactgctagttcatactacagctactactcctctttactgttacgtccggaggtacgggaacgtacggggtcgacccgtctacgtcacgtacccg

SEQ ID NO: 301033 - DNA, 585 bp, Homo sapiens
  misc_feature: GZ8MTXP02GWOHQ.38.36.D03.1.454.CMB.2.raw
  modified_base (229)..(229): a, c, t, g, unknown or other
  misc_feature (229)..(229): n is a, c, g, or t
  modified_base (248)..(248): a, c, t, g, unknown or other
  misc_feature (248)..(248): n is a, c, g, or t
  modified_base (253)..(253): a, c, t, g, unknown or other
  misc_feature (253)..(253): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccngcagtgacattgtcattanaactntgtctcgtgtaccaacaaccacccaggaccaacgacccctaaactctaatttatttatgtacggtaccgaatccggcctacaggtaatttctaatcgtcttctctggctcaagtctggaccaacaccgcctcccagaccatcctactggacctccgagcctaggacggacggaggtctagtaacttacgtactcgactagttactaatactaacaaacgtacctaacttaacccttccttactttaccttaggttttaccgttaccggggacgggtacgggaaccgtaggggttaccgacccgttaccgtaacgttccgaaccgtaccccgg

SEQ ID NO: 301034 - DNA, 529 bp, Homo sapiens
  misc_feature: GZ8MTXP02HP97S.38.36.D03.1.454.CMB.2.raw
  modified_base (306)..(306): a, c, t, g, unknown or other
  misc_feature (306)..(306): n is a, c, g, or t
  modified_base (403)..(403): a, c, t, g, unknown or other
  misc_feature (403)..(403): n is a, c, g, or t
  modified_base (473)..(473): a, c, t, g, unknown or other
  misc_feature (473)..(473): n is a, c, g, or t
tcagtcgatcacgtcacgaccggtgctcgatttagctgcgtcacgatctctcttgggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccagcagtgacattggtcattataactctgtctcgtgtacccaacaacacccaggaccaagcccccaaatcatttatttangaggtcgaatcggcctcagtatttcaatcgcttctctgctccaagtctggcaacacgcctccctcgaccatctctcggactccgaggctgaggacgnggtctgattacactgactagttcatactaacaagcctactaaccttcttcgttcttgtttacgtccgggnggtaacgggaaccgtaaggggtcgtacccggttacctaaacggtccaacgaccccg

SEQ ID NO: 301035 - DNA, 593 bp, Homo sapiens
  misc_feature: GZ8MTXP02HVLJN.38.36.D03.1.454.CMB.2.raw
  modified_base (227)..(227): a, c, t, g, unknown or other
  misc_feature (227)..(227): n is a, c, g, or t
tcagtcgatcacgtcacgaccggtgctcgatttagctgcgtcacgatctctcgttggggggggtctcaggaggcagcgctctcaggacatctccaccatggcctgggctctgctgctcctcaccctcctcactcaggcacagagtcctgggcccagtctgccctgactcagcctgcctccgagtctgcgtctcctggacagtcatcaccatctcctgcatggaaccngcagtgacattggctattataactctgtctcgtgtaaccaacaaccacccaggaccaaaccgacccccaaactcaatttattatggacggtccggaatccggcctacgaggtaactttcaatcgtcttctctgtctccgtaagtctcggaccaaccgaccgtcccctacccttcgaaccctacttccttaccgtacgggtacctcccgaagggtcctagggacgggacggagggtctagtaactttacgactgactagtttacattaactaacaaacgtacctaacctacttccttacttcttacggtttacgtcgggacggacggaaccgtggtacgacccgtactacggtcctacggaccccgg

SEQ ID NO: 301036 - DNA, 498 bp, Homo sapiens
  misc_feature: GZ8MTXP02GPTDW.38.36.D03.1.454.CMB.2.raw
  modified_base (268)..(268): a, c, t, g, unknown or other
  misc_feature (268)..(268): n is a, c, g, or t
  modified_base (375)..(375): a, c, t, g, unknown or other
  misc_feature (375)..(375): n is a, c, g, or t
tcagtcgatcacgtcacgaccggtgctcgatttagctgcgtcacgatctctcttggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccagcagtgacattggtcattataactctgtctcgtgtaccaanaacaccaggccaagcccccaaatcattattatgagtccgaatcggcctcagaatttcaatcgcttctctgctccaagtctggcaacacgcctccctgacccatctcnggactccaggctgacggacgaggctgattactactgcagttcatatacagcactactctcttctagttacttcgggcggtacggaaccgagggtacgaccggtacctaaggtccacgaccccg

SEQ ID NO: 301037 - DNA, 500 bp, Homo sapiens
  misc_feature: GZ8MTXP02GL5II.38.36.D03.1.454.CMB.2.raw
  modified_base (228)..(228): a, c, t, g, unknown or other
  misc_feature (228)..(228): n is a, c, g, or t
  modified_base (305)..(305): a, c, t, g, unknown or other
  misc_feature (305)..(305): n is a, c, g, or t
  modified_base (459)..(459): a, c, t, g, unknown or other
  misc_feature (459)..(459): n is a, c, g, or t
tcagtcgatcacgtcacgaccggtgctcgatttagctgcgtcacgatctctcttgggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccngcagtgacattggtcattataactctgtctcgtggtaccaacaacacccaggccaagcccccaaactcattatttangagtccgaatcggcctcaggaatttctaatcgcttctctggctccaagtctggcaacacggcctccctgaccatctctggactccaggctgaggacgaggctgattactacgtgcagttcatatacagcactactctacttctgttacttcggnggtaggaaccgtagggtcgaccgtctaacgtcagtaccccg

SEQ ID NO: 301038 - DNA, 563 bp, Homo sapiens
  misc_feature: GZ8MTXP02GYUTB.38.36.D03.1.454.CMB.2.raw
  modified_base (253)..(253): a, c, t, g, unknown or other
  misc_feature (253)..(253): n is a, c, g, or t
  modified_base (470)..(470): a, c, t, g, unknown or other
  misc_feature (470)..(470): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccagcagtgacatggtcattataactntgtctcgtgtaccaacaaccaccacgaccaacgacccccaaatcattattatgaggtccgaatcggcctacgagtaatttactaatcgtacttctcgtcggtcctaccgtaacgtctagggaccaaaccgaccggccctccctacgaccctatcctctcggacctcgaggcctagacggacgaggctagtattactatgactagttacatatacaanactactacttcctcttactcgtttacgtaccggacgggtacgggaaccgtaggggtaccgtacccgtaccgtaacgtaccgacgtaaccccgg

SEQ ID NO: 301039 - DNA, 534 bp, Homo sapiens
  misc_feature: GZ8MTXP02F4XKQ.38.36.D03.1.454.CMB.2.raw
  modified_base (225)..(225): a, c, t, g, unknown or other
  misc_feature (225)..(225): n is a, c, g, or t
  modified_base (380)..(380): a, c, t, g, unknown or other
  misc_feature (380)..(380): n is a, c, g, or t
tcagtcgatcacgtcacgaccggtgctcgatttagctgcgtcacgatctctcttgggggggtctcaggaggcagcgctctcaggacatctccaccatggcctgggctctgctgctcctcacctcctcactcagggcacagagtcctgggcccagtctgccctgactcagcctgcctccgtgtctgggtctcctggacagtcgatcaccatctcctgcactggaancagtagtgacattggtggttataactctgtctcctggtaccaacaacacccaggcaaacgcccccaaactcatcatttatgacgtcactcatcgcccctcgagggtttctactcgcttctctgctcagttgcaacacgcctccctgaccatttcnggctccaggctgagacgaggctagtatttatgtctctccatatacaggcagtcagcctaccccttatcgttaccgttacggaacgttacgggaaccctaacgggtccaacccggttaccttaccggtaccaacggaccccaaacggaacccccc

SEQ ID NO: 301040 - DNA, 500 bp, Homo sapiens
  misc_feature: GZ8MTXP02HFRB6.38.36.D03.1.454.CMB.2.raw
  modified_base (228)..(228): a, c, t, g, unknown or other
  misc_feature (228)..(228): n is a, c, g, or t
tcagtcgatcacgtcacgaccggtgctcgatttagctgcgtcacgatctctcttgggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccngcagtgacattgtcattataactctgtctcgtgtaccaacaacaccaggaccaacgccccaaactcattattatgaggtcgaatcggcctccagatttctaatcgcttctctgctccagtctggacacaccgctccctgaccatctctgactccgagctgaggacgaggcttagattacatgacagttcatatacaagctactactctctttctagttacgtcggcggtagggaaccgtagggtcgacccggttactacgtacgacgacccg

SEQ ID NO: 301041 - DNA, 511 bp, Homo sapiens
  misc_feature: GZ8MTXP02I673V.38.36.D03.1.454.CMB.2.raw
  modified_base (420)..(420): a, c, t, g, unknown or other
  misc_feature (420)..(420): n is a, c, g, or t
  modified_base (468)..(468): a, c, t, g, unknown or other
  misc_feature (468)..(468): n is a, c, g, or t
tcagtcgatcacgtcacgaccggtgctcgatttagctgcgtcacgatctctcgttggggggggtctcaggaggcagcgctctcaggacatctccaccatggcctgggctctgctgctcctcaccctcctcactcagggcacagagtcctgggcccagtctgccctgactcagcctgcctcgagtctgcgtctcctggacagtcgatcaccatctcctgcactggaaccagcagtgacattggtcattataactctgtctcgtggtaccaacaacaccaggccaacgcccccaaatcatttatttatgaggtccgaatcggccctcaggaatttctaatcgcttctctgctccaagtctggcaacacgcctccctgaccatctctcggactcgagctgaggacgaggctgacttacgtacngctagttcaatataacaacgcactactcctcttcttagttacttcggnggacgggaaccgaggggtcaccgtctaacgtcgacgtacccgg

SEQ ID NO: 301042 - DNA, 529 bp, Homo sapiens
  misc_feature: GZ8MTXP02GHGE6.38.36.D03.1.454.CMB.2.raw
  modified_base (229)..(229): a, c, t, g, unknown or other
  misc_feature (229)..(229): n is a, c, g, or t
  modified_base (248)..(248): a, c, t, g, unknown or other
  misc_feature (248)..(248): n is a, c, g, or t
  modified_base (426)..(426): a, c, t, g, unknown or other
  misc_feature (426)..(426): n is a, c, g, or t
  modified_base (463)..(463): a, c, t, g, unknown or other
  misc_feature (463)..(463): n is a, c, g, or t
  modified_base (469)..(469): a, c, t, g, unknown or other
  misc_feature (469)..(469): n is a, c, g, or t
  modified_base (482)..(482): a, c, t, g, unknown or other
  misc_feature (482)..(482): n is a, c, g, or t
  modified_base (493)..(493): a, c, t, g, unknown or other
  misc_feature (493)..(493): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccngcagtgacatggtcattanaactctgtctcgtagtaaccaaacaacacccacggaccaaacgaccccctaaaactctaatttaatttataggaacggtaccggaaatccgggccctaccgaaggtaatttactaaatcgtcttctctgctacaagtctaggcaacacgccctcctgaccatctctcggactcgagcngaggacgaggctgaatttacactgctagttacaatanaacaanactactctctctntgtacgtcggnggacgaacgaggtacgaccgtacgtacgacacgacg

SEQ ID NO: 301043 - DNA, 545 bp, Homo sapiens
  misc_feature: GZ8MTXP02H3P7E.38.36.D03.1.454.CMB.2.raw
  modified_base (229)..(229): a, c, t, g, unknown or other
  misc_feature (229)..(229): n is a, c, g, or t
  modified_base (254)..(254): a, c, t, g, unknown or other
  misc_feature (254)..(254): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctcgagtctgcgtctcctggacagtcgatcaccatcctcctgcactggaaccngcagtgacattggtcattataactngtctcgtggtaccaacaaccacccaggccaaacgacccccaaactcattatttatgagtccgaatcgcctcgagtaattcaatcgcttctctgctccagtctcggctaacaccgcctcctgaccatctcgtggactccgagctgaggacgaggtctgacttactactgcagttcataatacaaagacctactacttcccttcttcgttacgtttacgtttccgggacgggtacggggtaacccgtgggggtaaccgtacccggttcgtaaaacgggtcaacggaaccccgg

SEQ ID NO: 301044 - DNA, 511 bp, Homo sapiens
  misc_feature: GZ8MTXP02GRSFO.38.36.D03.1.454.CMB.2.raw
  modified_base (419)..(419): a, c, t, g, unknown or other
  misc_feature (419)..(419): n is a, c, g, or t
tcagtcgatcacgtcacgaccggtgctcgatttagctgcgtcacgatctctcttgggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccagcagtgacattggtcattataactctgtctcgtgtaccaacaacacccaggccaacgcccccaaactcattatttatgacggtccgaatcggcctccaggtactttctaatcgcttctctggctccagtctggcaacacgcctccctgaccatctctggactccaggctgaggacgagctgattacacgtnctagttcatatacaagctactactctcttctcgttacttcgggagacgggtaaccgaggggtacgaccgttaccgtaagtccgacgaccccg

SEQ ID NO: 301045 - DNA, 540 bp, Homo sapiens
  misc_feature: GZ8MTXP02IDPXZ.38.36.D03.1.454.CMB.2.raw
tcagtcgatcacgtcacgaccggtgctcgatttagctgcgtcacgatctctcttgggggggtctcaggaggcagcgctctcaggacatctccaccatggcctgggctctgctgctcctcaccctcctcactcagggcacagagtcctgggcccagtctgccctgattcagcctgcctccgagtctgcgtctcctggacagtcgatcaccatctcctgcactggaaccagcagtgacattggtcattataactctgtctcgtggtaccaacaacacccagcccaacgcccccaaatcatttatttatgaggtccgaatcggcctcagtatttcaatcgcttctctcgctccaagtctggacaaccaccggccctccctcgacctatctcgtggtacctccgaggctggacggacgaggcttgacttactactgactagttcaattatacaaagctaactactccttctttccgtgtttacgtccgggtcggacgggaacccgtaggggtactacccggtactacggtccacggtaccccgg

SEQ ID NO: 301046 - DNA, 520 bp, Homo sapiens
  misc_feature: GZ8MTXP02JHKOG.38.36.D03.1.454.CMB.2.raw
  modified_base (231)..(231): a, c, t, g, unknown or other
  misc_feature (231)..(231): n is a, c, g, or t
  modified_base (300)..(300): a, c, t, g, unknown or other
  misc_feature (300)..(300): n is a, c, g, or t
  modified_base (313)..(313): a, c, t, g, unknown or other
  misc_feature (313)..(313): n is a, c, g, or t
  modified_base (324)..(324): a, c, t, g, unknown or other
  misc_feature (324)..(324): n is a, c, g, or t
  modified_base (328)..(328): a, c, t, g, unknown or other
  misc_feature (328)..(328): n is a, c, g, or t
  modified_base (367)..(367): a, c, t, g, unknown or other
  misc_feature (367)..(367): n is a, c, g, or t
tcagtcgatcacgtcacgaccggtgctcgatttagctgcgtcacgatctctcgttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatcctcctgcactggaaccngcagtgacattgctattatactctgtctcgtgtaccaacacaccagccaacgccccaaatcattattangagtcgatcgccnagtattcatcnttcnctgctacagtctggacacaccgcctcctcgactatctcncgactccgagctgagacgagctagtatactagtgacgtattcatactaacacgtcacttacttcctccttagttacgttacgttacggggaccggtaagggtaacccgtaaggggtccgtacccgttacgtaacgtaccgacggtaaccccgg

SEQ ID NO: 301047 - DNA, 497 bp, Homo sapiens
  misc_feature: GZ8MTXP02GKG7D.38.36.D03.1.454.CMB.2.raw
  modified_base (228)..(228): a, c, t, g, unknown or other
  misc_feature (228)..(228): n is a, c, g, or t
  modified_base (387)..(387): a, c, t, g, unknown or other
  misc_feature (387)..(387): n is a, c, g, or t
  modified_base (435)..(435): a, c, t, g, unknown or other
  misc_feature (435)..(435): n is a, c, g, or t
tcagtcgatcacgtcacgaccggtgctcgatttagctgcgtcacgatctctcttgggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccngcagtgacattggtcattataactctgtctcgtggtaccaacaacacccaggccaagccccccaaatcattatttatgaggtccggaatcggccctcgaggaactttctaatcgcttctctggctccaagtctggcaacacgcctccctgaccatctcncggactccagctgaggacgaggctgattacactgcagttcatatagancactactctcttctgttactcggcggagggaactgggtacgaccgtacgtagtcacgacccg

SEQ ID NO: 301048 - DNA, 774 bp, Homo sapiens
  misc_feature: GZ8MTXP02JYN8Z.38.36.D03.1.454.CMB.2.raw
tcagtcgatcacgtcacgaccggtgctcgatttagctgcgtcacgatctctcttgggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccagcagtgactagttggtctaattactaactctgtctacgtacgtaaccaacaaccacccaggacccaacgaccccaaatctattattatgacgtaccgaactccggacctcgagtatttactaactcgtacttctctcggacctaccgtaagtccgtacgggaccaaacccgtacccggtccccttaccccgtacgtaacccctaacttcccgttaaccgttccggggaacccctttacccggtacgggaccgttacgggtaaacggggaaccggtaacgggtcccttagggtaactttaaaccgttaacgtcgtacccgttaaggttaccctaaagttaaaccgtaaaccgtaaaacgtaccccttaaacccgtttaaaccccgtttccctttaaaccccgtttttggtttaccgggttttaaaccggtttacccggggggaaccggggtaacccgggggttaaccggtaaccgggggttaacccgtaaaccccgggtttaacccgttaaaccgggttacccgaaacccggtttaaccccccgggg

SEQ ID NO: 301049 - DNA, 537 bp, Homo sapiens
  misc_feature: GZ8MTXP02IQ125.38.36.D03.1.454.CMB.2.raw
  modified_base (318)..(318): a, c, t, g, unknown or other
  misc_feature (318)..(318): n is a, c, g, or t
  modified_base (337)..(337): a, c, t, g, unknown or other
  misc_feature (337)..(337): n is a, c, g, or t
  modified_base (385)..(385): a, c, t, g, unknown or other
  misc_feature (385)..(385): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctctgcactggaaccagcagtgacgttggtggttataaatatgtctcttggtaccaacatcaaccaacatcacccaggaccaaaagtccccaaaatcaattattangagtcaactaacgcccctnagtagttctaatcgcttctctgctaccagtctggcaacgacgcctccngaccatctcgtggctccaactgacgacgacggctacacttattatcgcagtctacaattatacaagtacagtcgtactacggttgggtacgttcggggacggtacgggaacccgtacgtcggtaacccgtgttaacgggtccacggaccccg

SEQ ID NO: 301050 - DNA, 507 bp, Homo sapiens
  misc_feature: GZ8MTXP02I8KPF.38.36.D03.1.454.CMB.2.raw
  modified_base (434)..(434): a, c, t, g, unknown or other
  misc_feature (434)..(434): n is a, c, g, or t
  modified_base (463)..(463): a, c, t, g, unknown or other
  misc_feature (463)..(463): n is a, c, g, or t
tcagtcgatcacgtcacgaccggtgctcgatttagctgcgtcacgatctctcttgggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccagcagtgacattggtcattataactctgtctcgtggtaccaaacaacacccaggccaacgcccccaaactcattattatgagtcgaatcggcctccagatttcaatcgcttctctgctccaagtctggacaacacgcctccctgaccatctactggactccagctgaggacgaggctgaattactactgctagttcaatataacaanctaactactcctcttctcgtttactcggnggtacggaaccgagggtacgtaccggtacctaagtcacgacccg

SEQ ID NO: 301051 - DNA, 526 bp, Homo sapiens
  misc_feature: GZ8MTXP02JHZ6F.38.36.D03.1.454.CMB.2.raw
  modified_base (229)..(229): a, c, t, g, unknown or other
  misc_feature (229)..(229): n is a, c, g, or t
  modified_base (304)..(304): a, c, t, g, unknown or other
  misc_feature (304)..(304): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgcgtctccgtggacagtcgatcaccatctctgcactggaaccngcagtgacattggtcattataactctgtctcgtggtaccaacaacacccagccaacgcccccaaatcattattangagtccgaatcggcctaccaggaatttcaatcgacttctctggctccaagtctggacacaccggcctccctgacctagtcctactcggactccaggctgaggacgaggctagattactactggactagtccatatacaagctactactccttacttcctagttacgttcggcggaggtaacccgtagggtcgtacccgtctaaacgttccgaacgtaccccg

SEQ ID NO: 301052 - DNA, 547 bp, Homo sapiens
  misc_feature: GZ8MTXP02FW5WK.38.36.D03.1.454.CMB.2.raw
  modified_base (229)..(229): a, c, t, g, unknown or other
  misc_feature (229)..(229): n is a, c, g, or t
  modified_base (438)..(438): a, c, t, g, unknown or other
  misc_feature (438)..(438): n is a, c, g, or t
  modified_base (460)..(460): a, c, t, g, unknown or other
  misc_feature (460)..(460): n is a, c, g, or t
  modified_base (471)..(471): a, c, t, g, unknown or other
  misc_feature (471)..(471): n is a, c, g, or t
  modified_base (511)..(511): a, c, t, g, unknown or other
  misc_feature (511)..(511): n is a, c, g, or t
tcagtcgatcacgtcacgaccggtgctcgatttagctgcgtcacgatctctcttggggggggtctcaggaggcagcgctctcaggacatcctccaccatggcctgggctctgctgctcctcaccctcctcactcagggcacagggtcctgggcccagtctgccctggctcagcctgcctcgtgtctgggtctcctggacagtcgatcaccatctcctgcactggaaccngcagtgacgttggtgttataaattgtctctggtaccaacagcacccgggcaatcgacccccaaaatcaatgatttatgaggtcactcatcggccctcgtacggggtttactaatcgtcttctcttgcactccaaagtctggacaaacgaccggccctccctgacccatctcgtggcctcgaggctagaggacgagcttaaattatttcngactatctatataaaccaacanacaaacactcngtactagttacgggacgggaacgggaacccaaaggtaacncggtaaccggtacctaacggtacacggacccaacgg

SEQ ID NO: 301053 - DNA, 526 bp, Homo sapiens
  misc_feature: GZ8MTXP02IWMXW.38.36.D03.1.454.CMB.2.raw
  modified_base (228)..(228): a, c, t, g, unknown or other
  misc_feature (228)..(228): n is a, c, g, or t
  modified_base (405)..(405): a, c, t, g, unknown or other
  misc_feature (405)..(405): n is a, c, g, or t
  modified_base (458)..(458): a, c, t, g, unknown or other
  misc_feature (458)..(458): n is a, c, g, or t
  modified_base (486)..(486): a, c, t, g, unknown or other
  misc_feature (486)..(486): n is a, c, g, or t
tcagtcgatcacgtcacgaccggtgctcgatttagctgcgtcacgatctctcttgggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccngcagtgacattggtcattataactctgtctcgtggtaaccaacaaaccacccaggaccaaacgacccccaaaactctaatttaatttatgacggtaccgaatcggccctacaaggtaatttctaaatcgtacttctctgctccaagtctggacaacacgccctccctgaccatctcncgactccagctgacgacgaggctgattactactgactagttcatataacgaanctactactcctcttctacgttactcggngtacggaaccgagggtcaccgtactaacgtcacgtacccg

SEQ ID NO: 301054 - DNA, 611 bp, Homo sapiens
  misc_feature: GZ8MTXP02HQK1L.38.36.D03.1.454.CMB.2.raw
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccagcagtgacattggtacattataactctgtctcgtgtaaccaacaaccacccaggaccaacgacccccaaactctaatttattatagaggtaccgaatccggcctacgaaggtaatttactaatcgtacttctctggctaccaagtctcggacaaccacgccctccctgaccctagtcctcgtcggacctccgaaggtctaggaacggaccgaggtccttaggtaacttaaccggtaactcggactacgttacctaattaactaactaaacgcctaaaccttaccttacccttcctttacgtagtttaacgtccggtacgggtaaggggaacccgtaggggtaccgtacccggttaccgtaacggtaccgaaacggtaccccg

SEQ ID NO: 301055 - DNA, 634 bp, Homo sapiens
  misc_feature: GZ8MTXP02HPSWX.38.36.D03.1.454.CMB.2.raw
  modified_base (215)..(215): a, c, t, g, unknown or other
  misc_feature (215)..(215): n is a, c, g, or t
  modified_base (226)..(226): a, c, t, g, unknown or other
  misc_feature (226)..(226): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcacatctcngcatggaaccngcagtgactattggtcattataactctgtctcgtgtaaccaacaaccaccacggaccaaaccgacccccaaaatcaatttatttatgacggtccgaatccggcctacgagtaattctaatcgtcttctctcgctccaagtcctaggacctaaccgaccgtccctacccgtcgaccctacttccctcgtacggtaacctcccgaagggtcccgtaggaacggaacccggtaggtccgttacggtaaatttaccgtaaccgtgacccttaagttacctaaattaacttaaccaaaacgtccctaaaccttaccctttcccttctttaccgttacgtttacgttccgggaccgggtaacggggcccgtagggtaccgtacccggtaaccgttacgacgtaccgtaacccgg

SEQ ID NO: 301056 - DNA, 583 bp, Homo sapiens
  misc_feature: GZ8MTXP02IMHQ8.38.36.D03.1.454.CMB.2.raw
  modified_base (229)..(229): a, c, t, g, unknown or other
  misc_feature (229)..(229): n is a, c, g, or t
tcagtcgatcacgtcacgaccggtgctcgatttagctgcgtcacgatctatcttggggggggtctcaggaggcagcgctctcaggacatctccaccatggcctgggctctgctgctcctcaccctcctcactcagggcacagagtcctgggccccagtctgccctgactcagcctgcctcgagtctgcgtctcctggacagtcgatcaccatcctctgcactggaaccngcagtgactattggtctaattataactctgtctcgtacgtaacccaacaaccaccacggcccaaacgacccccaaatctatttaatttatgacggtccgaatccggccctacgagtatttctaatcgtacttctcgtgctaccgaagtctggacaacgaccgtcctccctgacctattcctactcggaacctcgaggctaggacggacgaggtcttagtactttacgtacgtcgacgtagttacaattactaaacgacactaacctacttccttctttacgtacgtttacgtaccgggacggaacgggtaaccgtacgggtcgtacccgttacgtaacgtaccgacgtaacccg

SEQ ID NO: 301057 - DNA, 579 bp, Homo sapiens
  misc_feature: GZ8MTXP02JOH6V.38.36.D03.1.454.CMB.2.raw
  modified_base (412)..(412): a, c, t, g, unknown or other
  misc_feature (412)..(412): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccagcagtgacattggtcattataactctgtctcgtgtaccaacaacaccaggaccaacgacccccaaactctaatttatttatgacggtaccgaatccggacctcgaggtaactttctaatcgtcttcctcgtcgggctaccgtaagtctaggaccaaaccgccggtcccttaccctgaaccctntcctcgtcgacctcgaggtcgtaggaacggacggagtcgtagtaacttacgtacgtgtactacgttactaataactacgaactactaccttaccttccttacgttcttacgttacgtcggacggtacggtaacggtacggtacgtaccgtacgtacgtccgacgccg

SEQ ID NO: 301058 - DNA, 500 bp, Homo sapiens
  misc_feature: GZ8MTXP02JQA4K.38.36.D03.1.454.CMB.2.raw
tcagtcgatcacgtcacgaccggtgctcgatttagctgcgtcacgatctctcttgggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccagcagtgacattggtcattataactctgtctcgtgtaccaacaacacccaggccaagcccctaaatcaattatttatgagtcgaatcggcctcagatttcaatcgacttctctggctccaagtctggacaacacgcctccctgaccatctctggactcagctgagacgaggctgattacgactgctagttcatatacaagctaactactcctacttctcgttacttcggcggtacggaaccgtagggtcgaccgtacgtacgtacacgacccg

SEQ ID NO: 301059 - DNA, 496 bp, Homo sapiens
  misc_feature: GZ8MTXP02JJI2A.38.36.D03.1.454.CMB.2.raw
  modified_base (248)..(248): a, c, t, g, unknown or other
  misc_feature (248)..(248): n is a, c, g, or t
  modified_base (442)..(442): a, c, t, g, unknown or other
  misc_feature (442)..(442): n is a, c, g, or t
tcagtcgatcacgtcacgaccggtgctcgatttagctgcgtcacgatctctcttgggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccagcagtgacattggtcattanaactctgtctcgtggtaccaacaacacccaggccaagcccccaaatcatttattatgaggtccgaatcggcctcagtattctaatcgcttctctgctccagtctggcaacacgcctccctgaccatcctctcggacttcccgaggcctgacggacgaggctgattactactgcagttcatataacagcactacncctctactgttactcggtcgaggaaccgagggtcgaccgtctaagtcagacccg

SEQ ID NO: 301060 - DNA, 623 bp, Homo sapiens
  misc_feature: GZ8MTXP02GFZCG.38.36.D03.1.454.CMB.2.raw
  modified_base (225)..(225): a, c, t, g, unknown or other
  misc_feature (225)..(225): n is a, c, g, or t
tcagtcgatcacgtcacgaccggtgctcgatttagctgcgtcacgatctctcttgggggggtctcaggaggcagcgctctcaggacatctccaccatggcctgggctctgctgctcctcaccctcctcactcagggcacagagtcctgggcccagtctgccctgactcagcctgcctcgagtctgcgtctcctggacagtcgatcacatctctgcactggaaccngcaatgacattggtcattataactctgtctcgtgtaaccaacaacaccaggaccaacgcccccaaatcattattatgagtccgaatcggcctcagtaattctaatcgacttctctgctaccaagtctggacaacaccggcctcccgtgaccatcctcgtcggacctccgaggtccaggaaggaccggaaggtccgttagtaactttaaccgtactacgacgttaacgttactaaacttaacgtaaacctaaagacccttaaccttaaccccttaccctttcctttacgtttacggtttaaccgtttaccggggaccggggttaaacggggaacccggttacggggtaccggtaaaccccggttaccgttaaacgttacccgaacggtaaacccccggg

SEQ ID NO: 301061 - DNA, 599 bp, Homo sapiens
  misc_feature: GZ8MTXP02IYG4Y.38.36.D03.1.454.CMB.2.raw
  modified_base (227)..(227): a, c, t, g, unknown or other
  misc_feature (227)..(227): n is a, c, g, or t
  modified_base (242)..(242): a, c, t, g, unknown or other
  misc_feature (242)..(242): n is a, c, g, or t
tcagtcgatcacgtcacgaccggtgctcgatttagctgcgtcacgatctctcgttgggggggtctcaggaggcagcgctctcaggacatctccaccatggcctgggctctgctgctcctcaccctcctcactcagggcacagagtcctggcccagtctgccctgactcagcctgcctccgagtctgcgtctcctggacagtcgatcaccatctctgcactggaaccngcagtgacattggtntattataactctgtctcgtagtaccaacaacaccacgaccaacgcccccaaatcaatttattatagacggtaccgaatccggccctacgaagtaactttactaaactccgtacttcgtctcggtcctaccaagttctacgggaccaaaccgtacccggcccttaccccgtagaccctacttcccttaccgtccggaaccttcccgacgggtcgtaggaacgggaccggtaggaccttgtaacttaccgtaactgacctagttacaatactaacgacactacctactcctcttactgtttacgtccgggacggacggaaccgtaggtaccgaccgtaccgtaacgtcgacgtaacccg

SEQ ID NO: 301062 - DNA, 575 bp, Homo sapiens
  misc_feature: GZ8MTXP02J0QAF.38.36.D03.1.454.CMB.2.raw
  modified_base (228)..(228): a, c, t, g, unknown or other
  misc_feature (228)..(228): n is a, c, g, or t
  modified_base (309)..(309): a, c, t, g, unknown or other
  misc_feature (309)..(309): n is a, c, g, or t
tcagtcgatcacgtcacgaccggtgctcgatttagctgcgtcacgatctctcttgggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccngcagtgactattggtcattataactctgtctcgtaggtaccaacaacacccaggcccaacgccccaaactcatttatttangtaggtccgaatcggcctcgagtatttctaatcgcttctctgcctcaagtctggaccaacaccgccctccctcgaccatcctctcggactccgaggcctaggacggacgaggcgtagtattactacgtgacctaggttcaattatacgaaacgtctaaccttacctccgttcttaccttagtttaacgttccggggcgggtaacggggaaccccgtaagggggtacctacccggttaccgtaaacggttccgaacggtacccccgg

SEQ ID NO: 301063 - DNA, 634 bp, Homo sapiens
  misc_feature: GZ8MTXP02IYTW3.38.36.D03.1.454.CMB.2.raw
  modified_base (225)..(225): a, c, t, g, unknown or other
  misc_feature (225)..(225): n is a, c, g, or t
tcagtcgatcacgtcacgaccggtgctcgatttagctgcgtcacgatctctcttgggggggtctcaggaggcagcgctctcaggacatctccaccatggcctgggctctgctgctcctcaccctcctcactcagggcacagagtcctgggcccagtctgccctgactcagcctgcctcgagtctgcgtctcctggacagtcgatcacatctctgcactggaaccngcagtgacattggctattataactctgtctcgtagtaaccaacaaccaccacggaccaacgacccccaaatctatttattatgacggtccgaatccggcctacgaggtaatttctaatcgtacttctcgtcgcctaccgtaagtcctacgggacctaaaccgtacccgggtccccttacccgtacgaaccctaacttcccgttacgttaccgggacccttaccccggaaggtcccgttagggaaaccgggtaccggacggtaccgttaggtaactttaccgaacgttcgaccgtagttacaataacgtaacaagcctaaacttcctccttactttcgttacgttacgttccgggacggtacgggtaaccgtagggtaccacccggtacctaaggtccgacggtaccccg

SEQ ID NO: 301064 - DNA, 530 bp, Homo sapiens
  misc_feature: GZ8MTXP02I0KGW.38.36.D03.1.454.CMB.2.raw
  modified_base (307)..(307): a, c, t, g, unknown or other
  misc_feature (307)..(307): n is a, c, g, or t
  modified_base (381)..(381): a, c, t, g, unknown or other
  misc_feature (381)..(381): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatcctctgcactggaaccagcagtgacattggtcattataactctgtctcgtgtaccaacaacacccaggccaacgcccccaaactctattatttangacggtccgaatcggccctcaggtaatttctaactcgtcttctctgctaccaagtctggcaacacgtccttccncgacatctctggactcgagctgaggacgaggctgtacttactacgtgactagttcaatataacaagtctaactacttcctcttcttacgttacgtcggacggtagggaacccgtagggtactacccggtctaaacgtcgacgtaacccg

SEQ ID NO: 301065 - DNA, 555 bp, Homo sapiens
  misc_feature: GZ8MTXP02J258U.38.36.D03.1.454.CMB.2.raw
  modified_base (230)..(230): a, c, t, g, unknown or other
  misc_feature (230)..(230): n is a, c, g, or t
  modified_base (460)..(460): a, c, t, g, unknown or other
  misc_feature (460)..(460): n is a, c, g, or t
tcagtcgatcacgtcacgaccggtgctcgatttagctgcgtcacgatctctcgttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccngcagtgacattggtcattataactctgtctcgtggtaccaacaacacccaggccaacgcccccaaaactcattattatgagtccgaatcggcctcaggtaatttctaatcgcttctctggtcctcagtctggacacacgccctccctgaccatctcgtcgactccaggtcctaggacgggacgagggctaggtactttacctacgtgcgtagttccaattactaaacaancctaacttacctccttctttacgttgttacgtccgggtacgggtacgggaaccgtacggggtcgacccgttaccgtaacgtccgaacgaccccgg

SEQ ID NO: 301066 - DNA, 618 bp, Homo sapiens
  misc_feature: GZ8MTXP02FZGW6.38.36.D03.1.454.CMB.2.raw
tcagtcgatcacgtcacgaccggtgctcgatttagctgcgtcacgatctctcttgggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccagcagtgacattggtcattataactctgtctcgtgtaccaacaacacccaggaccaacgcccccaaaactctaatttactttatggtacggtaccggaatccggccctacaaggtaactttactaaatcgtctttctcgtcggccttaccgaaagttcctacgggaccaaaccgaccggcccttacccctgaacccattcctaccgtcggaccttcccgagggtcctggaacgggacgaggcctagtacttactactcgactagttacaattacaacaaacgcctaaccttacttccctttacgtttccttagtttacgttcgggacggtaacggggtaacccgtagggggttacctaacccggttacctaaacggtcgaacgaaccccgg

SEQ ID NO: 301067 - DNA, 491 bp, Homo sapiens
  misc_feature: GZ8MTXP02FN061.38.36.D03.1.454.CMB.2.raw
  modified_base (304)..(304): a, c, t, g, unknown or other
  misc_feature (304)..(304): n is a, c, g, or t
tcagtcgatcacgtcacgaccggtgctcgatttagctgcgtcacgatctctcttgggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccagcagtgacattggtcattataactctgtctcgtggtaccaacaacacccaggccaagcccccaaactcattattangaggtccggaatcggcctcagatttctaatcgcttctctggctcaagtctggcaacacgcctccctgaccatctctggactccaacctgaggacgaggctcactattattgcagctcatatacaagcagcgtcacgttgggtgttcggcggagggaccgaacgtgaccgtcttaggtcagcccaagg

SEQ ID NO: 301068 - DNA, 510 bp, Homo sapiens
  misc_feature: GZ8MTXP02JQURG.38.36.D03.1.454.CMB.2.raw
  modified_base (228)..(228): a, c, t, g, unknown or other
  misc_feature (228)..(228): n is a, c, g, or t
  modified_base (368)..(368): a, c, t, g, unknown or other
  misc_feature (368)..(368): n is a, c, g, or t
  modified_base (433)..(433): a, c, t, g, unknown or other
  misc_feature (433)..(433): n is a, c, g, or t
  modified_base (435)..(435): a, c, t, g, unknown or other
  misc_feature (435)..(435): n is a, c, g, or t
tcagtcgatcacgtcacgaccggtgctcgatttagctgcgtcacgatctctcttgggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccngcagtgacattggctattataactctgtctcgtaggtaaccaacaacaccaggccaaacgcccccaaactcattattatgaggtcgaatcggcctcagtattcaatcgcttctctgctcagtctgcacaccgcctccctnaccatctctcggactccgagcctaggacgacgagctgattacgtactgactagttcaattactananctactactcctcttactgttacgttcggcgaacgggcgtagggtacgtacccggtctaacggtcgaacgtacccg

SEQ ID NO: 301069 - DNA, 598 bp, Homo sapiens
  misc_feature: GZ8MTXP02IIFMV.38.36.D03.1.454.CMB.2.raw
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccagcagtgactattggtactaattactaactctgtctcgtacgtaacccaacaaccaccgaacggacccaaaccgacccccaaaactctaatttaatttacgtaggtacggtaccgaacgtccggtccctaccgaaggtaactttctaactcgtcttctcgtgctccaagtctgacacgacgtcctccctgaccatctcgtcggacctccgaggctaggacggacgaggtctagtacttactactgactagttacataatacaacgtactacctacttcccttactttcgttacgtttacgtaccgggtacgggtaacggaacccggtaggggtaccgtaccgttaccgtaacggaccgtacggtaacccg

SEQ ID NO: 301070 - DNA, 702 bp, Homo sapiens
  misc_feature: GZ8MTXP02JMTH6.38.36.D03.1.454.CMB.2.raw
  modified_base (228)..(228): a, c, t, g, unknown or other
  misc_feature (228)..(228): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctctgcactggaaccngcagtgactattggtctattataactctgtctcgtggtaaccaacaaccacccacggacccaaacgacccccaaatcaatttatttatgacggtaccgaactccggtcctacgaggtaactttactaactcgtctttctcgtcggtcctaccgtaacgtcgtcgggaaccaaaccgacccgggtccccttaccccgtacggaacccctacttacccgttaccgttccggggtaaccttaccccggaagggtccgttacgggtaaacggaccggtagggtacctaggtactttaaccgtaaccgttggaccttaacggtactaaaacgttacgttaaacccgaaagtacccttaaaccgtttaaccttcccctttaacccgtttcgttaaccgggtttaccgtttacggggaccggtacgggtaaccgtacggggttacgtacccggtacgtaaccgtaccggacgtaaccccgg

SEQ ID NO: 301071 - DNA, 598 bp, Homo sapiens
  misc_feature: GZ8MTXP02FW4XL.38.36.D03.1.454.CMB.2.raw
  modified_base (230)..(230): a, c, t, g, unknown or other
  misc_feature (230)..(230): n is a, c, g, or t
  modified_base (236)..(236): a, c, t, g, unknown or other
  misc_feature (236)..(236): n is a, c, g, or t
  modified_base (291)..(291): a, c, t, g, unknown or other
  misc_feature (291)..(291): n is a, c, g, or t
  modified_base (343)..(343): a, c, t, g, unknown or other
  misc_feature (343)..(343): n is a, c, g, or t
  modified_base (473)..(473): a, c, t, g, unknown or other
  misc_feature (473)..(473): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagccttcctccgagtctgcgtctcctggacagtcgatcaccatcgtcctgcactggaaccngcagtnatgtcattatactctgtctctggtaccaacaacaccacgacaacaccccaactanattaacttatgacggtaccggtactccgccgtacctagtaacgtttactacncgtcttctctgctcacgtcgtcgctaaacaccggtcccttaccctcgaacctctactccgtgggacctcccgtagggcctaggacggacggtaacggtctgtaacttataccctggactaacggtcttanacttaacgacctaatcccttaactcccggttctttacgttagtttacggttaccgggaccgggacgggaaccggttacggtcgtaaccgtaccgtaaacgttcgaaccggtacccacggtacccg

SEQ ID NO: 301072 - DNA, 533 bp, Homo sapiens
  misc_feature: GZ8MTXP02HFG1V.38.36.D03.1.454.CMB.2.raw
  modified_base (314)..(314): a, c, t, g, unknown or other
  misc_feature (314)..(314): n is a, c, g, or t
  modified_base (352)..(352): a, c, t, g, unknown or other
  misc_feature (352)..(352): n is a, c, g, or t
  modified_base (375)..(375): a, c, t, g, unknown or other
  misc_feature (375)..(375): n is a, c, g, or t
  modified_base (384)..(384): a, c, t, g, unknown or other
  misc_feature (384)..(384): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccagcagtgacagttggtctattataactctgtctcgtacgtaccaacaaccacccaggacccaacgacccccaaatcatttatttangtacgtccgtaatccggcctcagtattcaatcgcttcnctgctcatctgcacacgcctccngaccatctntcgactcgagctgaggacgagctgtattactactgactagttacatactacaagctaacttactcttcttacgttacgttacgttccgggacggtacgggaaccgtaaggggtccgtacccggttactaaacgtccgacgtaaccccgg

SEQ ID NO: 301073 - DNA, 572 bp, Homo sapiens
  misc_feature: GZ8MTXP02G24RV.38.36.D03.1.454.CMB.2.raw
  modified_base (451)..(451): a, c, t, g, unknown or other
  misc_feature (451)..(451): n is a, c, g, or t
  modified_base (495)..(495): a, c, t, g, unknown or other
  misc_feature (495)..(495): n is a, c, g, or t
tcagtcgatcacgtcacgaccggtgctcgatttagctgcgtcacgatctctcttgggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtggttataaattgtctctggtaccaacagcacccgggcaatcgacccccaaaatccaatgtatttatgaggtcacttcatccggccctcgtacggggtttctaatcgtctttctcttgctactccaaagttctggacaaacgaccggccctccctacgacccatctcgtgggcctccgaggctggaagaccgaggtactaagtttattcngactagttacatactaaccaaacgacgacaaaacctcgtactanaccgttaagttccgggacgggaacgggaaccaaaggcctacgtacccgtacgttaaggtccaacggaccctaaccgg

SEQ ID NO: 301074 - DNA, 504 bp, Homo sapiens
  misc_feature: GZ8MTXP02GNKQL.38.36.D03.1.454.CMB.2.raw
  modified_base (229)..(229): a, c, t, g, unknown or other
  misc_feature (229)..(229): n is a, c, g, or t
  modified_base (404)..(404): a, c, t, g, unknown or other
  misc_feature (404)..(404): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcatcactcagggcacagagtcctgggcccagtctgccctgactcagcctgcctccgagtctgcgtctcctggacagtcgatcaccatctcctgcactggaaccngcagtgacattggtcattataactctgtctcgtagtaccaacaacacccaggaccaacgcccccaaactcattattatgagtcgaatcggcccctgagtattctaatcgcttctctggctccaagtctggcaacacgccctccctcgaccatctctgactccagctggaggacgngctagagttacactgactagtacatatacaagcactactccttctacttcgttactcggcggaacggacgacgggtacgtaccgtacgtaacgtcaaccg

SEQ ID NO: 301075 - DNA, 505 bp, Homo sapiens
  misc_feature: GZ8MTXP02FHZWI.38.36.D03.1.454.CMB.2.raw
  modified_base (394)..(394): a, c, t, g, unknown or other
  misc_feature (394)..(394): n is a, c, g, or t
  modified_base (402)..(402): a, c, t, g, unknown or other
  misc_feature (402)..(402): n is a, c, g, or t
  modified_base (436)..(436): a, c, t, g, unknown or other
  misc_feature (436)..(436): n is a, c, g, or t
  modified_base (476)..(476): a, c, t, g, unknown or other
  misc_feature (476)..(476): n is a, c, g, or t
tcagtcgatcacgtcacgaccggtgctcgatttagctgcgtcacgatctctcttgggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccagcagtgacattggtcattataactctgtctcgtggtaaccaacaaacaccaggcccaacgcccccaaaactcaatttattatgtacggtccgaatccggcctaccaggtaatttctaatcgtacttctctgctcaagtctgcaacacgccctccctgaccatctcnggactcgngctgaggcgaggctgatactactgcagttcatanacagcactactcttctcttgttactcggcgtaggaaccgnggtacgaccgtcgtaacgtcacgtacccg

SEQ ID NO: 301076 - DNA, 514 bp, Homo sapiens
  misc_feature: GZ8MTXP02HRH85.38.36.D03.1.454.CMB.2.raw
  modified_base (302)..(302): a, c, t, g, unknown or other
  misc_feature (302)..(302): n is a, c, g, or t
  modified_base (356)..(356): a, c, t, g, unknown or other
  misc_feature (356)..(356): n is a, c, g, or t
tcagtcgatcacgtcacgaccggtgctcgatttagctgcgtcacgatctctcttgggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccagcagtgacattggtcattataactctgtctcgtgtaccaacaacaccagcccaagcccccaaatcattatttangagtccgaatcggccctcagaatttcaatcgcttctctggctcagtctggcacncgcctccctgaccatctctcggactcagctcgaggtcgagctgattactactgctagttcaattacaacaagctactacttcctctttaccgttagtttacttccgggacgggtaacggccgtagggtacgtacccgtactaacggtcaacgaccccg

SEQ ID NO: 301077 - DNA, 806 bp, Homo sapiens
  misc_feature: GZ8MTXP02G3LJV.38.36.D03.1.454.CMB.2.raw
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcacatctcctgcactggaaccagcagtgactattggtactattactaactctgtctcgtagtaccaacaaccacccgaggaccaaccgaccccaaactctaatttattatagtacggtaccggatccggcctacgaagtaatttactaacttcgtacctttctccgtcggtaccttacccgtaaggttcctacgggaccctaaacccgtacccggtccccttacccccgtagtaacccctacttcccttaccgttaccgggtaaccccttacccggaacgggtacccgttacggggaaaccggggtaaccggtaacgggtacccgtttaagggtaaccttttaaaccggttaaacccgttcgtaaacccgttaacggttttaactaaaacgtttaacgtaaaaccgaaaacccgttaacccttaaaccccgtttaaaccctttcccgtttaaacccctttttccggttaacggtttttacgggttaaccccgggggacgggggttaaaaccggggtaacccgggttaacgggggttaccccggtaaacccggtttaacccggttaaaaccggttcccggaaacccggttaaccccccggg

SEQ ID NO: 301078 - DNA, 586 bp, Homo sapiens
  misc_feature: GZ8MTXP02F7PKH.38.36.D03.1.454.CMB.2.raw
  modified_base (227)..(227): a, c, t, g, unknown or other
  misc_feature (227)..(227): n is a, c, g, or t
  modified_base (499)..(499): a, c, t, g, unknown or other
  misc_feature (499)..(499): n is a, c, g, or t
tcagtcgatcacgtcacgaccggtgctcgatttagctgcgtcacgatctctcgttgggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcatcacatctcctgcactggaaccngcagtgacattggtcattataactctgtctcgtggtaaccaacaaccaccaggaccaaacgaccccccaaaatcctaatttaatttatacggacggtaccggaaatccgggcccctacgaaggtaactttactaaacttcgtaccttctcgtcggccttaccaaacgttctaggaccaaacaccggccctccctgaacccatcctcgtcggactccgaggacctggaacggacgaagctagacttactactgcagtttcaatactaacgaanctaactactccttcttcttagtttacgttcggcggtaacggaaccgtaggggtacgtacccgtactaaacggtccaacgaaccccgg

SEQ ID NO: 301079 - DNA, 494 bp, Homo sapiens
  misc_feature: GZ8MTXP02HAZL6.38.36.D03.1.454.CMB.2.raw
  modified_base (229)..(229): a, c, t, g, unknown or other
  misc_feature (229)..(229): n is a, c, g, or t
  modified_base (248)..(248): a, c, t, g, unknown or other
  misc_feature (248)..(248): n is a, c, g, or t
  modified_base (269)..(269): a, c, t, g, unknown or other
  misc_feature (269)..(269): n is a, c, g, or t
  modified_base (304)..(304): a, c, t, g, unknown or other
  misc_feature (304)..(304): n is a, c, g, or t
  modified_base (321)..(321): a, c, t, g, unknown or other
  misc_feature (321)..(321): n is a, c, g, or t
  modified_base (339)..(339): a, c, t, g, unknown or other
  misc_feature (339)..(339): n is a, c, g, or t
  modified_base (358)..(358): a, c, t, g, unknown or other
  misc_feature (358)..(358): n is a, c, g, or t
  modified_base (374)..(374): a, c, t, g, unknown or other
  misc_feature (374)..(374): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccngcagtgacatggtcattanaactctgtctgtgtaaccaanaacaccaggccaacgcccccaaaatcattatttangaggtcgaatcggcctnagtaatttcaatcgcttnctgctacagtctgcaaacncgcctcctagccatcnctcgactcgagctgagacgaggctgattactactgactagttcaatataacaagccaactactctcttctagttacgtcggaggacggaaccgtagggtcaccggtactacgcacgaccg

SEQ ID NO: 301080 - DNA, 541 bp, Homo sapiens
  misc_feature: GZ8MTXP02FUWNO.38.36.D03.1.454.CMB.2.raw
  modified_base (228)..(228): a, c, t, g, unknown or other
  misc_feature (228)..(228): n is a, c, g, or t
  modified_base (375)..(375): a, c, t, g, unknown or other
  misc_feature (375)..(375): n is a, c, g, or t
  modified_base (414)..(414): a, c, t, g, unknown or other
  misc_feature (414)..(414): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcacatctcctgcactggaaccngcagtgacattggtcattataactctgtctcgtgtaaccaacaaccacccaggccaacgacccccaaaactctatttaattatgacggtccgaatccggaccctcaggtaatttctaatcgtcttctctggctcaagtctggcaacnccgcctccctgaccatctacgtcggacctccgaagtccngacggacgaggctagtacttacactgcagttcaatataacaagctactaccttccttcttacttacgttacgttcggcggtaacgggaaccgtagggacgtaccggtcctaagtccacgtaaccccg

SEQ ID NO: 301081 - DNA, 678 bp, Homo sapiens
  misc_feature: GZ8MTXP02JLTDU.38.36.D03.1.454.CMB.2.raw
  modified_base (375)..(375): a, c, t, g, unknown or other
  misc_feature (375)..(375): n is a, c, g, or t
  modified_base (402)..(402): a, c, t, g, unknown or other
  misc_feature (402)..(402): n is a, c, g, or t
tcagtcgatcacgtcacgaccggtgctcgatttagctgcgtcacgatctctcgttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccagcagtgacattggcattataactctgtctcgtggtaccaacaaccaccaggaccaacgacccccaaaactccatttactttatggacggtccgaatccggcctacaggtattctaatcgtcttctcgtcggtcctccgaagttcngggacctaaacgccggtcccttcccgngaccctacttctaccgtggaaccttccgacggtcctaggacggaccgaagggtcctaggtaactttaccgtaacgtcggtactacggtttacgaaacttacgttaaacgtaaaacgacctaaaaccgtttacccgtacccttttacctttacggtttcgggttttaaaaccgtttcccgggggaccggggtaaacggggtaacccccgggtaaaggggtttccggaaccccggtttaaccgttaaaacgggttcccgtaaacgggtaacccccggg

SEQ ID NO: 301082 - DNA, 646 bp, Homo sapiens
  misc_feature: GZ8MTXP02FOGID.38.36.D03.1.454.CMB.2.raw
  modified_base (265)..(265): a, c, t, g, unknown or other
  misc_feature (265)..(265): n is a, c, g, or t
  modified_base (273)..(273): a, c, t, g, unknown or other
  misc_feature (273)..(273): n is a, c, g, or t
tcagtcgatcacgtcacgaccggtgctcgatttagctgcgtcacgatctctcttgggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtggttataattgtctctgtaccangcaccggnatcgaccccaaatcatgtatttatgaggtcactcacgtccggccctcgtacggggtttctaatcgtcttctcttcgctatacccaagttcctaggacaaaccgaccggtccctcccgtacgaccctattccgtcgttcggggaccctccgacggtccgtaggaacgggtaacggaacgggttaccttaaaagtttcgttttaccgtaggtaccttaacggtttactaaattaacttaaaccaaaccgtaaacgaccaaaacctaaccttcgttagtacctttacggttaccggggacggggtaaaccgggacctaaacggtccgtaccggtaacccgtaaccgtaaacgtccgaaaccgccccggtaaaccgg

SEQ ID NO: 301083 - DNA, 496 bp, Homo sapiens
  misc_feature: GZ8MTXP02FJA2R.38.36.D03.1.454.CMB.2.raw
  modified_base (305)..(305): a, c, t, g, unknown or other
  misc_feature (305)..(305): n is a, c, g, or t
  modified_base (386)..(386): a, c, t, g, unknown or other
  misc_feature (386)..(386): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccagcagtgacattggtcattataactctgtctcgtgtaccaacaacaccagaccaacgacccccaaactcattattangagtcgaatcggcctcaggtaattctaatcgacttctctggctacgaagtctggacaacgaccgcctccctgaccatctcngactcgagctgagacgagctgtattacatgcagttcatatacagctaactactcttcttctcgttacgtcggcggaggaaccgaggtcgacgtctaacgtcacgtacccg

SEQ ID NO: 301084 - DNA, 616 bp, Homo sapiens
  misc_feature: GZ8MTXP02FT0TB.38.36.D03.1.454.CMB.2.raw
  modified_base (229)..(229): a, c, t, g, unknown or other
  misc_feature (229)..(229): n is a, c, g, or t
  modified_base (512)..(512): a, c, t, g, unknown or other
  misc_feature (512)..(512): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccngcagtgactattggtcattataactctgtctcgtgtaaccaacaaccaccaggaccaacgacccccaaaatctaatttattatagtacggtaccggaatccggtccctacgaggtaactttactaatcgtcttactcgtcgcctaccgaagtctacggaccaaacaccggccctaccctacgaaccctatcctctacggtacctcccgagaccgtaggaacgggaccggtaggccgttagtaactttacgtacgtcgacgtacgttacaaatataacgaaacncctaaccttaccttccttctttacgttacgtttacgttacgggacgggtaacgggaacccgtaggggtaccgtaacccggtactaaacgtccgacgaaccccgg

SEQ ID NO: 301085 - DNA, 479 bp, Homo sapiens
  misc_feature: GZ8MTXP02G740H.38.36.D03.1.454.CMB.2.raw
  modified_base (301)..(301): a, c, t, g, unknown or other
  misc_feature (301)..(301): n is a, c, g, or t
  modified_base (333)..(333): a, c, t, g, unknown or other
  misc_feature (333)..(333): n is a, c, g, or t
  modified_base (418)..(418): a, c, t, g, unknown or other
  misc_feature (418)..(418): n is a, c, g, or t
  modified_base (424)..(424): a, c, t, g, unknown or other
  misc_feature (424)..(424): n is a, c, g, or t
  modified_base (448)..(448): a, c, t, g, unknown or other
  misc_feature (448)..(448): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccagcagtgacattggcattataactctgtctcgtggtaccaacaacaccagccaagcccccaaatcattattangagtccgaatcgcctcagattcaatcgcttcnctgctcaagtctgcaacacgctccctgaccatctactggactccgagctgaggacgagctgacttacgactgctagttcaattanacgaancactactcctcttctgttatcggngaggaaccagggtcacgtctaagcacgaccg

SEQ ID NO: 301086 - DNA, 722 bp, Homo sapiens
  misc_feature: GZ8MTXP02IZ1CL.38.36.D03.1.454.CMB.2.raw
  modified_base (229)..(229): a, c, t, g, unknown or other
  misc_feature (229)..(229): n is a, c, g, or t
  modified_base (307)..(307): a, c, t, g, unknown or other
  misc_feature (307)..(307): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccngcagtgacattggtcattataactctgtctcgtggtaccaacaacaccaggaccaacgacccccaaatcatttattangacggtaccgatcggcctcagtactttctaactcgtaccttctctcggtcctaccgaacgttctacgggacctaaaccgaccggccccttccccgtacgaaccctacttccttacgtccgggtaacccttccccgaaagggtccgtagggaacggggaacccgtaaggggtcccttaggttaaacgttttaaaccctacgtttaacggccttaacggtttacctaaagttaacttaaaccgaaacggtaaccctaaaaccctttaaccttccctttaccgttttaccgttacggtttttaacgttcccgggggtaccgggggttaaacgggggaacccggttaacgggggtacccggttaaaccccgggttaccccgtttaaaacgggttaccgaaacccggttaaacccccggg

SEQ ID NO: 301087 - DNA, 744 bp, Homo sapiens
  misc_feature: GZ8MTXP02JBGAR.38.36.D03.1.454.CMB.2.raw
tcagtcgatcacgtcacgaccggtgctcgatttagctgcgtcacgatctctcttgggggggtctcaggaggcagcgctctcaggacatctccaccatggcctgggctctgctgctcctcaccctcctcactcagggcacagagtcctgggcccagtctgccctgactcagcctgcctcgagtctgcgtctccgtggacagtcgatcaccatctctgcactggaaccagcagtgacattggctattataactctgtctcgtgtaccaacaacaccaggaccaacgacccccaaactctatttattatgacggtaccgaatccggccctacgaggtaactttactaactcgtccttctcgtcggtcctacctaaacgttccgttcggacctaaaccgaacccgggtcccttaccccgttacggaacccctaacttcccgttccgtacggggtaacccttcccggaacgggtccgttacgggaaacggggacccgggtaaacggggtccttacggggtaaacttttaacccgttaaaccgttcgtacccgttaacggtttacccgtaaattaaacttaaaccgaaaacggtaccttaaaacccgttaaaccctttaccccgtttcctttttaacccgtttaggttttaaaccggtttccgggggaccggggtaacgggggtaacccggtacgggggttaccgtaaccccgggttaccgtaaacggttaccgacggtaaacccccggg

SEQ ID NO: 301088 - DNA, 524 bp, Homo sapiens
  misc_feature: GZ8MTXP02I287T.38.36.D03.1.454.CMB.2.raw
  modified_base (228)..(228): a, c, t, g, unknown or other
  misc_feature (228)..(228): n is a, c, g, or t
  modified_base (423)..(423): a, c, t, g, unknown or other
  misc_feature (423)..(423): n is a, c, g, or t
  modified_base (429)..(429): a, c, t, g, unknown or other
  misc_feature (429)..(429): n is a, c, g, or t
  modified_base (446)..(446): a, c, t, g, unknown or other
  misc_feature (446)..(446): n is a, c, g, or t
tcagtcgatcacgtcacgaccggtgctcgatttagctgcgtcacgatctctcttgggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccngcagtgacgttggtggttataaatttgtctcctggtaccaacagcacccgggcaatcgacccccaaaatccatgatttatgaggtcactcatcgcccctcgtaggggtttctaatcgcttctctgcatccaagtctggctaacacggcctccctgaccatctctcgggctccgagctgaggacgaggtctaattntttacngcattcatataacaacngacaacactctgtacttacgttccggacggtaggaacccgaaggaccttacggacccgtacctaacggtccaacccgg

SEQ ID NO: 301089 - DNA, 524 bp, Homo sapiens
  misc_feature: GZ8MTXP02HROS2.38.36.D03.1.454.CMB.2.raw
  modified_base (229)..(229): a, c, t, g, unknown or other
  misc_feature (229)..(229): n is a, c, g, or t
  modified_base (307)..(307): a, c, t, g, unknown or other
  misc_feature (307)..(307): n is a, c, g, or t
  modified_base (445)..(445): a, c, t, g, unknown or other
  misc_feature (445)..(445): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccngcagtgactagttggtcattataactctgtctcgtgtaccaacaacaccaggccaaacgcccccaaatcattatttangtaggtcgaatcggcctcaggtaatttctaatcgtcttctctgtctccaagtctggacaacaccgcctccctgaccatctactggactccgagctgacggacgaggtctagattacgtactgactagtcatatacgancactactcctacttcttagttacgtcggcggtacggaaccgtacgggtacgtaccggtcgtacggtacacggtaacccg

SEQ ID NO: 301090 - DNA, 587 bp, Homo sapiens
  misc_feature: GZ8MTXP02IP8HS.38.36.D03.1.454.CMB.2.raw
  modified_base (358)..(358): a, c, t, g, unknown or other
  misc_feature (358)..(358): n is a, c, g, or t
  modified_base (479)..(479): a, c, t, g, unknown or other
  misc_feature (479)..(479): n is a, c, g, or t
  modified_base (486)..(486): a, c, t, g, unknown or other
  misc_feature (486)..(486): n is a, c, g, or t
tcagtcgatcacgtcacgaccggtgctcgatttagctgcgtcacgatctctcttgggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccagcagtgacattggcattataactctgtctcgtggtaaccaacaacacccaggccaacgacccccaaaatcaactttaatttatagacggtaccgaatcggccctcgaggtaaatttctaaatcgctttcncgttaggcctaccgaaagtctggacaaacgaccgtcctccctgacccatcctcgtcggactaccagggtctaggaggacgaggactgtaactttacaccgttggacctagttacatttaanacgaaanctaaccttaactccctttacggttcttacgtttacgttccgggacggtacgggtaacccgtaggggtcgtacccgttacgtacgttacgtacgaaccccgg

SEQ ID NO: 301091 - DNA, 570 bp, Homo sapiens
  misc_feature: GZ8MTXP02JU6OR.38.36.D03.1.454.CMB.2.raw
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcacatctcctgcactggaaccagcagtgacattggtcattataactctgtctcgtgtaaccaacaaccaccacgaccaacgcccccaaatctattattatgagtccgatcggcctcgagtatttctaatcgtcttctcgtgctctaagtctggactaaaccgaccgtccctcccgtacacccatcctactcggactccgaggcctaggaaggaccgaggtcgtagaacttactacgtcgactacgttacaattaacaacaaacgtacctaacttacctccttctttccttagtttacgttccgggacggtacgggtaaccgtacgggtaccgtaccgtaccgtaaacgtcccgaggtaaccccg

SEQ ID NO: 301092 - DNA, 516 bp, Homo sapiens
  misc_feature: GZ8MTXP02FMKLQ.38.36.D03.1.454.CMB.2.raw
  modified_base (362)..(362): a, c, t, g, unknown or other
  misc_feature (362)..(362): n is a, c, g, or t
  modified_base (382)..(382): a, c, t, g, unknown or other
  misc_feature (382)..(382): n is a, c, g, or t
  modified_base (428)..(428): a, c, t, g, unknown or other
  misc_feature (428)..(428): n is a, c, g, or t
tcagtcgatcacgtcacgaccggtgctcgatttagctgcgtcacgatctctcttgggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccagcagtgacattggtcattataactctgtctcgtggtaccaacaacaccaggccaacgcccccaaactcattatttatgagtccgaatcggcctcaggattctaatcgacttctctgctccaagtctagctaacncgcctccctgaccatctacnggactcgagctgaggacgaggctgtacttactactgcagttcatanaacagcactactcttacttctacgttagttcggcggtaacgggaaccgtagggtacgtacccgtaccgtaacgtccgacgtaaccccg

SEQ ID NO: 301093 - DNA, 601 bp, Homo sapiens
  misc_feature: GZ8MTXP02JTB7I.38.36.D03.1.454.CMB.2.raw
  modified_base (230)..(230): a, c, t, g, unknown or other
  misc_feature (230)..(230): n is a, c, g, or t
  modified_base (250)..(250): a, c, t, g, unknown or other
  misc_feature (250)..(250): n is a, c, g, or t
  modified_base (257)..(257): a, c, t, g, unknown or other
  misc_feature (257)..(257): n is a, c, g, or t
  modified_base (273)..(273): a, c, t, g, unknown or other
  misc_feature (273)..(273): n is a, c, g, or t
  modified_base (310)..(310): a, c, t, g, unknown or other
  misc_feature (310)..(310): n is a, c, g, or t
  modified_base (399)..(399): a, c, t, g, unknown or other
  misc_feature (399)..(399): n is a, c, g, or t
tcagtcgatcacgtcacgaccggtgctcgatttagctgcgtcacgatctctcgttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccngcagtgacattggtcattanaactctntctcgtgtaacccaanaaccaccaggccaacgacccccaaatcatttattagngacggtcgaatccggcctacagtaattctaatcgcttctctcggctaccaagtctgggaccaaacgcccggtccctcccgtacaacctntcctcgtcgacctccgacgggtctaggacggacgaggtcttagacttactaccgtgtacgtatttaccaattaacgttaacgaacgtacctaccttaaccttccgttactttacgtacggtttacgtaccggggtccggggaacgggtaaccggaggggttacccgtaccggtaccgttaaacggtccgaccgtaaccccgg

SEQ ID NO: 301094 - DNA, 613 bp, Homo sapiens
  misc_feature: GZ8MTXP02I8Q0N.38.36.D03.1.454.CMB.2.raw
  modified_base (199)..(199): a, c, t, g, unknown or other
  misc_feature (199)..(199): n is a, c, g, or t
  modified_base (226)..(226): a, c, t, g, unknown or other
  misc_feature (226)..(226): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctcgagtctgcgtctcctggacngtcgatcacatctctgcactggaaccngcagtgactgtgtactattactactctcgtctcgtacgtaaccaacaaccaccgacgaccaaccgacccctaactactaatttattagtacggacggtaccgtacgtccgtacctacgtaacgttactttactactcgtcttctcgtcgtacctacgtacgtcgtacgaccaccgacccgtccctaccgtacgacctactccgtacgtccgacctacgacggcgaggacggacgtacggtactacgtaacttacgtagtcgtactacgttacaaactactaacgaactacctaacttacccttcttacgtttcgttacgttacggtaccggggtacggtaaccggtaacggtacggtaccgtaccgtacgtacgtaccgacgtaccg

SEQ ID NO: 301095 - DNA, 525 bp, Homo sapiens
  misc_feature: GZ8MTXP02GWPFA.38.36.D03.1.454.CMB.2.raw
  modified_base (228)..(228): a, c, t, g, unknown or other
  misc_feature (228)..(228): n is a, c, g, or t
tcagtcgatcacgtcacgaccggtgctcgatttagctgcgtcacgatctctcttgggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccngcagtgacattggtcattataactctgtctcgtggtaccaacaaccacccaggccaacgcccccaaaactcattatttatgaggtccgaatccggcctccaggtaatttctaatcgacttctctgctccaagtctgcaacaccggcctccctgaccatcctctcggactccgagctggacggacgaggctagacttactactgcctagttcaagtataacaagctactactcctcttcgtgttacgtcggtacgacgggtaaccgacgggtcgtaccgtacctacgtctacgacccg

SEQ ID NO: 301096 - DNA, 687 bp, Homo sapiens
  misc_feature: GZ8MTXP02F9TFG.38.36.D03.1.454.CMB.2.raw
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctcgagtctgcgtctcctggacagtcatcacatctcctgcactggaaccagcagtgacattggtcattataactctgtctcgtagtaaccaacaaccacccacggaccaacgacccccaaaactctaatttattatggtacggtaccgaatccggaccctccgtaaggtaactttactaaacttcgtaccttctcgtcggccttacctaaacgtcctaggaccaaaccgacccggtccctaccccgttacgaaccctacttcccttacgtaccgggtaaccttacccgaagggaccgttacgggaaacgggaaccgggtaacgggtaccgttaggtaaacttttaaaccgtaccgttacgtacgtaacggtttacctaaattaaacttaaaccgaaacgtaccctaaaccttaccttacctttctttaccgttagtttacgttcggggacggaacggggtaaccgtaaggggtaccgtaacccgttaccgtaacgtaccgacgtaacccgg

SEQ ID NO: 301097 - DNA, 613 bp, Homo sapiens
  misc_feature: GZ8MTXP02FZXXO.38.36.D03.1.454.CMB.2.raw
  modified_base (231)..(231): a, c, t, g, unknown or other
  misc_feature (231)..(231): n is a, c, g, or t
  modified_base (318)..(318): a, c, t, g, unknown or other
  misc_feature (318)..(318): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgccgtctcctggacagtcgatccaccatctcctgcactggaaccngcagtgacagttggtctattataactctgtctcgtcgtaaccaacaaccacccacggacccaacgacccccaaaatctattatttanggtacggtaccggaatccggcctacgagtaactttctaactcgtcctttcgtctacgggtcctccgtaagtcgtcggaccaaaccgacccggtccctccctacgaaaccctcgttccttaccgtcgggtacctcccgagggcctaggacgggaccgaggtctagtacttacgtactcgactagttctaataactaacgaacgtactaccttacgtccttctttcgtacgtttacgtccggggcggtaacgggaacgtcgggtacacccggttactaacggtaccacggtaccccg

SEQ ID NO: 301098 - DNA, 513 bp, Homo sapiens
  misc_feature: GZ8MTXP02JMFCZ.38.36.D03.1.454.CMB.2.raw
  modified_base (190)..(190): a, c, t, g, unknown or other
  misc_feature (190)..(190): n is a, c, g, or t
  modified_base (334)..(334): a, c, t, g, unknown or other
  misc_feature (334)..(334): n is a, c, g, or t
  modified_base (397)..(397): a, c, t, g, unknown or other
  misc_feature (397)..(397): n is a, c, g, or t
  modified_base (403)..(403): a, c, t, g, unknown or other
  misc_feature (403)..(403): n is a, c, g, or t
  modified_base (449)..(449): a, c, t, g, unknown or other
  misc_feature (449)..(449): n is a, c, g, or t
tcagtcgatcacgtcacgaccggtgctcgatttagctgcgtcacgatctctcttggggggtctcaggaggcagcgctctcaggacatctccaccatggcctgggctctgctgctcctcaccctcctcactcagggcacagagtcctgggcccagtctgccctgactcagcctgcctccgagtctgcgtcncctggacagtcgatcacatctcctgcactggaaccagcagtgacattggtcattataactctgtctcgtgtaccaacaacacccaggccaagcccccaaatcatttattatgagtcgaatcggcctcagatttcaatcgcttcnctggctccaagtctcggcaaccacggcctccctagactcatctcctggaactccaggcctagnggacgnggctagattacactgactagttcatatacgaatcaacttctacctnttaccgtgttacgttcggacggtaagggaaccctagggggtctaccgtctaaacgtcgaaccgg

SEQ ID NO: 301099 - DNA, 531 bp, Homo sapiens
  misc_feature: GZ8MTXP02HFX0O.38.36.D03.1.454.CMB.2.raw
  modified_base (228)..(228): a, c, t, g, unknown or other
  misc_feature (228)..(228): n is a, c, g, or t
tcagtcgatcacgtcacgaccggtgctcgatttagctgcgtcacgatctctcttgggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccngcagtgacattggtcattataactctgtctcgtggtaccaacaacaccaggaccaacgcccccaaatcatttatttatagacggtccgaatccggccctccaggaatttctaatcgcttctctggctccaagtctggactaacacggtcctccctgacctatcctctcggactccgagctggacggacgaggctgattacgtactgcagttcataatacaagcctaactactcctacgttctagttacgttcggcggtaacgggccgtagggtacgaccgttaccgtaagtccgacgaacccg

SEQ ID NO: 301100 - DNA, 544 bp, Homo sapiens
  misc_feature: GZ8MTXP02H4S0T.38.36.D03.1.454.CMB.2.raw
  modified_base (271)..(271): a, c, t, g, unknown or other
  misc_feature (271)..(271): n is a, c, g, or t
  modified_base (464)..(464): a, c, t, g, unknown or other
  misc_feature (464)..(464): n is a, c, g, or t
  modified_base (471)..(471): a, c, t, g, unknown or other
  misc_feature (471)..(471): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccagcagtgactattggcattaataactctgtctcgtgtaccaanaaccacccaggaccaacgacccccaaactcaatttatttatgaggtaccgaatccggcctccaaggtaactttctaaatcgtcttctctcggctccaagtctcggacaaacaccgccctccctgacctatcctcgtcggaacctcccagggcctggacggacgaggcttagattacactgacagttcaattanacaaacnctactactctcgttctagttacgtcggacggacggaaccgtaggtaccgtaccgtacgtacgtacgacgaccg

SEQ ID NO: 301101 - DNA, 675 bp, Homo sapiens
  misc_feature: GZ8MTXP02G0WM5.38.36.D03.1.454.CMB.2.raw
  modified_base (307)..(307): a, c, t, g, unknown or other
  misc_feature (307)..(307): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccagcagtgactattggtacattatactctgtctcgtgtaccaacacaccaggaccaacgaccccaaatctatttatttanggtacggtaccgaatccggtcctaccgtagtaactttctaatccgtacttctccgtcggtacttaccgaagttccgtacggaccaaaccgtacccggtcccttccccgtacgaccctacttccctcgtaccggaccttccgaggccgtagggaacgggtaccggtaaggcttaggttaacttaccgttacgtacggtacttacggttactaaacttaactaaacgaaacgtaccctaaccgttaacccttccctttacctttacgtttacggtttaaccggttccgggggtaaccggtaccgggggaaccgttacgggggtaccgtaacccggttaccgtaaacggttacccgaccggtaaaccccgg

SEQ ID NO: 301102 - DNA, 546 bp, Homo sapiens
  misc_feature: GZ8MTXP02IRSGY.38.36.D03.1.454.CMB.2.raw
  modified_base (363)..(363): a, c, t, g, unknown or other
  misc_feature (363)..(363): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctcgagtctgcgtctcctggacagtcgatcaccatctcctgcactggaaccagcagtgacattggtcattataactctgtctcgtggtaccaacaacacccaggacccaacgacccccaaactcatttatttatgacggtccgaatccggcctcagatttctaatcgcttctctgctcatctgcacncgcctcctgaccatctctcggactccgaggctggaggacgaggtctagtacttactacgtcgctagttacaatataacaagactaaccttacttccttctttacgttacgtttacgttccggggcgggtaacgggtaaccgtacggggttacgtacccgtaccgtaaacgtccgacgacccgg

SEQ ID NO: 301103 - DNA, 730 bp, Homo sapiens
  misc_feature: GZ8MTXP02HG498.38.36.D03.1.454.CMB.2.raw
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctcgagtctgcgtctctggacagtcgatcacatctctgcacgtggaaccagcagtgacattggtggttataaattgtctctgtacaacagcaccggcaatcgacccccaaaatcaatgtactttatgacggtcactcactcccggccctcgacggggtttctaagtcgtcttctactgtctactccaagtcctagggaccaacgacccggtccctccctacgaccctacgttccgtcgttcggggtacccttaccggaacgggtccgttacggggaaacggggtaacccgggtaacgggttaaccgttttaaaacttttaacgttttcccgttacgggtaccttaaccggtttaacgtaaacgtttaaaccgttaaaacccaaaaccccgttaaacggaaccccgtaaaaccgttaccctttaccgtacgggttaacccttaaaccggggtttcccggggaaaaccgggggttaaccgggggaaaacccgttaaaacgggtccggtaacccggtaaccccggtttaacccggttaaaacggtttaacccccggg

SEQ ID NO: 301104 - DNA, 620 bp, Homo sapiens
  misc_feature: GZ8MTXP02JUTBB.38.36.D03.1.454.CMB.2.raw
  modified_base (230)..(230): a, c, t, g, unknown or other
  misc_feature (230)..(230): n is a, c, g, or t
  modified_base (520)..(520): a, c, t, g, unknown or other
  misc_feature (520)..(520): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctcgagtctgcgtctcctggacagtcgatcaccatctcctgcacgtcggaaccngcagtgactagttggtctaattactaactctcgtctacggtacggtaacccaaacaaccacccgacggacccaaacgacccccaaactctaatttattataggaggtaccgaatccgtcctacgagtaactttctaatcgtcttctcgtcgaaactccgaagtcgtacggaccaaccgacccggtccctacccgtagaccctatccttacgtacggaccttccgaggtccgtaggaacgggacgaggtctagtaacttacgtactggacttagtacaatactaacgaacnctaacttacccttccgttactttcgtacggtttaacgtccgggtacggacgggtaaccgacgggttaccgtaccgtacgtacgtaccgacggaaccccgg

SEQ ID NO: 301105 - DNA, 606 bp, Homo sapiens
  misc_feature: GZ8MTXP02JQVR4.38.36.D03.1.454.CMB.2.raw
  modified_base (232)..(232): a, c, t, g, unknown or other
  misc_feature (232)..(232): n is a, c, g, or t
  modified_base (237)..(237): a, c, t, g, unknown or other
  misc_feature (237)..(237): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgccgtctcctggacagtcgatcacctatctcctgcacgtggaaccngcagngacattggctattataactctgtctcgtggtaaccaacaaccaccgacgaccaacgacccccaaaatctaatttattataggtacggtaccgaactccggtcctaccgagtaactttactaactcgtccttcttcgtcggtactacctacgtctacggaccaaaccgcccgcccttccctagaccctatccctcgtcggtacctccgagccgtaggaggacgaggcttagattactagcgtctagttaccattaactacaacgacctaacttacctcccttacgtttcgttacgttaccgttcggggtacggacggggtaaccgtagggttcccggtaaccgttcgtaaacggtccaacggtaacccgg

SEQ ID NO: 301106 - DNA, 512 bp, Homo sapiens
  misc_feature: GZ8MTXP02HTJNK.38.36.D03.1.454.CMB.2.raw
  modified_base (247)..(247): a, c, t, g, unknown or other
  misc_feature (247)..(247): n is a, c, g, or t
  modified_base (297)..(297): a, c, t, g, unknown or other
  misc_feature (297)..(297): n is a, c, g, or t
  modified_base (331)..(331): a, c, t, g, unknown or other
  misc_feature (331)..(331): n is a, c, g, or t
  modified_base (435)..(435): a, c, t, g, unknown or other
  misc_feature (435)..(435): n is a, c, g, or t
tcagtcgatcacgtcacgaccggtgctcgatttagctgcgtcacgatctctcttgggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccagcagtgacattggcattanaactctgtctcgtgtacaacaacaccagccaagccccaaatcattattangagtcgaatcggcctcagtatttcaatcgtcttntctgctccaagtctcggacacacgcctccctgaccactctcgtcggacctcagggtctggacggacgacggtctgacttactactgcctagtcataatacaaanctactaactcctacttcgtagttacgtccgggacggacgggaaccgtagggtcgtacctcgttaacgcgacgacccg

SEQ ID NO: 301107 - DNA, 529 bp, Homo sapiens
  misc_feature: GZ8MTXP02H82OH.38.36.D03.1.454.CMB.2.raw
  modified_base (229)..(229): a, c, t, g, unknown or other
  misc_feature (229)..(229): n is a, c, g, or t
  modified_base (236)..(236): a, c, t, g, unknown or other
  misc_feature (236)..(236): n is a, c, g, or t
  modified_base (439)..(439): a, c, t, g, unknown or other
  misc_feature (439)..(439): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcacccctcctcactcagggcacagagtcctgggcccagtctgccctgacctcagcctgcctccgagtctgcgtctcctggacagtcgatcaccatctcctgcactggaancagtagngacattggtggttataactatgtctctgtaccaacacacccagcaaacgcccccaaatcaactctattatgacgtcactcatcccggcctcgtaggggtttctactcgtcttctctggcctacctaagtttcgcaacaccgccctccctgaccctattccgtggcctcgagctgaggacgaggctagtaattttatgctctanatatacaggcagcacgcctaacccttatcgttcttacggaaacgttcgggaacctaacggtccacccgtacacgtcacgaccccgaaacg

SEQ ID NO: 301108 - DNA, 537 bp, Homo sapiens
  misc_feature: GZ8MTXP02IV9E6.38.36.D03.1.454.CMB.2.raw
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatccaccatcctcctgcactggaaccagcagcgacattggtcaattataactctgtctcgtgtaccaacaaccaccagccaacgacccccaaatcatttattatgacggtccgaatccggcctcagtatttctaatcgcttctctgctcagtctggacacaccgcctccctgaccatcctctcggactccgaggctgaaggaccgagctgtactttacgactgctagttcaattataacaagtcctaacttaccttcccttctttcttagttacgttccgggcggtaacgggaaccgtagggtccgtacccgtacgtaacgtcgacgacccgg

SEQ ID NO: 301109 - DNA, 673 bp, Homo sapiens
  misc_feature: GZ8MTXP02GCZUC.38.36.D03.1.454.CMB.2.raw
  modified_base (224)..(224): a, c, t, g, unknown or other
  misc_feature (224)..(224): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctcgagtctgcgtctctgacagtcgatcacatctctgcactggaaccngcagtgactattgtacattactaactctcgtctacgtacgtaaccaaacaaccaccgacggaccaaaccgacccccaaatctactttattagtggtacggtaccgaagtccggacctacgtaagttaactttcgtaactccgtacttctcgtcgtctacgtaacgtcgtacggacaaacccgacccgtcccttaccctagaccctattccgtacgtaccgtaccgtaccgacgggtactacgggaaacggaaccggtcgggtacctagttaaacctttacgttactacggtaccgtagtttacaatttaacaacccgaataccctaacctttcccgttaccttcgtttacttacggtttaaccggtccggggacggggttaaccgggaaccgtacggggtttaaaccgacccccggttacgtaacggttacccaaaccggtacccccgg

SEQ ID NO: 301110 - DNA, 604 bp, Homo sapiens
  misc_feature: GZ8MTXP02JYIA8.38.36.D03.1.454.CMB.2.raw
  modified_base (424)..(424): a, c, t, g, unknown or other
  misc_feature (424)..(424): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactaggaaccagcagtgactattggtctattataactctgtctcggtacgtaccaacaaccaccacggaccaaccgaccccaaactctatttacttataggacggttaccgaacgtccggtaccctacgaaggttaatttactaaagttcgtacctttctcgtcggtcctaccgtaagtcgtcggaccaaccgaccgtccctccncgaacctctctcgtcggactcgaggctaggaggacgaggtctagtacttactagtcacgtacttactactaactaacaatacctacttaccttccttactttcgttacgtttacgtcggggacgggtacggtaaccggacgggtacgtacccgtaccgtaacgtccgaccggtaacccgg

SEQ ID NO: 301111 - DNA, 639 bp, Homo sapiens
  misc_feature: GZ8MTXP02GR8NJ.38.36.D03.1.454.CMB.2.raw
  modified_base (230)..(230): a, c, t, g, unknown or other
  misc_feature (230)..(230): n is a, c, g, or t
  modified_base (482)..(482): a, c, t, g, unknown or other
  misc_feature (482)..(482): n is a, c, g, or t
  modified_base (554)..(554): a, c, t, g, unknown or other
  misc_feature (554)..(554): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcacgtggaaccngcagtgactattggtactattataactctgtctcgtacgtaaccaacaaccaccacggaccaaccgacccccaaaatcctaatttactttagtacggtacggtaccggtaacgtccggtacccttaccggtacggggtttcctacgtccgtctttccgttcgtcggtcctaccgtaagtttcggacaaccgaccggtccctcccgtacgacccttagtttcggcggtcctccgagggtctagggacgacggngtacgttagttaaactttttgtactccttccgtataagtactacgaggacacgacgacgccctaacccgttnttcgttacgttacggaaccgtacgggaacctaacggtcctaacccgttccgtaacgtcaccgtacccgaacgtaccccaaacccg

SEQ ID NO: 301112 - DNA, 537 bp, Homo sapiens
  misc_feature: GZ8MTXP02IX7CE.38.36.D03.1.454.CMB.2.raw
  modified_base (228)..(228): a, c, t, g, unknown or other
  misc_feature (228)..(228): n is a, c, g, or t
  modified_base (320)..(320): a, c, t, g, unknown or other
  misc_feature (320)..(320): n is a, c, g, or t
  modified_base (331)..(331): a, c, t, g, unknown or other
  misc_feature (331)..(331): n is a, c, g, or t
  modified_base (338)..(338): a, c, t, g, unknown or other
  misc_feature (338)..(338): n is a, c, g, or t
  modified_base (384)..(384): a, c, t, g, unknown or other
  misc_feature (384)..(384): n is a, c, g, or t
  modified_base (394)..(394): a, c, t, g, unknown or other
  misc_feature (394)..(394): n is a, c, g, or t
tcagtcgatcacgtcacgaccggtgctcgatttagctgcgtcacgatctctcttggggggtctcaggaggcagcgctctcaggacatctccaccatggcctgggctctgctgctcctcaccctcctcactcagggcacagagtcctgggccccagtctgccctgactcagcctgcctccgagtctgcgtctcctggacagtcgatcaccatctcctgcactggaaccngcagtgacatggtcattataactctgtctcgtggtaccaacaacacccaggccaagcccccaaatcattattatgagtccgaatcggcctcnggaattctaancgcttcnctgctccaagtctggccaaacacgtctccccctagaccatcttccnggacctaccncgctggaaggacgagctagacttactactgactagttacatactaacaacgacctaaccttactccgttacttcgttacgttacgtccgggacggtacggaaccgtagggtaccgtaccgtacctaacgtacgaacgtacccg

SEQ ID NO: 301113 - DNA, 532 bp, Homo sapiens
  misc_feature: GZ8MTXP02JG8SD.38.36.D03.1.454.CMB.2.raw
  modified_base (432)..(432): a, c, t, g, unknown or other
  misc_feature (432)..(432): n is a, c, g, or t
  modified_base (439)..(439): a, c, t, g, unknown or other
  misc_feature (439)..(439): n is a, c, g, or t
  modified_base (450)..(450): a, c, t, g, unknown or other
  misc_feature (450)..(450): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccagcagtgacattggtactattataactctgtctcgtagtaaccaacaacaccaggccaacgaccccaaatcattattatgacgtcgaatcggcctcagtaactttctaatcgtcttctcgtcgctccaagtcgtacgcaaccaccgtccctccctgaccatctctcggacctcgagctaggacggcgaggtctgtacttactcngctagtnaatataacganactaactccttctacttactagtttacgtcggacggtacggtaaccgtagggtacgtaccgtactacgtccgacgtaacccg

SEQ ID NO: 301114 - DNA, 697 bp, Homo sapiens
  misc_feature: GZ8MTXP02IKGVL.38.36.D03.1.454.CMB.2.raw
  modified_base (193)..(193): a, c, t, g, unknown or other
  misc_feature (193)..(193): n is a, c, g, or t
  modified_base (211)..(211): a, c, t, g, unknown or other
  misc_feature (211)..(211): n is a, c, g, or t
tcagtcgatcacgtcacgaccggtgctcgatttagctgcgtcacgatctctcgttggggggggtctcaggaggcagcgctctcaggacatctccaccatggcctgggctctgctgctcctcaccctctcactcagggcacagagtcctgggcccagtctcgcctgactcagcctgcctcgagtctgcgtctcngacagtcatcacatctcngcacgtaggaaccagcagtgactagttgtactaattaatactctgtcctcgtacgaacccaacaccaccgacgacccaaaccgaccccctaaaatcgtaactttaagtttacgtacggtaccggtacccggaacgttacccgggtaccccttaagtaaacgggttaaactttttacgtaaacgttccgttccctttccttaccggttccgggtacccttaacccgtaaacggttcccttacggggaaccctaaacccggtacccgtccccttaccccgtagtacccctaacttcccgtacgtacgggtaaccctcccgggaaggacgtacggaaaccggggtacgtaggtcctaggtaactttacgtaaccgtgtactaacgtttcaaactactaaacacgtacctacttaccttctactttacgcgtttacgaccgggtagaacggaacgtcggtacgtacgtacgtacgtaccgacgtacccgg

SEQ ID NO: 301115 - DNA, 554 bp, Homo sapiens
  misc_feature: GZ8MTXP02H0ADU.38.36.D03.1.454.CMB.2.raw
  modified_base (228)..(228): a, c, t, g, unknown or other
  misc_feature (228)..(228): n is a, c, g, or t
  modified_base (406)..(406): a, c, t, g, unknown or other
  misc_feature (406)..(406): n is a, c, g, or t
tcagtcgatcacgtcacgaccggtgctcgatttagctgcgtcacgatctctcttgggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatcctctgcactggaaccngcagtgacattggtcattataactctgtctcgtggtaaccaacaacacccaggcccaaacgaccccccaaactcaatttactttatagacggtccgaaatcggccctcaaggtaatttcgaaattcgacttctctggctccgaagtctggcaacacggcctaccctgacctatccgtncgactcgagctagaggacgaggtctagtattactacgtgctagttcaattactaacgaagcctactacttcccgttcttcgtacgtttacgtcggcggtaacgggaaccgtagggtcacccggttactaaacgtccaacggtaccccg

SEQ ID NO: 301116 - DNA, 708 bp, Homo sapiens
  misc_feature: GZ8MTXP02FJSLT.38.36.D03.1.454.CMB.2.raw
  modified_base (234)..(234): a, c, t, g, unknown or other
  misc_feature (234)..(234): n is a, c, g, or t
  modified_base (311)..(311): a, c, t, g, unknown or other
  misc_feature (311)..(311): n is a, c, g, or t
  modified_base (332)..(332): a, c, t, g, unknown or other
  misc_feature (332)..(332): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagccttcctccgagtctgcgtctcctggacagtcgatcaccatctcctgcactggaaccagcagngacattggtcattataactctgtctcgtggtaccaaacaaccaccccaggaccaacgacccccaaactcattattangaggtaccgaatcggaccctnacggtaatttctaatcgtcttactcgtggcctacctaaagttccgacgggtacaaaccgacccgggtcccttaccccgttaccggaaccctaacttcccgtaccgtacgggacccttcccgaacgggtcctagggaaccgggaacgggtacgggtacttacgggtaactttaacccgtaacgttacggacccttaagtttactaaactttaaactaaaccaaacgtaccctaaaacctttaacccgttccctttaccttttctttacggttttaaacggttccggggaccgggtaacggggttaacccgaagggggttcccgtaaaccccgttaccgtaaaacggtttccgaaaaccggtccccggtaaaaccggg

SEQ ID NO: 301117 - DNA, 694 bp, Homo sapiens
  misc_feature: GZ8MTXP02HW5ZK.38.36.D03.1.454.CMB.2.raw
  modified_base (270)..(270): a, c, t, g, unknown or other
  misc_feature (270)..(270): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccagcagtgacattggtcattataactctgtctcgtgtaccaanaaccacccaggaccaacgacccccaaactcattattatgagtaccgaatccggcctcgaggtaactttcgtaaatcgtacttctctaggctacccaagtcctcggacaaaccaccggccctccctacgacccatcctcgtacggacctccgaaggtcaggacgggacgtaacggctaggtacttaacgtaccgtggtactaacggtttacaactttaaacttaaccgtaaaacgacccttaaaacctttaacccttacccctttaccttttccggtttacggttttaaaccgttttcccgggggtaaccgggggtaaaccggggggtaaacccccggtaaaggggggtttaccccggttaaacccccgggttaaacccggtttaaaaccggtttacccgtaaaacccgggtaaaccccccgggg

SEQ ID NO: 301118 - DNA, 651 bp, Homo sapiens
  misc_feature: GZ8MTXP02JR9P2.38.36.D03.1.454.CMB.2.raw
  modified_base (250)..(250): a, c, t, g, unknown or other
  misc_feature (250)..(250): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccagcagtgactagttgctattanaactctgtctcgtacgtaaccaacaaccacccgtacggaccctaacgacccctaaaatctaagtttaactttataggacggttaccgaaactccggtacctaccgaggtaaactttctaatcgtacttcgtctggcttacccaagttctacggacctaaaccgcccggtccctacccgtagacctacttctacgtcggtaacctcccgaagtccgtaagagggaacggtacggtaccttggtaaactttaccgtaacgttcgtaccgtaacgtttaacacgtaaacttaaacaaaacggacctaaaccttaaccgttcccgttatttacccgttaggtttaccgtcgggacggtacggtaaccgtacggtacgtaccgtacgtaacgtcgaacgtaacccg

SEQ ID NO: 301119 - DNA, 573 bp, Homo sapiens
  misc_feature: GZ8MTXP02GBMRJ.38.36.D03.1.454.CMB.2.raw
  modified_base (227)..(227): a, c, t, g, unknown or other
  misc_feature (227)..(227): n is a, c, g, or t
  modified_base (309)..(309): a, c, t, g, unknown or other
  misc_feature (309)..(309): n is a, c, g, or t
  modified_base (392)..(392): a, c, t, g, unknown or other
  misc_feature (392)..(392): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctcgagtctgcgtctcctggacagtcgatcaccatctctgcactggaaccngcagtgactagttggtcattataactctgtctcgtagtaccaacacaccagaccaaccgacccccaaatctaatttattagngacggtaccgaatccggacctcgaagtaatttactaactcgtcttctcgtcgctaccagtctggacaacgaccgtccctcccngaccatcctcgtcgactcgagctgacggacgagctagtacttacgtacgtgactagttacaataataacgaacgtcctaacttacccttccttacttcgttacggtttacgtcggggtaccgggaaccgggaacggtacggggtacgtacccgttacgtaacggtaccgacggaaccccgg

SEQ ID NO: 301120 - DNA, 626 bp, Homo sapiens
  misc_feature: GZ8MTXP02JOZK3.38.36.D03.1.454.CMB.2.raw
tcagtcgatcacgtcacgaccggtgctcgatttagctgcgtcacgatctctcttggggggggtctcaggaggcagcgctctcaggacatctccaccatggcctgggctctgctgctcctcaccctcctcactcaggcacagagtcctgggcccagtctgccctgactcagcctcgcctccgagtctgccgtctcctggacagtcgatcaccatcctcctgcacgtaggaaccagcagtgactagttggtactattataactctcgtctcggtacgtaaccaacaaccaccacgacccaaccgaccccctaaactctatttattatgacggtaccgaagtccgcctacgagtacttactaactcgtaccttctcgtcgctaccagtcgtacggaccacgtacccgccctcccacgaacctctctcgtacgacctcgagcgtagacggacgagtctagtacttacgtctgtaccgtagttacaatacgtaacctacgtaccctaccttaccttccctttacgtttacgttacggtttaccggttacccgggggaacgggtaaccggtaaccggttaacgggtacccggtacccgttaccgtaacggtacccgtaccggtaaaccccgg

SEQ ID NO: 301121 - DNA, 541 bp, Homo sapiens
  misc_feature: GZ8MTXP02INBEB.38.36.D03.1.454.CMB.2.raw
  modified_base (229)..(229): a, c, t, g, unknown or other
  misc_feature (229)..(229): n is a, c, g, or t
  modified_base (307)..(307): a, c, t, g, unknown or other
  misc_feature (307)..(307): n is a, c, g, or t
  modified_base (376)..(376): a, c, t, g, unknown or other
  misc_feature (376)..(376): n is a, c, g, or t
  modified_base (400)..(400): a, c, t, g, unknown or other
  misc_feature (400)..(400): n is a, c, g, or t
  modified_base (439)..(439): a, c, t, g, unknown or other
  misc_feature (439)..(439): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgacctcagcctgcctcgagtctgcgtctcctggacagtcgatccacatctcctgcactggaaccngcagtgactattggcattataactctgtcctacgcgtaccaacaacaccaggccaacgacccccaaatcatttattanagacgtcgatccgcctacacgtatttctaatcgtcttctcgttacgcttaccaagtctggacctaaacnccgccctaccctgaccactctacncggtctcgtaggctaggagacgaggtctagtaaattttntcgtcctctatatactacgagcacgacgacaccctaccttagtcgttacgtacggaacgtacggaaccgtacgtaccgtacgtaccgtacgaccaacgaccg

SEQ ID NO: 301122 - DNA, 560 bp, Homo sapiens
  misc_feature: GZ8MTXP02G5RAX.38.36.D03.1.454.CMB.2.raw
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcacgtggaaccagcagtgacattggtcattataactctgtctcgtagtaccaacaaccaccaggaccaacgacccccaaaactcaatttatttatagacggtaccgaatccggcctacgaggtatttcaactcgtcttctctggctctaagtctcggacaacgacgccctccctgaccctatcctctcggactaccgagtctaggaaggacgaggcgtagtacgtttacctagtcgatacgttcaatactacaacgacctacttacctccttcttcgttacggtttactccgggacggtaggaaccgtagggtacgtacccgtactacgtcgacgtacccgg

SEQ ID NO: 301123 - DNA, 573 bp, Homo sapiens
  misc_feature: GZ8MTXP02I2Q9I.38.36.D03.1.454.CMB.2.raw
  modified_base (200)..(200): a, c, t, g, unknown or other
  misc_feature (200)..(200): n is a, c, g, or t
  modified_base (266)..(266): a, c, t, g, unknown or other
  misc_feature (266)..(266): n is a, c, g, or t
  modified_base (277)..(277): a, c, t, g, unknown or other
  misc_feature (277)..(277): n is a, c, g, or t
  modified_base (305)..(305): a, c, t, g, unknown or other
  misc_feature (305)..(305): n is a, c, g, or t
  modified_base (350)..(350): a, c, t, g, unknown or other
  misc_feature (350)..(350): n is a, c, g, or t
  modified_base (443)..(443): a, c, t, g, unknown or other
  misc_feature (443)..(443): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacngtcgatcaccatctctgcactggaaccagcagtgacgttggtgttataatttgtctctgtaccaanacgcacccggnaactcgaccccaaaatcaatgtatttangagtcactcatccgcctgtacgggtttctacgtcgtcttctcgtnctactacctaagtcgtggaccacgaccggccctccgacgacctactctcgtggcctacgagtcaggacgacgaggtacttaaatttctttcgngtactacgttactaataacgtaacaacgtaacacctaaacctacttcgtacgttcgtacggtaccggacgggaaccggtaccaagtccgtaccgtaaccgtaccgtaacgtaccgaaccgaccgtaacgg

SEQ ID NO: 301124 - DNA, 611 bp, Homo sapiens
  misc_feature: GZ8MTXP02H1MMS.38.36.D03.1.454.CMB.2.raw
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctcgccctgactcagcctgcctccgagtctgcgtctcctggacagtcgatcaccatctctgcactcggaaccagcagtcgactagttggtctattataactctgtctcgtcggtaaccaacaaccacccgaggacccaaaccgacccccaaactctaactttatttatggacggtccggaactccggccctacgaggtaacttttctaactcgtactttctcgtcggtccttacccgtaagttccgtcggacctaaaccgcccggtcccttaccccgtagaccctacttccttacgtcggtacctcccgaaggtccaggacggacgacggcttagtattacctacgtgactagttacataactaacactacctaactccgttctacttcttacgttacgttcgggacggtagggaaccgtacggtacgtaccgtacgtaacgtcgacgtacccg

SEQ ID NO: 301125 - DNA, 634 bp, Homo sapiens
  misc_feature: GZ8MTXP02HCTTA.38.36.D03.1.454.CMB.2.raw
  modified_base (229)..(229): a, c, t, g, unknown or other
  misc_feature (229)..(229): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccngacagtagactagttgtactattactactctcgtcgtacgtacgtaaccaacaaccgaccgacgaccaaccaccccaactactatttattagtgtacggtacgtacgtccgcctacgtagtacttactactctcttcgtcgtcgtactacgtacgtcgtacgacaaccgccgtccctacccgtacgacctactcctacgtaccggtacctaccggacgtacggtacggaacggacggtacgtcgttaacgtaacgttacgtacgtcgtacgtacgttactaactaactaacgtaacgtaccttaaccttaccttcccttaccgttacgttacggttaccggtaccggggacgggtacgggtaacggtacgggtaccgtaccgtacgtacgtaccgaaccggaccg

SEQ ID NO: 301126 - DNA, 594 bp, Homo sapiens
  misc_feature: GZ8MTXP02FTLZK.38.36.D03.1.454.CMB.2.raw
  modified_base (301)..(301): a, c, t, g, unknown or other
  misc_feature (301)..(301): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctcgagtctgcgtctcctggacagtcatcacatctcctgcactgaaccagcagtgacattggtcattataactctgtctcgtgtaccaacaacaccaggaccaacgcccccaaactcattattangagtccgatcggcctcagtattctaatcgcttctctggctacagtctggacaacgacgccctaccctgaccctacttcgtaccgtcggtaccgtccggggtctacgggacggaaccggtagggcgttacggtatttaaccgtacgtacgtaccctaggtttacataactaacgaactctaactaaccttcctctttacgtcgtttaaacgttccggggtacggtaccggggtaaccggtaaggggttacccgtacccggtaccttaacgtaccgacgaacccccgtaaccggg

SEQ ID NO: 301127 - DNA, 576 bp, Homo sapiens
  misc_feature: GZ8MTXP02HGXQ2.38.36.D03.1.454.CMB.2.raw
  modified_base (396)..(396): a, c, t, g, unknown or other
  misc_feature (396)..(396): n is a, c, g, or t
  modified_base (408)..(408): a, c, t, g, unknown or other
  misc_feature (408)..(408): n is a, c, g, or t
  modified_base (462)..(462): a, c, t, g, unknown or other
  misc_feature (462)..(462): n is a, c, g, or t
tcagtcgatcacgtcacgaccggtgctcgatttagctgcgtcacgatctctcttgggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatcctctgcatcggaaccagcagtgactagttggtactaattatactctgtctcgtcgtaaccaacaacaccgacgacccaaccgacccccaactactaactttatttatcgtaggtaccgaacgtccggacctacgtagtaactttactaatctcttctctcgctacctagtcgtacgacaacnccgtcctacccncactactctcgtacgtaccacgcgcgagaggacgtagtctatacgttacacgtntactatactaatactaacactactaccttacgttccttacgttcgttacgttacggtccggtacggtacggtaaccggtacggtaccgtaccgtaacgtacgtacgaccgaccg

SEQ ID NO: 301128 - DNA, 610 bp, Homo sapiens
  misc_feature: GZ8MTXP02H0VFW.38.36.D03.1.454.CMB.2.raw
  modified_base (227)..(227): a, c, t, g, unknown or other
  misc_feature (227)..(227): n is a, c, g, or t
  modified_base (270)..(270): a, c, t, g, unknown or other
  misc_feature (270)..(270): n is a, c, g, or t
  modified_base (549)..(549): a, c, t, g, unknown or other
  misc_feature (549)..(549): n is a, c, g, or t
tcagtcgatcacgtcacgaccggtgctcgatttagctgcgtcacgatctctcttgggggggtctcaggaggcagcgctctcaggacatctccaccatggcctgggctctgctgctcctcaccctcctcactcagggcacagagtcctgggcccagtctgccctgactcagcctgcctcgagtctgcgtctcctggacagtcgatcaccatctcctgcactggaaccngcagcgacattggacattataactctgtctcgtgtaacccaanaaccacccaaggcccaaaccgacccccaaaacttcaatttaactttatacggacggtacccggaaattccgggacccctagaaaggtaactttcctaaagttccgtctttctcgtggcctaccgtagtcctggaacctaaacgcccgtccctcccgtagacccctaatcccgttactcgggacctcccgaggcctaggacggggaccgagggccttagaactttaccgaacgtgacctaagtttcaattacaacgtagactactacttcctctttacgngtttacgtcgggacggaccggaacgtaacggtcgtacccgtctaaacggttcaaccgcccg

SEQ ID NO: 301129 - DNA, 496 bp, Homo sapiens
  misc_feature: GZ8MTXP02JAAJX.38.36.D03.1.454.CMB.2.raw
  modified_base (228)..(228): a, c, t, g, unknown or other
  misc_feature (228)..(228): n is a, c, g, or t
  modified_base (303)..(303): a, c, t, g, unknown or other
  misc_feature (303)..(303): n is a, c, g, or t
  modified_base (338)..(338): a, c, t, g, unknown or other
  misc_feature (338)..(338): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctcgagtctgcgtctcctggacagtcgatcaccatctcctgcactggaaccngcagtgacattggtcattataactctgtctcgtgtaccaacaacaccagccaacgcccccaaactcattatttangagtccgaatcggcctcagtattctaatcgcttcnctgctcagtctgcaacacgcctccctgaccatctctcgactcagctgaggacgagctgattactactgctagttcatatacagtcactactctcttctagttacgttcggcggtaacggaaccgtagggtcgaccgtactaacggtcaacgtaccccg

SEQ ID NO: 301130 - DNA, 525 bp, Homo sapiens
  misc_feature: GZ8MTXP02IFK9T.38.36.D03.1.454.CMB.2.raw
  modified_base (474)..(474): a, c, t, g, unknown or other
  misc_feature (474)..(474): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcacccctcctcactcagggcacagagtcctgggcccagtctgccctgactcagcctgcctccgagtctgcgtctcctggacagtcgatcaccatctcctgcactggaaccagcagtgacatgtcattataactctgtctcgtgtaccaacaaccaccaggccaaacacccccaaactcatttatttatagaggtaccggaatcggtccctcagtaatttctaatcgcttctctcggctacctaagtctggacaacaccgcctccctgacccatcctactcggacctcgagggctggaaggaccgaggccttagacttactactgtctagttcaatataacaagctactactcctnttctagttacgtcgcggaggccgaggtcgaccgtctaacgtcacgtacccg

SEQ ID NO: 301131 - DNA, 615 bp, Homo sapiens
  misc_feature: GZ8MTXP02HRYOM.38.36.D03.1.454.CMB.2.raw
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccagcagtgacattggtctattataactctgtctcgtgtaccaacaacacccaggcccaacgacccccaaactctatttatttatgacggtcgaatccggcctcgaggtaactttcaaatcgtaccttctctgggtctcctaagttcctcggaccaaaccgccggtccctccccgttgaacccacttcctccgtcggtaacctcccgaggtcctaggacggaccgaggtaccttaggtaactttacctaacgtcggtctaagtttaccattaactaccgaaaagtcctaacttacctccttactttcgttacgttaacggttccggacgggttaacgggaaccgtaaggggtcgtaacccgtaccgtaacgttaccgacgtaaccccgg

SEQ ID NO: 301132 - DNA, 812 bp, Homo sapiens
  misc_feature: GZ8MTXP02H3WN8.38.36.D03.1.454.CMB.2.raw
  modified_base (239)..(239): a, c, t, g, unknown or other
  misc_feature (239)..(239): n is a, c, g, or t
  modified_base (259)..(259): a, c, t, g, unknown or other
  misc_feature (259)..(259): n is a, c, g, or t
  modified_base (261)..(261): a, c, t, g, unknown or other
  misc_feature (261)..(261): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcacccctcctcactcagggcacagagtcctgggcccagtctgccctgactcagcctgcctccgagtctgcgtcctcctggacagtcgatccacctatcctctgcactggaaccagcagtnactattgactattataactntntctcgtacgtaaccaacaaccaccgacggaccaaccgacccccaaaatcgtaatttaacttagtaggtaacggtccgaaacgtccggacccttacgaacggttaaacttttactaaacgttccgtcctttaccgtcgttccgggtaccttacccgaaaggttttcccgacgggaaaccctaaacccgtaccccgggttcccccttacccggtaccgtaaaccctaccgttccctttacccggggtaccggtaaccccttccccgggagggttaccgttacggggaaaaccgggtaacgggaccggtacgtttaccgaaacggttttaaccctaacgggtttcaacccgggtttaagtttaacctaaaagtttaaccaaaccgggttaaaacgtaccccctttaaaacccgttaaaccttttccccttttaccgtttacccggtttaaaggttttacgggttcccgggtaccgggggtacgggtaaacccgggtcggggttaaaccgtaccccggttaacgtaccggttaaccgaaccggtttaaaccccgg

SEQ ID NO: 301133 - DNA, 681 bp, Homo sapiens
  misc_feature: GZ8MTXP02ITYNL.38.36.D03.1.454.CMB.2.raw
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgacctcagcctgcctcgagtctgcgtctcctggacagtcgatcaccatcctcctgcactggaaccagcagtgactattggtcattataactctgtctgtcgtaacccaacaaccaccaggacccaaaccgacccccaaatctatttatttagtgacggtacgactccgccctacgagtatttctaatcgtcttctcgtggtcctaccgtaagtcgtacggacctaaccgacccgggtccctcccgtacgaccctaacttcccgttcgtacggtaccttacccgacgggtaccgtagggaaccgggaccggtacgggtaccgttaggtaacctttaacgtaaccgtgtaccgttacggtttacctaaattactaaacgtaacgtaccctaaccttaccctttacctttaccttttacgttacggtttacggttaccggggaccggggtaaccggggtaaccgtacgggggttacccgtaacccggttaccgtaaaacgtcccgtaaaccgtaccccgg

SEQ ID NO: 301134 - DNA, 658 bp, Homo sapiens
  misc_feature: GZ8MTXP02FM9LM.38.36.D03.1.454.CMB.2.raw
  modified_base (226)..(226): a, c, t, g, unknown or other
  misc_feature (226)..(226): n is a, c, g, or t
  modified_base (335)..(335): a, c, t, g, unknown or other
  misc_feature (335)..(335): n is a, c, g, or t
  modified_base (533)..(533): a, c, t, g, unknown or other
  misc_feature (533)..(533): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctctcactcagggcacagagtcctgggcccagtctgccctgactcagcctgcctcgagtctgcgtctcctggacagtcgatcacatctcctgcactggaaccngcagtgactagttcggtcaatttaataacctctacgtcttacggtacggtaaaccaaaccaaaccacccgacggacccaaacgaccccccaaaatcctaatttatttanacggtacggtaccgaactccggacccctagtaagtaactttactaaactcgtctttctcgtcggaccttaccgaaagttcctacgggaccaaacccgtaccggtccccttaccccggtacgaaccctaattccctacgtaccgggtacctacccgtaaggcctaggaacgggaccgagggtctagttaatttttacgntaccttcctataattacaacgacggacaacggacacgtaccctacccgttagttactaccggttaacgaacgttacggaaccgtaacgtccctaaacccggtcctaaccggacaccggaaccccg

SEQ ID NO: 301135 - DNA, 661 bp, Homo sapiens
  misc_feature: GZ8MTXP02GTIDU.38.36.D03.1.454.CMB.2.raw
tcagtcgatcacgtcacgaccggtgctcgatttagctgcgtcacgatctctcttgggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatcctcctgcacgtggaaccagcagtgactgttgtctattaataactctgtctcgtacgtaaccaaacaaccaccgacggacccaaccgaccccctaaactacctaatttaactttagacggtaacggtaccggtaacgtcccgggtaccctaccgaacggttaattttactaacgttcgtacctttctcgtcgggtacctaccgttaaggtttcggacctaaaccgcccgggtcccttacccgtacgtacctacgtttcggtcggtacctaccggtacggtcgtacgggacggacgacgggtcttaagttatttttatcgtaccttctatactaagtacgacggacacgcaccgtaccctacctttagtccgttcggttaaccggacgttacggaaccgtacggtccgtacccggtactacgtaccgacgaccccgaacggtaaccccc

SEQ ID NO: 301136 - DNA, 584 bp, Homo sapiens
  misc_feature: GZ8MTXP02GVKQB.38.36.D03.1.454.CMB.2.raw
  modified_base (385)..(385): a, c, t, g, unknown or other
  misc_feature (385)..(385): n is a, c, g, or t
  modified_base (495)..(495): a, c, t, g, unknown or other
  misc_feature (495)..(495): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctctcattcagggcacagagtcctgggcccagtctgccctgactcagcctgcctccgagtctgcgtctcctggacagtcgatcaccatcctcctgcactcggaaccagcagtgactattggtctattataactctgtctcgtgtaccaacaaccaccaggccaacgacccccaaatctaattattatgacgtccgaatccggacctcgagtaatttcaactcgtcttctcgtcggcctaccgtagtcgtagtaccgaaaccncccgggtccctaccccgtagaccctaactccgtactcgggtaacctccgacgggtcaggacggacggaggtctagaactttacactcgactagttacaattactacgaancctaactacttccttacttacttcgtttaacgtccggtaagggaccggtaacgagggtaccgaccgttcgtaaacgtcgacgtacccgg

SEQ ID NO: 301137 - DNA, 650 bp, Homo sapiens
  misc_feature: GZ8MTXP02FYI6O.38.36.D03.1.454.CMB.2.raw
  modified_base (306)..(306): a, c, t, g, unknown or other
  misc_feature (306)..(306): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctcgagtctgcgtctcctggacagtcgatcacatctctgcacgtgaaccagcagtgactagttggtcattataactctgtctcgtcgtaaccaacaacaccacggaccaacgccccaaatctattattangtacggtacgaatccggacctacgagtactttactaactcgtacttctcgtcgtctacctaagtcgtacggacaaccgtacccggcccttccctagacctagttcctaccgcggtacctacgaacggtccgtaggaacgggaccggaaggtccgtaggtaacttacgtactcgtcgtaacgttactaaattacaaacgtacgacttaaaccttacccgttcctttacctttacgttacggttttaccggtaccggggtaccgggtaacgggggtaacccgttaacgggggtaccgttaaaccccggggtacctaaacggttaccggaaccgtaaacccccgggg

SEQ ID NO: 301138 - DNA, 552 bp, Homo sapiens
  misc_feature: GZ8MTXP02FV6JA.38.36.D03.1.454.CMB.2.raw
  modified_base (227)..(227): a, c, t, g, unknown or other
  misc_feature (227)..(227): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctcgagtctgcgtctcctggacagtcgatcacatctctgcacgtggaaccngcagtgactattggtcattataactctgtctcgtacgtaacaacaacaccgagaccaacgacccccaaatcatttattatgtacggtaccgaatccggcctgagtattctaatcgtcttctctcgctactaagtctggacaacgacgccctcccagacctatctcgcgtacctcgaggctggacgggacgaggctagtacttaactcgtagctattaccaatactaacgaacactaacttcttccttctttcttacgttacgttccgggacgggacggaaccggtagggtacgacccgttacgaaacgtccgacggtaaccccgg

SEQ ID NO: 301139 - DNA, 676 bp, Homo sapiens
  misc_feature: GZ8MTXP02G6FIV.38.36.D03.1.454.CMB.2.raw
  modified_base (230)..(230): a, c, t, g, unknown or other
  misc_feature (230)..(230): n is a, c, g, or t
  modified_base (313)..(313): a, c, t, g, unknown or other
  misc_feature (313)..(313): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctcgagtctgcgtctcctggacagtcgatcacctatcctcctgcactggaaccngcagtgactattggtctattatactctgtctcgtgtaccaacaaccacccgaggaccaacgacccccaaatctatttatttangacggtaccgaatccggcctacgagtatttactaatcgtacttctcgtcggtctacctaacgtcgtaggacctaaaccgaccggtcccctcccgtagaaccctactccttacgtcggtaacccttccgaacggtccgtacggaacgggacggacgggtacgttggtaaactttaccgtaacgttcgtaccgttaacgtttaccaaattaactaaaccgtaagacccttaaccttacccttcctttaccgtttcgtttacggtttaccggttccggggtaccggggtaaacgggtaacccggttaacggggtaccggttaaccccggttacgtaaaccggtacccgtaacggtaaacccccggg

SEQ ID NO: 301140 - DNA, 649 bp, Homo sapiens
  misc_feature: GZ8MTXP02FP9SE.38.36.D03.1.454.CMB.2.raw
  modified_base (229)..(229): a, c, t, g, unknown or other
  misc_feature (229)..(229): n is a, c, g, or t
tcagtcgatcacgtcacgaccggtgctcgatttagctgcgtcacgatctctcttgggggggtctcaggaggcagcgctctcaggacatcctccaccatggcctgggctctgctgctcctcaccctcctcactcagggcacagagtcctgggcccagtctgccctgactcagcctgcctcgagtctgccgtctcctggacagtcgatccacatctcctgcactggaaccngcagtgacatggtcattatactctgtctcgtgtaccaacaacaccgagaccaacgacccccaaactcatttattatagtacggtaccgaatccggcctacaaggtatttactaattcgacctttctcgtggacccttacgaacgttcctaggaccaaacctacccggccctaccccgtagacctaactccttcgacggtacttcccgagggactcggaaacggcgaacggtcgtagtaacttacgttaactcggtaacttacggttaccttaaattaactaaacggaaacgtacctaaacccttaccgtttaacctttccggttttaaccttagggtttacgtttaccggggaaccggggttacggaacccgtagggggtaccgtacccgttacccgtaaagtccgtacgtaacccccgg

SEQ ID NO: 301141 - DNA, 731 bp, Homo sapiens
  misc_feature: GZ8MTXP02GJDON.38.36.D03.1.454.CMB.2.raw
  modified_base (305)..(305): a, c, t, g, unknown or other
  misc_feature (305)..(305): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcacatctctgcactggaaccagcagtgacattgtcattataactctgtctcgtgtaccaacaacaccaggaccaacgacccccaaactctatttattanggtacggttaccgaactccggtaccctacgtaaggtaactttactaacttcgtacctttactccgtcggaccttaccgtaaagttccgtagggaaccaaaccgacccgggtcccttaccccgtagtaaccctattcctaccgtacgggtaaccctccggtaacggtaccgttagggaaaccgggaacggtacggtacgttacggtaaacttttacccgtaacgttacgtaccgttaaacggtttaccctaaaagttaaccttaaacgaaaacgtaaccttaaaccgtttaaccccttacctttccgtttaccgtttacgggtttaacgtttacccgggggaacggggtaaacgggggtaacccgtaacgggggttaccgaaacccggtttacccggtaaaacgttcccgaaccggtaaacccccgg

SEQ ID NO: 301142 - DNA, 532 bp, Homo sapiens
  misc_feature: GZ8MTXP02JFXBC.38.36.D03.1.454.CMB.2.raw
  modified_base (229)..(229): a, c, t, g, unknown or other
  misc_feature (229)..(229): n is a, c, g, or t
  modified_base (310)..(310): a, c, t, g, unknown or other
  misc_feature (310)..(310): n is a, c, g, or t
  modified_base (336)..(336): a, c, t, g, unknown or other
  misc_feature (336)..(336): n is a, c, g, or t
  modified_base (391)..(391): a, c, t, g, unknown or other
  misc_feature (391)..(391): n is a, c, g, or t
  modified_base (400)..(400): a, c, t, g, unknown or other
  misc_feature (400)..(400): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgccgtctcctggacagtcgatcaccatctctgcactggaaccngcagtgacattggtcattataactctgtctcgtgtaaccaacaaccaccaggaccaacgcccccaaatcctatttatttangaggtccgatcggcctcgagtacttnaatcgtcttctgtggctcatcgtggcaacgccgtacctccctgacctatctacgnggcctacgngctggacggacgtagactttaagttatttcgtgactagttacattacaaccaccagacacactatcgtactacggttacggaccggacggaacaaggtactacggaccctacgtaacgtaccgacgtacccg

SEQ ID NO: 301143 - DNA, 588 bp, Homo sapiens
  misc_feature: GZ8MTXP02JI64K.38.36.D03.1.454.CMB.2.raw
  modified_base (310)..(310): a, c, t, g, unknown or other
  misc_feature (310)..(310): n is a, c, g, or t
  modified_base (519)..(519): a, c, t, g, unknown or other
  misc_feature (519)..(519): n is a, c, g, or t
tcagtcgatcacgtcacgaccggtgctcgatttagctgcgtcacgatctctcttgggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctctgcactggaaccagcagtgacattggtctattataactctgtctcgtgtaaccaacaaccaccacggacccaacgacccccaaatctattatttangacggtccgaatccggccctcgaaggtactttactaaatccgtctttctcgtcggcctaccgaagttctacgggacaaacgacccggtccctcccgtagaccctatccctctacggaccttacccgaggctacggaggacgaaggcttgaacttacgtaactgacctagttaccaataactacaacactaccttactcccttccgttcncgtaccgtacgttccggggacggtaacggacccgtaggggttacgacccgttaccgtaagcctaaccgg

SEQ ID NO: 301144 - DNA, 517 bp, Homo sapiens
  misc_feature: GZ8MTXP02GAJHI.38.36.D03.1.454.CMB.2.raw
  modified_base (302)..(302): a, c, t, g, unknown or other
  misc_feature (302)..(302): n is a, c, g, or t
  modified_base (317)..(317): a, c, t, g, unknown or other
  misc_feature (317)..(317): n is a, c, g, or t
  modified_base (338)..(338): a, c, t, g, unknown or other
  misc_feature (338)..(338): n is a, c, g, or t
  modified_base (379)..(379): a, c, t, g, unknown or other
  misc_feature (379)..(379): n is a, c, g, or t
  modified_base (410)..(410): a, c, t, g, unknown or other
  misc_feature (410)..(410): n is a, c, g, or t
  modified_base (415)..(415): a, c, t, g, unknown or other
  misc_feature (415)..(415): n is a, c, g, or t
  modified_base (425)..(425): a, c, t, g, unknown or other
  misc_feature (425)..(425): n is a, c, g, or t
  modified_base (430)..(430): a, c, t, g, unknown or other
  misc_feature (430)..(430): n is a, c, g, or t
  modified_base (451)..(451): a, c, t, g, unknown or other
  misc_feature (451)..(451): n is a, c, g, or t
tcagtcgatcacgtcacgaccggtgctcgatttagctgcgtcacgatctctcttggggggggtctcgggaggcagcgctctcaggacatctccaccatggcctgggctctgctgctcctcacctcctcactcagggcacagagtcctgggcccagtctgccctgactcagcctgcctccgagtctgcgtctcctggacagtcgatcaccatctctgcactggaaccagcagtgacattggtcattataactctgtctcgtggtaccaacacacccaggccaacgccccaaactcattattangagtcgaatcgcctnacgtatttcaagtctcttacnctggctacaagtctggactacgacgcctcctgaccatctcncggcctcaggctagaggacgagtctaatttnttacngactacgttnaactnaactaccagacaacactcgtnacgttatacggaccgtacgggacctaaggccttacggacgtccgtaaacgtcgaccgacctaacgg

SEQ ID NO: 301145 - DNA, 565 bp, Homo sapiens
  misc_feature: GZ8MTXP02JQ8X1.38.36.D03.1.454.CMB.2.raw
  modified_base (230)..(230): a, c, t, g, unknown or other
  misc_feature (230)..(230): n is a, c, g, or t
  modified_base (421)..(421): a, c, t, g, unknown or other
  misc_feature (421)..(421): n is a, c, g, or t
  modified_base (491)..(491): a, c, t, g, unknown or other
  misc_feature (491)..(491): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcacgtggaaccngcagtgacagttggtcattataactctgtactcgtacgtaccaacaaccacccaggaccaacgacccccaaaactctaatttattatgacggtccggtaatccggcctaccgagtactttactaatcgtcttctctcggctaccgtaagtctacggacaaaccgccgcccttaccctagacctactctacncggactccgaaggtctggagggaccgagggtctagaacttacgtacttgacagtttacatataacgaacnctaactcttcctcttcgttacgttacgtcggacggacggaacgtacggtactaccgtacgtacgccgacgaccg

SEQ ID NO: 301146 - DNA, 691 bp, Homo sapiens
  misc_feature: GZ8MTXP02F32JN.38.36.D03.1.454.CMB.2.raw
  modified_base (256)..(256): a, c, t, g, unknown or other
  misc_feature (256)..(256): n is a, c, g, or t
  modified_base (308)..(308): a, c, t, g, unknown or other
  misc_feature (308)..(308): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgatctgcgtctcctggacagtcgatcaccatcctctgcactcggaaccagcagtgacattggtcattataactctntctcgtcgtaaccaacaaccaccagaccaaccgccccaaactcatttattangtacgtcgaatcgccactagtattactaactcgacttctcgtcgcctactaacgtcgtagtaccaaacgcccggcctccctacgaaccctattcccgtacgtccggtaaccttcccgaagggtaccctaggaaacggggtaaccgacgggtcgttacggtaaacctttaacttaacgtccgggtacttaaacggtttaacctaattaaaacgtaaaccgtaaacgtaacccctaaacctttaacccggtttccctttacctttaccgttaacgggttttacgtaccgggggttacccggggaaacgggggtaaccccgtaaaacggggttccgaaacccccggttaaccgtttaaacggacccgtaaaaccggggtacccccg

SEQ ID NO: 301147 - DNA, 592 bp, Homo sapiens
  misc_feature: GZ8MTXP02JV52O.38.36.D03.1.454.CMB.2.raw
  modified_base (185)..(185): a, c, t, g, unknown or other
  misc_feature (185)..(185): n is a, c, g, or t
  modified_base (199)..(199): a, c, t, g, unknown or other
  misc_feature (199)..(199): n is a, c, g, or t
  modified_base (237)..(237): a, c, t, g, unknown or other
  misc_feature (237)..(237): n is a, c, g, or t
  modified_base (240)..(240): a, c, t, g, unknown or other
  misc_feature (240)..(240): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcacctcctcactcagggcacagagtcctgggcccagtctgccctgactcagcctgcctccgagtcngcgtctcctggacngtcgactcaccatcctcctgcacgtggaaccagcagtnacnttggtcattatactctgtctcgtagtaccaacaccaccgacggaccaaccgaccccaaatctaatttattagagtacggtacgtacgtccgactacgagtacttactaatcgtcttcgtcgtcgtctaccgtagtctcgactaacgacccgtccctaccctacgacctacttccgtacgtcggacccttcggaacgtcgtacgggtaggcgtacggcttacgtacttacgtacgtgtaccttaaggtacctatactaacgactactaccttacgtccttacttcgttagttacggtcggtacgggacgtaacggtacggtaccggtaccgtagtacggacctaccggacccg

SEQ ID NO: 301148 - DNA, 552 bp, Homo sapiens
  misc_feature: GZ8MTXP02HE2FJ.38.36.D03.1.454.CMB.2.raw
  modified_base (342)..(342): a, c, t, g, unknown or other
  misc_feature (342)..(342): n is a, c, g, or t
  modified_base (347)..(347): a, c, t, g, unknown or other
  misc_feature (347)..(347): n is a, c, g, or t
  modified_base (388)..(388): a, c, t, g, unknown or other
  misc_feature (388)..(388): n is a, c, g, or t
  modified_base (447)..(447): a, c, t, g, unknown or other
  misc_feature (447)..(447): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcaggcacagagtcctgggcccagtctgccctgactcagcctgcctccgagtctgctctcctggacagtcgatcaccatctcctgcactggaaaccagcagtgactagttggtcattataactctgtctacgtggtaaccaacaacacccaggaccaacgaccccaaatcatttattatgacggtacgatccggcctacagtattcaatcncttcnctgtctacagtcgtaggacaacaccgtcctcctgaccatcncgtcgactcccgtaggactggacggaccgaggtagttagtacttttagtgccttacccntaactatacgaagtcacgtcgacgcctaccctttagtccgttacgttacgaaacgttcgggaaccgaagttcccgacggtttaccgaccgtcgacccgaacccgg

SEQ ID NO: 301149 - DNA, 613 bp, Homo sapiens
  misc_feature: GZ8MTXP02FQFEV.38.36.D03.1.454.CMB.2.raw
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtctgccctgactcagcctgcctccgagtctgcgtctcctggacagtcgatcaccatctcctgcactggaaccagcagtgacattggtctattataactctgtcctgtcgtaccaacaaccaccgacgaccaaccgaccccaactctattattagtagtacggtaccgatccggcctaccgagtacttactactctacttctcgtcgtctacctagtcgtacggacaacgaccgtccctcccgtacgacctactccttacgtcgtaccgtaccgtacgtacgtacggacggtacggtacggtaactttaaactttacgtttcgtaggtaccctagttaacgtaactaaactaaccaaacctaacgaacctaacctactacgtacgtactaacggttccggacggaccggtaacgaacgtacgtacggtacccgtactaacgtaccgtacgaaccccgg

SEQ ID NO: 301150 - DNA, 674 bp, Homo sapiens
  misc_feature: GZ8MTXP02JCGND.38.36.D03.1.454.CMB.2.raw
  modified_base (554)..(554): a, c, t, g, unknown or other
  misc_feature (554)..(554): n is a, c, g, or t
tcagtcgatcacgtcacgaccggtgctcgatttagctgcgtcacgatctctcttgggggggggtctcaggaggcagcgctctcaggacatctccaccatggcctgggctctgctgctcctcaccctcctcactcagggcacagagtccgtgggcccagtctgccctgactcagcctcgcctccgagtctgcgtcctccgtggacagtcgatccaccatcctcctgacctacgtacggaaccagacagtacgactagttcggtactaattaatactctgtactcgtacgtaaccaacaaccaccgacggacccaaacccgacccccaaatactaatttaactttagtaggtacggtaccggtaacgtcccggtacctacgtaagttaacttactaactcgtcttctcgtcgtactacgtagtcgtacgacaaaccgcccgtaccctcccgtaacgcctattcccgtacgtccgtaccgtaccgaggtacctagggaaccggaggtacgtacgttagtaaccgttactacgtgtaccgtattactaataacgtaanacgtacctaactccttaccttctttacgttacgtttacggttaccggggacggtaaacgggtaaccggtaacggggtcccgtaaaccggttaccgtaacggtaccgaacggtaaccccgg

SEQ ID NO: 301151 - DNA, 600 bp, Homo sapiens
  misc_feature: GZ8MTXP02G3SN4.38.36.D03.1.454.CMB.2.raw
  modified_base (233)..(233): a, c, t, g, unknown or other
  misc_feature (233)..(233): n is a, c, g, or t
  modified_base (239)..(239): a, c, t, g, unknown or other
  misc_feature (239)..(239): n is a, c, g, or t
  modified_base (318)..(318): a, c, t, g, unknown or other
  misc_feature (318)..(318): n is a, c, g, or t
  modified_base (505)..(505): a, c, t, g, unknown or other
  misc_feature (505)..(505): n is a, c, g, or t
  modified_base (517)..(517): a, c, t, g, unknown or other
  misc_feature (517)..(517): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcagggcacagagtcctgggcccagtcctgccctgactcagcctgcctccgagtctgccgtctcctggacagtcgatcaccatctcctgccacgtagaaccngcagtnactagtgtctattactactctgtctcgtacgtaccaactaccaccgacgacctaaccgaccccaaatctaattacttanggacgtccgtaacgtccggtcctacggaagttaactttacgtaactccggttcttcctacgttcggaccttaccggtaaagtccgtacgggaacaacccgtaccgcccgttccctagaccctatcccgttagcgaacctccggaagcagggacgtacgaagtcctagtacttacgatcgactattanactactaagacncctaactcgttctacgttgttacgtacgtccggagtaccggtaacgtacgtaccggtaccgtacgtaacgccgtaacgtaccg

SEQ ID NO: 301152 - DNA, 673 bp, Homo sapiens
  misc_feature: GZ8MTXP02HYXE9.38.36.D03.1.454.CMB.2.raw
  modified_base (191)..(191): a, c, t, g, unknown or other
  misc_feature (191)..(191): n is a, c, g, or t
  modified_base (227)..(227): a, c, t, g, unknown or other
  misc_feature (227)..(227): n is a, c, g, or t
tcagtcgatcacgtcacgaccggtgctcgatttagctgcgtcacgatctctcttggggggggtctcaggaggcagcgctctcaggacatctccaccatggcctgggctctgctgctcctcaccctcctcactcaggcacagagtcctgggcccagtctgccctgactcagcctgcctccgagtctgcgtcncctggacagtcgatcaccatctcctgcatggaaccngcagtgactattggcattataactctgtctcgtaggtaaccaacaaccacccaggaccaaaccgacccccaaaatcctaatttaatttatggtaggtaccgaatccggcctaccgagtaatttcaattcgctttctccgtagtcctcctaaagttccacggacctaaaccgaaccgtccctacccgttcgaaccctattccctccttacggaccttacccgaacgggttctagggaacgggtaaccgagggtccgttagtaaacctttaaccgaacctgtaccggtacttaactaattaactaaccgtaaaacgaactaccttaaaacctttcccgttaccctttagttacgtttaaccgtttccgggaacggggttaacggggaacccgtaacggggttacggtaaccccgttacgtaaaaccggttccgaaacggaacccccgg

SEQ ID NO: 301153 - DNA, 524 bp, Homo sapiens
  misc_feature: GZ8MTXP01BR11R.38.18.B07.1.454.CMB.2.raw
  modified_base (258)..(258): a, c, t, g, unknown or other
  misc_feature (258)..(258): n is a, c, g, or t
  modified_base (463)..(463): a, c, t, g, unknown or other
  misc_feature (463)..(463): n is a, c, g, or t
tcagtcgatcacgtcacgaccggtgctcgatttagtcgctgcgtaaggggggactgctcagttaggacccagacggaaccatggaagccccagcgcagcttctcttcctcctgctactctggctcccagtttcacaaaccactggagaagtagtgatgacgcagtctccagccaccctgtctgtgtctccaggggacagcgccaccctctcctgcagggccagtcacagtattaacaataacttagcctggtaccaanagcagactggccaggctcccaggctcatcatgtatggttcatcccacagggccactgggtctcccgaggcctaggttcaggacggaaggcgggtctggggacaagagttcactctcaccattaacagtctgcaggctagaagtatttgctagtttatcctgtcagcaatatgatacgtggcctggcttcgactagtcgggaccgnggtggaagttacgaaacgagtgtggcgttgaccaactatctgtcttcaacttccgttcccg

SEQ ID NO: 301154 - DNA, 602 bp, Homo sapiens
  misc_feature: GZ8MTXP01B4Q8D.38.18.B07.1.454.CMB.2.raw
  modified_base (256)..(256): a, c, t, g, unknown or other
  misc_feature (256)..(256): n is a, c, g, or t
  modified_base (365)..(365): a, c, t, g, unknown or other
  misc_feature (365)..(365): n is a, c, g, or t
  modified_base (369)..(369): a, c, t, g, unknown or other
  misc_feature (369)..(369): n is a, c, g, or t
tcagtcgatcacgtcacgaccggtgctcgatttagtcgctgcgtaaggggggactgctcagttaggacccagacggaaccatggaagccccagcgcagcttctcttcctcctgctactctggctcccagtttcacaaaccactggagaagtagtgatgacgcagtctccagccaccctgtctgtgtctccgaggggacagccgccaccctctcctgcagggccagtcacagtataacaataacttagctgtacaanagcagactgcaggctccagctcatcatgtatgtcatccacaggccagtgtctccgagcaggtcagacggagcgggtctgggacaagagttcactctacaccattaacgngtcngacgagctagtaagttatttagacttacgtttacttcgtagtactaagtactaaagttagtacgtaacgttaccgtcggtcccgtaccgggtaccgttaccgtaccgtacgggtaccgggtaacgggtaagggtaacgggtaaacgttaaacgtaaacgacgttcggtacggttacgttcgacctaacgtacgttccgttacgttccttaccgtaaccgttcccgttaacccg

SEQ ID NO: 301155 - DNA, 566 bp, Homo sapiens
  misc_feature: GZ8MTXP01AOF56.38.18.B07.1.454.CMB.2.raw
  modified_base (257)..(257): a, c, t, g, unknown or other
  misc_feature (257)..(257): n is a, c, g, or t
  modified_base (360)..(360): a, c, t, g, unknown or other
  misc_feature (360)..(360): n is a, c, g, or t
  modified_base (396)..(396): a, c, t, g, unknown or other
  misc_feature (396)..(396): n is a, c, g, or t
tcagtcgatcacgtcacgaccggtgctcgatttagtcgctgcgtaagggggggactgctcagttaggacccagacggaaccatggaagccccagcgcagcttctcttcctcctgctactctggctcccagtttcacaaaccactggagaagtagtgatgacgcagtctccagccaccctgtctgtgtctccaggggacagcgccaccctctcctgcagggccagtcacagtataacaataactagcctggtaccaanagcagactggccaggcctcccaggctcatcatgtatggttcatccacgaggccacgtggtcgtcccgaggcaggttcaggacggaggcgggtctgggacaagngtcactctacactatacagtctgcaggctagaagtntttagacttagtttactccgttgtacagtacaatatgacttaccgtcggtccgtcggtaccgttacgacgtaggtcgggaaccggtagggtaaggaacgttacgaaacgttacgtggtcgggcttcggacaactagttcgtcgttaccttctaaccgttccttaaccccg

SEQ ID NO: 301156 - DNA, 514 bp, Homo sapiens
  misc_feature: GZ8MTXP01AJ8KO.38.18.B07.1.454.CMB.2.raw
  modified_base (317)..(317): a, c, t, g, unknown or other
  misc_feature (317)..(317): n is a, c, g, or t
  modified_base (357)..(357): a, c, t, g, unknown or other
  misc_feature (357)..(357): n is a, c, g, or t
  modified_base (510)..(510): a, c, t, g, unknown or other
  misc_feature (510)..(510): n is a, c, g, or t
tcagtcgatcacgtcacgaccggtgctcgatttagtcgctgcgtaaggggggactgctcagttaggacccagacggaaccatggaagccccagcgcagcttctcttcctcctgctactctggctcccagtttcacaaaccactggagaaatcgtgatgacgcagtctccagccaccctgtctgtgtctccaggggagagagccaccctctcctgcagggccagtcagagtgttagtaacaacctagcctggtaccatcagaaacctggccaggctcccagactcctcatctatgatgcatccaccagggccatggtntcccagccaggttcagtcggcaggtgggtctgggaacagngttcactctcaccatcagcagcctgcagtctagaagtattttgcttagtttattattgtcgagtctagtatgatcgagtcggcctccgtatccgaccgttcggccgagggggacacggactggaacaattaaacgaactgtcgctgctaaccngtcg

SEQ ID NO: 301157 - DNA, 644 bp, Homo sapiens
  misc_feature: GZ8MTXP01EGA0Z.38.18.B07.1.454.CMB.2.raw
  modified_base (257)..(257): a, c, t, g, unknown or other
  misc_feature (257)..(257): n is a, c, g, or t
tcagtcgatcacgtcacgaccggtgctcgatttagtcgctgcgtaaggggggactgctcagttaggacccagacggaaccatggaagccccagcgcagcttctcttcctcctgctactctggctcccagtttcacaaaccactggagaagtagtgatgacgcagtctccagccaccctgtctgtgtctccaggggacagcgccaccctctcctgcagggccagtcacagtataacaataacttagcctggtaccaanagcagactggccaggctcccaggctcatcatgtatggttcatcccacgagggccacgtggtcgtcccaggcaggttcaggacggaaggcgggtcgtaggggacaaggacgttcgactctacacctatttaaccagttctagcaggctagaagtattttagacttagtttacttcctgtacctaagtactaaagttagttggtaaacttacccgtgggtccccgttcggggtaacgtttcccggggaccctagggttccgggggaaccggtaaggggtaacgggtaaagttaccgtaaaaccggttaaacgttgggtaacggttccgttaggacccgtaacctacgttcttcggttcctttaccgtaacctttccccgtttcccccgg

SEQ ID NO: 301158 - DNA, 617 bp, Homo sapiens
  misc_feature: GZ8MTXP01C27MZ.38.18.B07.1.454.CMB.2.raw
  modified_base (258)..(258): a, c, t, g, unknown or other
  misc_feature (258)..(258): n is a, c, g, or t
tcagtcgatcacgtcacgaccggtgctcgatttagtcgctgcgtaagggggggactgctcagttaggacccagacggaaccatggaagccccagcgcagcttctcttcctcctgctactctggctcccagtttcacaaaccactggagaagtagtgatgacgcagtctccagccaccctgtctgtgtctcgaggggacagcgccaccctctcctgcagggccagtcacagtattaacaataactagctaggtaccaanagcagactggccaggcctccgaggctcatcatgtatggttcatccaccgaggccagtggtcgccgaggctaggtcaggacggaggcgggtgtgggacaacgtagttcacgtcctacacctataacagtctgacgaggtactagtaagttatttagacttagtttacttccgtagttaccagtactaattagtcgtaacttaccgtcggtcccgttacggtaccgtttccggacctaggggttaccgggaccgggtagggtaacgggggaacttaccggaaaacggttacgttacgggtgttaccgttcgaccgtaacctagttcgttacgtctttaccgtaacttccccgttaaccccg

SEQ ID NO: 301159 - DNA, 594 bp, Homo sapiens
  misc_feature: GZ8MTXP01CTJ01.38.18.B07.1.454.CMB.2.raw
  modified_base (552)..(552): a, c, t, g, unknown or other
  misc_feature (552)..(552): n is a, c, g, or t
tcagtcgatcacgtcacgaccggtgctcgatttagtcgctgcgtaagggggggactgctcagttaggacccagacggaaccatggaagccccagcgcagcttctcttcctcctgctactctggcctcccagtttcacaaaccactggagaagtagtgatgacgcagtctccagccaccctgtctgtgtctccgaggggacagcgccaccctctcctgcacgggccagtcacagtaattaacaataacttagcctaggtaccaacagcagactggccaggcctcccgagctcatcatgtatggttacactccaccgtagggcctacgtcgggtcgccccgaggctaggttcaggacggaggtcgggtgtaggggacaagacgttcactcctacgacctataacgtagtctgcaggctagtagtatttgctttagtttacttcctagtcaagtactaagttactagtactacgtcgtcccgtacggtaccgttacgacgtacgtggggaaccgtgggtaacggtaacgacaaacggttacgtacggtgttacgngcctaacctagtcgttactcttactaacgttccctaaccccg

SEQ ID NO: 301160 - DNA, 602 bp, Homo sapiens
  misc_feature: GZ8MTXP02JOQGE.38.18.B07.1.454.CMB.2.raw
  modified_base (374)..(374): a, c, t, g, unknown or other
  misc_feature (374)..(374): n is a, c, g, or t
tcagtcgatcacgtcacgaccggtgctcgatttagtcgctgcgtaaggggggactgctcagttaggacccagacggaaccatggaagccccagcgcagcttctcttcctcctgctactctggctcccagtttcacaaaccactggagaagtagtgatgacgcagtctccagccaccctgtctgtgtctccaggggacagcgccaccctctcctgcagggccagtcacagtattaacaataacttagcctggtaccaacagcagactggccaggctcccaggctcatcatgtatggttcatccacaggccactggtctcccaggcaggttcaggacggagcgggtctggggacagagttcactctcacattaacngtctgctaggctgaagtatttgctagtttatcctgtacagcaattatgacttaccgtggacccttcggtaccgtttcgaaccgtaggttacggggtacccggaagggttacgggaaaacggttaccggaaaaaccggtaaacgttcgggttacgggaccgttcgggaccgtaacccgtaattacccgtttacggttcctttacctaaccgtttcctttaaccccccgg

SEQ ID NO: 301161 - DNA, 614 bp, Homo sapiens
  misc_feature: GZ8MTXP02GXAKQ.38.18.B07.1.454.CMB.2.raw
tcagtcgatcacgtcacgaccggtgctcgatttagtcgctgcgtaagggggggactgctcagttaggacccagacggaaccatggaagccccagcgcagcttctcttcctcctgctactctggctcccagtttcacaaaccactggagaagtagtgatgacgcagtctccagccaccctgtctgtgtctccaggggacagcgccaccctctcctgcagggccagtcacagtataacaataactagcctgtaccacagcagactggccaggcctcccaggctcatcatgtatggttcatcccaccgagggccacgtcggtcgtcccaggcctaggttcaggacgggaacggcgggtcgtggggacagagttccacgtctcacctaattaacagtctagcaggactaggaagttgttttgaccttaggttttacttccgttagtactaagtactaaagttatagtacttacccgttcggtaccgttacgggtaccggtttccggaccgtaggtcggggtaaacggtacgggttagggtaacgtacgaaaacggtacgtacggtacgcgtacgaccgtaaccgtactacgttcgtccttactaccttccgttccccg

SEQ ID NO: 301162 - DNA, 560 bp, Homo sapiens
  misc_feature: GZ8MTXP02JGVGF.38.18.B07.1.454.CMB.2.raw
  modified_base (306)..(306): a, c, t, g, unknown or other
  misc_feature (306)..(306): n is a, c, g, or t
tcagtcgatcacgtcacgaccggtgctcgatttagtcgctgcgtaagggggggactgctcagttaggacccagacggaaccatggaagccccagcgcagcttctcttcctcctgctactctggctcccagtttcacaaaccactggagaagtagtgatgacgcagtctccagccaccctgtctgtgtctccaggggacagcgccaccctctcctgcagggccagtcacagtattaacaataacttagcctggtaccaacagcagactggccaggctcccaggctcatcatgtatggttcatccacnggccacgtggtcgtcccaggcaggtcagacggagcggggtctggggacaggagttcacgtctaccacctattaacagtctagcaggtctagaagtattttgctagtttactcctagtcagctaaatatagactacgtcgtccgtcggacgtttcgacgtagtacgggaccgtagggtacgggaaacgtacgaaaacggtaacgtaggtacgacgtgaccaactacgtcttcgtacttactactttcccttcccg

SEQ ID NO: 301163 - DNA, 562 bp, Homo sapiens
  misc_feature: GZ8MTXP02I9HO4.38.18.B07.1.454.CMB.2.raw
  modified_base (258)..(258): a, c, t, g, unknown or other
  misc_feature (258)..(258): n is a, c, g, or t
  modified_base (395)..(395): a, c, t, g, unknown or other
  misc_feature (395)..(395): n is a, c, g, or t
tcagtcgatcacgtcacgaccggtgctcgatttagtcgctgcgtaaggggggactgctcagttaggacccagacggaaccatggaagccccagcgcagcttctcttcctcctgctactctggctcccagtttcacaaaccactggagaagtagtgatgacgcagtctccagccaccctgtctgtgtctccaggggacagcgccaccctctcctgcagggccagtcacagtattaacaataacttagcctggtaccaanagcagactggccaggctccaggctcatcatgtatggttcatccaccagggccacgtcgggtctccccaggccaggttccaggacgggaaggcggggtactaggggactaggagtttccactctaccacctattaacngtctgcaggctgaatgtttgcttagtttattcctgtcagtactaattatgactacgtgcctcggtaccttcgacctagtacgggaccgaggtacggaacgtacgaaaacggtacgtggtacgacctgaccaaccgtactcgtcgttacttcgtacttcccttacccg

SEQ ID NO: 301164 - DNA, 585 bp, Homo sapiens
  misc_feature: GZ8MTXP02FUSZ9.38.18.B07.1.454.CMB.2.raw
  modified_base (258)..(258): a, c, t, g, unknown or other
  misc_feature (258)..(258): n is a, c, g, or t
tcagtcgatcacgtcacgaccggtgctcgatttagtcgctgcgtaaggggggactgctcagttaggacccagacggaaccatggaagccccagcgcagcttctcttcctcctgctactctggctcccagtttcacaaaccactggagaagtagtgatgacgcagtctccagccaccctgtctgtgtctccaggggacagccgccaccctctcctgcagggccagtcacagtattaacaatacttagcctggtaccaanagcagactggcagctccagctcatcatgtatggttcatccaccagggccactggtcgtcccaggcaggttcaggaggtaaggcgggtctggggacaggaagttcactctacaacctattaaacagtctgcaggactagtaaagtagttttgacgtaagtttacttccgtgtctaagctaaatagtgtacttaccgtggtacccgtacggtacgtttacgacccgtagtacggggaccggtagggtacggtaacgtacgaaaacggaacgttaggtacggcgtagaccgaaccgtattacgtacgtctttaccacttcccttaccccg

SEQ ID NO: 301165 - DNA, 553 bp, Homo sapiens
  misc_feature: GZ8MTXP02GGC15.38.18.B07.1.454.CMB.2.raw
  modified_base (343)..(343): a, c, t, g, unknown or other
  misc_feature (343)..(343): n is a, c, g, or t
  modified_base (373)..(373): a, c, t, g, unknown or other
  misc_feature (373)..(373): n is a, c, g, or t
  modified_base (391)..(391): a, c, t, g, unknown or other
  misc_feature (391)..(391): n is a, c, g, or t
tcagtcgatcacgtcacgaccggtgctcgatttagtcgctgcgtaaggggggactgctcagttaggacccagacggaaccatggaagccccagcgcagcttctcttcctcctgctactctggctcccagtttcacaaaccactggagaagtagtgatgacgcagtctccagccaccctgtctgtgtctccaggggacagcgccaccctctcctgcagggccagtcacagtattaacaataacttagcctggtaccaacagcagactggccaggctcccaggctcatcatgtatgttcatccacaggccactggtcgtcccaggcaggtcagacggagcgggtntggggacagagttcactctcaccattaacngtctgcaggctagaagtntttgctagtttactcctgtacagtactaatatgataccgtggcccgtacggtacgttacgaccgtagtacggggaccgaggtacgggaacgtacgaaaacgtaacgtggtacggactcgaccaacgtactcgtacgttaccttactacttccctttaccccg

SEQ ID NO: 301166 - DNA, 695 bp, Homo sapiens
  misc_feature: GZ8MTXP02HLAAW.38.18.B07.1.454.CMB.2.raw
  modified_base (335)..(335): a, c, t, g, unknown or other
  misc_feature (335)..(335): n is a, c, g, or t
  modified_base (345)..(345): a, c, t, g, unknown or other
  misc_feature (345)..(345): n is a, c, g, or t
  modified_base (427)..(427): a, c, t, g, unknown or other
  misc_feature (427)..(427): n is a, c, g, or t
tcagtcgatcacgtcacgaccggtgctcgatttagtcgctgcgtaaggggggggactgctcagttaggacccagacggaaccatggaagccccagcgcagcttctcttcctcctgctactctggcctcccagtttcacaaaccactggagaagtagtgatgacgcagtctccagcccaccctgtcctgtgtctccgaggggacagccgcccaccctctcctgcagggccagtcacagtaattaaacaattaattagcctaggtaaccaacgagacagacgtcggaccaggcctcccgaggcctcatcagttgtatggtcatcccacgacggtccncgtcgggtcnccgaggcgtagtacgaggacgggaacggcgggtacgtaggggacgtagtacgttccaactcctaccaaccgttattaaacgngttccgagtaccggtaacggtcttaaggtagtttaacgttttcggactttaggtttttacttccgttggtacctaaggacttaagttaagttgaaccgttccggttccgtcccggttaacggtccgttaccggtcgaacgggtacggggtaacccgtaggggtacgtaaacggtaaaccgggaaaacgtaccggttggaccgggtacttaccggaccgttaaccggtacttcgtttaccgtactttcccgaccttttcccgtaccccg

SEQ ID NO: 301167 - DNA, 581 bp, Homo sapiens
  misc_feature: GZ8MTXP02GNQXU.38.18.B07.1.454.CMB.2.raw
  modified_base (253)..(254): a, c, t, g, unknown or other
  misc_feature (253)..(254): n is a, c, g, or t
  modified_base (260)..(260): a, c, t, g, unknown or other
  misc_feature (260)..(260): n is a, c, g, or t
  modified_base (351)..(351): a, c, t, g, unknown or other
  misc_feature (351)..(351): n is a, c, g, or t
  modified_base (373)..(373): a, c, t, g, unknown or other
  misc_feature (373)..(373): n is a, c, g, or t
  modified_base (379)..(379): a, c, t, g, unknown or other
  misc_feature (379)..(379): n is a, c, g, or t
tcagtcgatcacgtcacgaccggtgctcgatttagtcgctgcgtaagggggggactgctcagttaggacccagacggaaccatggaagccccagcgcagcttctcttcctcctgctactctggctcccagtttcacaaaccactggagaagtagtgaatgacgcagtctccagccacctgtctgtgtctccgaggggacagcgccaccctctcctgcagggccagtcactagtataacataactgctgaccanncagacngcagctccagctcatcatgtatcggttcatccaccgaggtccacgtggtcgtcccgaggctaggtacgagacggaagcgggtctggacagngtcacgtctacgactagtaacngtctgnagctagaagtatttgactagtttactcttgtactagactaatacgtagtactaccgtcggtacccgttacggtccggttcgacgtacgggttcgggaccggtagggtaacggtacgttaacgaaaacggtacggtaggtacggacgttacgacctaacgtaacgttaccttggttacctaccgttacttcccgtttaccccg

SEQ ID NO: 301168 - DNA, 653 bp, Homo sapiens
  misc_feature: GZ8MTXP02FP6S2.38.18.B07.1.454.CMB.2.raw
  modified_base (328)..(328): a, c, t, g, unknown or other
  misc_feature (328)..(328): n is a, c, g, or t
tcagtcgatcacgtcacgaccggtgctcgatttagtcgctgcgtaaggggggggactgctcagttaggacccagacggaaccatggaagccccagcgcagcttctcttcctcctgctactctggctcccagtttcacaaaccactggagaagtagtgatgacgcagtctccagccaccctgtctgtgtctccgaggggacagccgcccaccctctcctgcgagggccagtcacagtattaacaataacttagcctaggtaaccaacagcagactggccaggctcccaggcctcatcatgtatgtcatccaccgcggcctacgtggtcncccgaggcaggttcaggaggaggcggtgtagggataggagttccacgtctaccaccctaattaacgacgtcgtacgcgaaggtcgtacgtaaagttagtttttacgactttagttttaactttcccgttagttacgtaacgaacctaaattaagtacgtaacttacccgtcggtacccgttaccggaccgttaccgaccgtacgtacggggtaccggtacggggtaacggaaaggtaaccgtaaaacggtaaacgttacgggtacgtacggtacgtaccgtaactacgttaccgtcgttacctacgttaccttcccgttaccccg

SEQ ID NO: 301169 - DNA, 607 bp, Homo sapiens
  misc_feature: GZ8MTXP01AVE1S.15.85.H08.1.454.CMB.2.raw
  modified_base (251)..(251): a, c, t, g, unknown or other
  misc_feature (251)..(251): n is a, c, g, or t
  modified_base (255)..(255): a, c, t, g, unknown or other
  misc_feature (255)..(255): n is a, c, g, or t
tcagtctacgtagccacgaccggtgctcgatttagtatcactcagccgcgggaggacgctgaccacacggtacgtgctgttgtactgctcctcccgcggctttgtcttggcattatgcacctccacgccgtccacgtaccagttgaacttgacctcagggtcttcggggcatcacataacaaccacattcctcctctaaagaagcccctgggagcacagctcatcaccatggactggacctggagttcctnttgnggtgcagcagctacaggtgtccagtcccaggtgcagctggtgcagtctgggggctgaggtgaagagcctgggtcctcggtgacgggtctcgtgcaaggcttcgtgcaggctacctttagcaaacttatcgtctttcgagtcgtgggtcgacggacgacggccccgtggaccgaagggcgttaggaggggttggggaagtgggggaggtacgtcgtaacttccgtaagtcccgttaggggacctaagggtaaagggtaactcccgaaacgacgaacggttacccgaaggggttacttaaaacgggttccaaccgtacgttaacccggacggaacgaacgtcccgaacgaaccg

SEQ ID NO: 301170 - DNA, 703 bp, Homo sapiens
  misc_feature: GZ8MTXP01EOBSJ.15.85.H08.1.454.CMB.2.raw
  modified_base (252)..(252): a, c, t, g, unknown or other
  misc_feature (252)..(252): n is a, c, g, or t
  modified_base (694)..(694): a, c, t, g, unknown or other
  misc_feature (694)..(694): n is a, c, g, or t
tcagtctacgtagccacgaccggtgctcgatttagtatcactcagccgcgggaggacgctgaccacacggtacgtgctgttgtactgctcctcccgcggctttgtcttggcattatgcacctccacgccgtccacgtaccagttgaacttgacctcagggtcttcggggcatcacataacaaccacattcctcctctaaagaagcccctgggagcacagctcatcaccatggactggacctggaggttcctntttgtggtggcagcagctacaggttccacgtccgaggtgcagcgtggtgcgagtcgtggggcgtgaggtggaagaacgccggtcggtccgtcggtggtaggtcccgtccgtgcgaaggcttctgcgagctacttagcaactatcgtctttcgagcgtgggcgtcgaccggacggtcccctaggggaacaacggggtctttagggagggttaggggggtaaggttaggggggaacgggtcttaacccggtaattttccccgttaaagttccccggtttaagggggaaacctaaacgggtttaaaggggtacccttaacccgaacggttaaacggtaaacgggtttaccccggaaagggggaaccttaaaaaccgttcccgaaaccccgttaaggtttaaccccgggaacgggaaacccggtaaaccttacccggtaaaccggnggaaacccc

SEQ ID NO: 301171 - DNA, 535 bp, Homo sapiens
  misc_feature: GZ8MTXP01ANLIM.15.85.H08.1.454.CMB.2.raw
  modified_base (513)..(513): a, c, t, g, unknown or other
  misc_feature (513)..(513): n is a, c, g, or t
tcagtctacgtagccacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcggggcatcacataacaaccacattcctcctctaaagaagcccctgggagcacagctcatcaccatggactggacctggaggttcctctttgtggtggcagcagctacaggtgtccagtcccaggtgcagctggtgcagtctgggggctgaggtgaagagcctgggtcctcggtgacgggtctcgtgcaaggcttctgcagggcacctttagcaactatgctttcagcgtgggtgcgacgaggcccctgggacgaagggcttggagggttgggagtggggagggtatcgtattcctagtccgttgggacaggtaaggtaatcccagagaagtccagggcaagttcaacntaaccgcgacatccgaagaacg

SEQ ID NO: 301172 - DNA, 681 bp, Homo sapiens
  misc_feature: GZ8MTXP01BTY1N.15.85.H08.1.454.CMB.2.raw
  modified_base (252)..(252): a, c, t, g, unknown or other
  misc_feature (252)..(252): n is a, c, g, or t
tcagtctacgtagccacgaccggtgctcgatttagtatcactcagccgcgggaggacgctgaccacacggtacgtgctgttgtactgctcctcccgcggctttgtcttggcattatgcacctccacgccgtccacgtaccagttgaacttgacctcagggtcttcggggcatcacataacaaccacattcctcctactaaagaacgcccctgggagcacagctcatcaccatgactggacctggagttcctnttgtggtgcagcagctacgaggtcgccacgtcccaggtcgcgagcgtggtgcgagtcgtgggggctggaggtagaaggtaacgtccgttcggggtccgtcggggtggtacgggttcctccgtgaccgtaaggtcctttcgtggaccgtaacgggtccctaaccgttttacggactaaacttgtcggttctttacggacgtcggttggggtcggaccggacgaccggccccggtaggaccgtaacggggtcttaggggaggggttggggtaagggtgggggaaggtatcgtaacgtttccgtacgttccgtaggggaacgtaaggttaacggtaactaccgaaggtaacgttacgttaacggacgggaaaccttacggacctaaccgtacgttaacccggacggaaccgacgtaaccccgaaggaacccg

SEQ ID NO: 301173 - DNA, 705 bp, Homo sapiens
  misc_feature: GZ8MTXP01DL864.15.85.H08.1.454.CMB.2.raw
  modified_base (338)..(338): a, c, t, g, unknown or other
  misc_feature (338)..(338): n is a, c, g, or t
  modified_base (487)..(487): a, c, t, g, unknown or other
  misc_feature (487)..(487): n is a, c, g, or t
  modified_base (658)..(658): a, c, t, g, unknown or other
  misc_feature (658)..(658): n is a, c, g, or t
tcagtctacgtagccacgaccggtgctcgatttagtatcactcagccgcgggaggacgctgaccacacggtacgtgctgttgtactgctcctcccgcggctttgtcttggcattatgcacctccacgccgtccacgtaccagttgaacttgacctcagggtcttcgggcatcacataacaaccacattcctcctactaaagaacgccccgtgggagcacagctcatcaccatggactggacctggtacggttccttcgtttggtggtggcagcaggctacgaggtcgtcccacgtaccccgaggtgccgagcgtgggtcgcgtaggtccggtgggggntagggtagggtaggaaaggacggtcccgttgggggttcccgtcgggtcgggtacccgggttccttacgtcggtaccgtaacggggtccctttcgtcggaccgtacgggtaccttaaccgtttacgacctaacttgtcgttcttaccggngtcggtgggtacgacgaccggtaccggccccggtaggaaccgtagggtacgttagggagggggtaggggtaggtaggggtacgggtacttcgtaccgttaccgttacgttacggtaccgggaagtacggttaacgggaacttacgagtaacgacggttacgacgggttaanaaccgttcaaccgtacgtaacccggacgacgttactcgaacgaaccg

SEQ ID NO: 301174 - DNA, 644 bp, Homo sapiens
  misc_feature: GZ8MTXP02JR6CP.15.85.H08.1.454.CMB.2.raw
tcagtctacgtagccacgaccggtgctcgatttagtatcactcagtcgcggggctgccctttggctttggagatggttttctcgatgggggctgggagggctttgttggagaccttgcacttgtactccttgccattcagccagtcctggtgcaggacggtgaggacgctgaccacacggtacgtgctgttgtactgcctcctcccgcggctttgtcttggcattatgcacctccacgccgtccacgtaccagttgaacttgacctcaggtctcgtgctcacgtccaccaccacgcatgtgacctcgaggggtccgagacacaatggcagtagtggaatgtattgttttgatagtcgtggggaccaaggggacagtgggtacacgttcgtacttctttccaacgtcccttcccgaacccgaaacggggccccaacgttcccggttcccttccccccgtcggacccctacccccgttccctacccgaaacggtaccgacccgacccgtcggtccgggggaccaaccgcgcccgggtccccgtgggccgtcgcccgtcggtaccgaacgggtccttaaccgttcccggacgttaccggtacgaccgtaggacggtcggggacgtcgggacgaacggcgacgacgtg

SEQ ID NO: 301175 - DNA, 633 bp, Homo sapiens
  misc_feature: GZ8MTXP02HJUQ6.15.85.H08.1.454.CMB.2.raw
tcagtctacgtagccacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcggggcatcacataacaaccacattcctcctctaaagaagcccctgggagcacagctcatcaccatggactggacctggaggttcctctttgtggtggcagcagctacaggtgtccagtccccaggtgcagctggtgcagtcgtggggctggaggtgaagagccgtgggtcctggtgacgggtcctccgtgcgtaggccttgtgcagggtcctaaccgttttaggacctaaacttagtcgtacctttcgagtccggttggggtcgaccggaccgacgggtcccccgtagggaccgaaggggtcctttggaaggtgggagtggggagggatacgtacttccgtaacgtccgttagggactaggtaaacggtactaccgaacgtaacgtaacggtttaccggacgggtactaaacggttaccaaccgtaacgttacccggaccggaaaccgtaacgtacccgaacgaaccg

SEQ ID NO: 301176 - DNA, 607 bp, Homo sapiens
  misc_feature: GZ8MTXP02G288W.15.85.H08.1.454.CMB.2.raw
  modified_base (402)..(402): a, c, t, g, unknown or other
  misc_feature (402)..(402): n is a, c, g, or t
tcagtctacgtagccacgaccggtgctcgatttagtatcactcagccgcgggaggacgctgaccacacggtacgtgctgttgtactgctcctcccgcggctttgtcttggcattatgcacctccacgccgtccacgtaccagttgaacttgacctcagggtcttcggggcatcacataacaaccacattcctcctctaaagaagccccctgggagcacagctcatcaccatggactggacctggaggttcctctttgtggtggcagcagctacaggtgtccagtccccaggtgcagctggtgcagtcgtggggctggaggtgaagagccgtggggtcctggtgacggggtctccgtgacgaaggtcttacgtcggcagggtcctaacctttagactaaactntgtctttcagtcgtgggtgccgtacgaccggccccgtagggaccgaagggtcgttgaggtggagtggggaggtatcgacgttctagtccggttagggaacgtagtaacggtactaccgaacgtaaggtacgttaccgacggggaacttaaacggaccgaacctaacgttacccgggacggaaccgaacgttaccccgaaggaccg

SEQ ID NO: 301177 - DNA, 555 bp, Homo sapiens
  misc_feature: GZ8MTXP02JAVUT.15.85.H08.1.454.CMB.2.raw
  modified_base (276)..(276): a, c, t, g, unknown or other
  misc_feature (276)..(276): n is a, c, g, or t
  modified_base (384)..(384): a, c, t, g, unknown or other
  misc_feature (384)..(384): n is a, c, g, or t
  modified_base (484)..(484): a, c, t, g, unknown or other
  misc_feature (484)..(484): n is a, c, g, or t
  modified_base (489)..(489): a, c, t, g, unknown or other
  misc_feature (489)..(489): n is a, c, g, or t
tcagtctacgtagccacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcggggcatcacataacaaccacattcctcctctaaagaagcccctgggagcacagctcatcaccatggactggacctggaggttcctcttgtggtggcagcagctacaggtntccagtcccaggtgcagctggtgcagtctggggctggaggtgaagaagccgtgggtcctggtgagggtcctccgtgcaggcttctgcaggccacctttagctaaactntgtctttcagtcgtgggtgcgacgacggcccctgggacagggtctgaggtggagtggggagggtatctagttcctagtccgtaggactaggtaacgtacnccganaggtaacgttaccgagggaccaaggtccaacgtacgttaccggacggacgaacgtccgaacgaacg

SEQ ID NO: 301178 - DNA, 725 bp, Homo sapiens
  misc_feature: GZ8MTXP02IM07J.15.85.H08.1.454.CMB.2.raw
  modified_base (309)..(309): a, c, t, g, unknown or other
  misc_feature (309)..(309): n is a, c, g, or t
tcagtctacgtagccacgaccggtgctcgatttagtatcactcagccgcgggaggacgctgaccacacggtacgtgctgttgtactgctcctcccgcggctttgtcttggcattatgcacctccacgccgtccacgtaccagttgaacttgacctcagggtcttcggggcatcacataacaaccacattccctcctactaaagaacgcccctggggagcacagctcatccaccatggactggacctggtaggttccttcttgtggtgcagcagctacgaggtcgtccagtccccaggtcgcagcgtggngcgagtcgtggggctggaggtagaaggacgccgttgggtccgtgggtcggacgggtcctccgtcgacgacggtcttcgtcggccacggtccttaacccgtttacgacctaaacttacgttcgttccttcgacggtcggtggggtacgacccggaccggaccggggtacccccgttaggggaaacccgtagggggttccttaggggtagggtacgggtagggtagggggaacgggttacgtaccgttacgtttacccgttaacgttcccgggttaaggggaaccttaaagggtaaaccggttaactacccgaaagtaacggtaaaccgttacccggaacggggtaaaacctaacgaaccgtaaccgtaacggttaaccccggaacggtaacccgtaaacgtacccgaacgggaaccg

SEQ ID NO: 301179 - DNA, 742 bp, Homo sapiens
  misc_feature: GZ8MTXP02JQI7J.15.85.H08.1.454.CMB.2.raw
tcagtctacgtagccacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcggggcatcacataacaaccacattcctcctctaaagaagccccctgggagcacagctcatcaccatggactggacctggaggttcctctttgtggtggcagcagctacgaggtcgtccagtcccaggtgcgagcgtggtgcgaggtcgtggggctggaggtaggaaggaacgccgtcggggtccgtcgggtggtaccggggtcctccgtggacgtacggtccttcgtcggaccgacgggtcctaacccgtttaggacctaaacttagttcgtcttttacgacggtccgttgggggtcgtaccggacgacccggggtaccccgtaggggaaccgtaaggggtccgttagggaaggttgggggtaaggtagggggtaggggtaacttccgaaacgtttcccgttaacggtttacccgggttagggggtaaaccgttaaagggttaaaaccgggttaactaacccggtaagtaaacggttaaacgggttacccggaaaggggtaaaccgtaaaacggtcctaaaacccgttaacgttaacccggggaccggaaacgtaaacctcccggaaacggtaaccg

SEQ ID NO: 301180 - DNA, 616 bp, Homo sapiens
  misc_feature: GZ8MTXP02FSCXM.15.85.H08.1.454.CMB.2.raw
  modified_base (251)..(251): a, c, t, g, unknown or other
  misc_feature (251)..(251): n is a, c, g, or t
tcagtctacgtagccacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcggggcatcacataacaaccacattcctcctactaaagaagcccctgggagcacagctcatcaccatggactggacctggagttctnttgtgtggcagcagctacaggtgccagtcccaggtgcagctggtgcagtcgtggggctggaggtagaagagtccgtggggtcctgggtgacggggtcctccgtgccgaaggtcctttcgcggcacgggtccttaaccgtttagactaaaacgttgttcgtctttcacggtcgtggggtcgaccgacgtacgggccccgtagggaccgaagggtcgttaggaggtgggagtggggaggtatcgtaattccgtagtaccggtggaacgtaaggtaagtactacgaaacgtacggtaacgttaccgaggaacgaaaccgttccgaaaccgaacgttaacccggacgggtaacaacgtcgaaacgaccg

SEQ ID NO: 301181 - DNA, 591 bp, Homo sapiens
  misc_feature: GZ8MTXP02FHLTB.15.85.H08.1.454.CMB.2.raw
tcagtctacgtagccacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcggggcatcacataacaaccacattcctcctctaaagaagcccctggagcacagctcatcaccatggactggacctggaggttcctctttgtggtggcagcagctacaggtgtccagtccccaggtgcagctggtgcagtcgtggggctggaggtgaagagccgtggggtcctcggtgacggggtctcctgcaaggcttctgcaggctaccgtttagctaactatgtctttcagtcgtgggtgcgacgacggccccctggacgaagggcttggaggtggagtggggagggatacgtattcctagttccgttaggggactagggtaaaggtactaccgaacacggtaaacgttacccgaacggggtaccaaaacggttcccaaccgtaacgttaacccggacggaaaccggaactacccgacgaaccg

SEQ ID NO: 301182 - DNA, 707 bp, Homo sapiens
  misc_feature: GZ8MTXP02FHJTJ.15.85.H08.1.454.CMB.2.raw
tcagtctacgtagccacgaccggtgctcgatttagtatcactcagccgcgggaggacgctgaccacacggtacgtgctgttgtactgctcctcccgcggctttgtcttggcattatgcacctccacgccgtccacgtaccagttgaacttgacctcagggtcttcggggcatcacataacaaccacattcctcctctaaagaagcccctgggagcacagctcatcaccatggactggacctggaggttcctctttgtggtggcagcagctacaggtgtccagtcccgaggtgcagctggtgcagtcgtggggctggaggtagaaggaacgccgtggggtcctcgggtaggaccgggtctccgtgacgtaagggtcctttcgtggaccgacgggtaccttacccgtttagacctaaacttatcgtaccgttttcgaggtcggttggggtcgaccgaccgtaccgggcccccgtagggaaccggtaagggggttcttagggagggttagggagggtacgggggtaaggggtacttacccgtacgtttaccccgttaacgttcccggttaggggaaccgttaaagggtaaaacgggtactacccgaaagtaaacgggtaaacggtttacccggaacgggtaacgaaacggttaccaaaccccgtaacgttaaccccggacggaacgtaaccgtacccggacggtaaaccg

SEQ ID NO: 301183 - DNA, 519 bp, Homo sapiens
  misc_feature: GZ8MTXP01CHIAB.39.31.C09.1.454.CMB.2.raw
  modified_base (292)..(292): a, c, t, g, unknown or other
  misc_feature (292)..(292): n is a, c, g, or t
  modified_base (505)..(505): a, c, t, g, unknown or other
  misc_feature (505)..(505): n is a, c, g, or t
  modified_base (515)..(515): a, c, t, g, unknown or other
  misc_feature (515)..(515): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaaacaataagaattactcgcttggtaccagcaagaaaccaggacagcctcctaagttgctcatttacngggcatcgtaccccgggagtccggggtccctgacccgattcagcggcagcggtcctgagacagatttcactctcaccatcagcagcctgcaggctgaagatgtggctagtttattactgtacagactagtaattatagtagtcctcagtacgttttcgggccggggtaccaagcgtaaggagatacaaacgaaactgttggcttagcaacctntctgttctcnctcc

SEQ ID NO: 301184 - DNA, 546 bp, Homo sapiens
  misc_feature: GZ8MTXP01C8H6Z.39.31.C09.1.454.CMB.2.raw
  modified_base (334)..(334): a, c, t, g, unknown or other
  misc_feature (334)..(334): n is a, c, g, or t
  modified_base (352)..(352): a, c, t, g, unknown or other
  misc_feature (352)..(352): n is a, c, g, or t
  modified_base (388)..(388): a, c, t, g, unknown or other
  misc_feature (388)..(388): n is a, c, g, or t
  modified_base (393)..(393): a, c, t, g, unknown or other
  misc_feature (393)..(393): n is a, c, g, or t
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacaggcccctggacaagggcttgagtggatggggatggatcagcacttanaataggaaacacaaagtntagcaacataaaatttccaagggcagagtcatcatnaccanagacacataccaacgagacactgacctacaatcgggaactaggaacggaacctgagatctagacgactacggtaccttatatttaattggttgcgaagacgtacttaaacttccttaccttaacattaacttaacgacgttagtcggaagttg

SEQ ID NO: 301185 - DNA, 505 bp, Homo sapiens
  misc_feature: GZ8MTXP01CJFUM.39.31.C09.1.454.CMB.2.raw
  modified_base (293)..(293): a, c, t, g, unknown or other
  misc_feature (293)..(293): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagcacgagtgtttacacaggtccaaacaataagaattacttcgcttggtaccagcaagaaaccaggacagcctcctaagttgctcatttacngggcatctacccgggagtccggggtccctgacccgattcagcgcagcgggtcctgagacagattcactctcaccatcagcagcctgcaggctgaagatgtggctagttatactgtcagcagttattatagtagtcctctagtactttgggccggggacaagctggagatacaaacgactgttaggcttgcacaatctgttcttcaattcccg

SEQ ID NO: 301186 - DNA, 560 bp, Homo sapiens
  misc_feature: GZ8MTXP01EB4OF.39.31.C09.1.454.CMB.2.raw
  modified_base (410)..(410): a, c, t, g, unknown or other
  misc_feature (410)..(410): n is a, c, g, or t
  modified_base (428)..(428): a, c, t, g, unknown or other
  misc_feature (428)..(428): n is a, c, g, or t
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagctgggtgcgacaggcccctggaccgaagggcttgagtggagtgggatggatcgagcacttacaataggaaaacacgaaaagtatagactaacataaaactttccaaggggcaagagtacaatcatacgaccaanagaacacataccaacgancactcgacctacataggaactgacggaactgagatcagacactacgtacttatattaatgttgacgttaggactaacaaaacttccttaccgttaacagttaattaaccggagttagtaacggttaaagttg

SEQ ID NO: 301187 - DNA, 559 bp, Homo sapiens
  misc_feature: GZ8MTXP01C5NPD.39.31.C09.1.454.CMB.2.raw
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacaggcccctggacaagggcttgagtggatgggatggatcagcactttacaataggaaacacgaaaagtatagacaacaattaaaactttcccgaaggggtacaaggaaggttccaattcaattcgaacccaacagacacatcccaacgagtcaactgaccctacatcggaaactggaacggaaacctgaagatctagacgactacggccttatattaatgttgcgagagacttaacttccttaccttaacattaacgttagacgatggaagttg

SEQ ID NO: 301188 - DNA, 514 bp, Homo sapiens
  misc_feature: GZ8MTXP01BRWYL.39.31.C09.1.454.CMB.2.raw
  modified_base (290)..(290): a, c, t, g, unknown or other
  misc_feature (290)..(290): n is a, c, g, or t
  modified_base (471)..(471): a, c, t, g, unknown or other
  misc_feature (471)..(471): n is a, c, g, or t
  modified_base (485)..(485): a, c, t, g, unknown or other
  misc_feature (485)..(485): n is a, c, g, or t
  modified_base (507)..(507): a, c, t, g, unknown or other
  misc_feature (507)..(507): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattactcgcttggtaccagcagaaaccaggacagcctcctaagtgctcatttacngggcatctacccggggagtccggggtccctgaccgattcagcggcagcgggtcctggagcagatttcactctcaccatcagcagccctgcaggctgaagatggtggctagtttattactgtcagctagttattatagttagtcctctagtacgtttgggcccgggggtaccaagcgtgganatacaaacgactgnggcttgctacaatctgttctcncttcccg

SEQ ID NO: 301189 - DNA, 564 bp, Homo sapiens
  misc_feature: GZ8MTXP01AOJ4P.39.31.C09.1.454.CMB.2.raw
  modified_base (294)..(294): a, c, t, g, unknown or other
  misc_feature (294)..(294): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccaacggggacatcgtgatgacccagtctccagactccctggctgtgtctctgggcgagagggccaccatcaactgcaagtccaaccagagtgttttatacagttaccaaacaaataaaaactacttagcttggcaccagcagaaaccaggacagcctctagagtgctcatttacngggcatcgtacccgggatcccgggggtccctgaccgattcagtggcagcggatcgtgggacagtatttcactctcaccatcagcagccctgcaggctagaagatggtgactagtttattactgtacaacctaatattaataactactctacagtactttcggccgtaggggaccaagcgtaagggaagaactaaccgaaaacgtaaacgttggttacggcttacggcctacccgtaattccgtcggttcctttcgttaaccgtttccccg

SEQ ID NO: 301190 - DNA, 545 bp, Homo sapiens
  misc_feature: GZ8MTXP01CCNO4.39.31.C09.1.454.CMB.2.raw
  modified_base (296)..(296): a, c, t, g, unknown or other
  misc_feature (296)..(296): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtaccaaacaaataagtaattacttcgcttggtaccagcaagaaaccaggacagcctacctaagtgctcatttacnggcatccgtacccgggagtcccgggtccctgacccgatcagcggcagcggtcctgagacagtatttcactctcacatcagcagcctgcaggctagaagagtagtggactagtttattacgtgtacagtacgtagttattaatagttacgtcctacgtagtacgtttcgggaccggggacacgcgtaaggagatacgaaacgtaacgtgttggcttcgtcacccaattctcgttcttccttaacttcccg

SEQ ID NO: 301191 - DNA, 548 bp, Homo sapiens
  misc_feature: GZ8MTXP01BC87H.39.31.C09.1.454.CMB.2.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaaacaataagaattacttcgcttggtaccagcagaaaccaggacagcctcctaagttgctcatttactgggcatctacccgggagtcccggggtccctgaccgattcagcgcagcgggtcctgagacagatttcactctcaccatcagcagcctgcaggctgaagatgtgctagttattactgtcagctagtattatagtagtcctcgtagtacgttttcgggccggggtaccaaggcgtaaggaagagtaccgaaacgtaaaccgtggttcgggcttcggaacctacccgtaattccgtgttccttccgttaacgtttccccg

SEQ ID NO: 301192 - DNA, 632 bp, Homo sapiens
  misc_feature: GZ8MTXP01D8GOV.39.31.C09.1.454.CMB.2.raw
  modified_base (461)..(461): a, c, t, g, unknown or other
  misc_feature (461)..(461): n is a, c, g, or t
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctctgcaaggcttctggttactacttttagctagttatggtgtcagcgtgggtgcgacgacggccccgtggacaagggcttggaggtggagtgggatggatcagcacttacaagtaggaaacaacgaaagtatagacactaattaaaactttccgaaggggacaaggaagtcaatacatacgaaccagaagaaccacactacccgaacggacgactaacctgacccctaaanacgtacggaacgtagggaaacggtaaccgtaggaacgtactacgtacggaaccgaccgtaccggttacctttaagttagtttaagttggttacggaacgaagtaaacgtaacttaaacgtttcccttaaccttaactattaacgtaacgacgttagttaacgttaacgttg

SEQ ID NO: 301193 - DNA, 604 bp, Homo sapiens
  misc_feature: GZ8MTXP01ATTVQ.39.31.C09.1.454.CMB.2.raw
  modified_base (343)..(343): a, c, t, g, unknown or other
  misc_feature (343)..(343): n is a, c, g, or t
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttcgtggttactacttttagctagttatggtgtcagcgtgggtgcgacgacggcccctggacgaagggtcttggagtggagtgggatggatcgagcacttanaagtaggaaacacaaagtatagacaactaattaaaacgtttccgaaggggtacaaggtacgtacatacagtacgaacccaacacggaaccacaactcccgaacgacgtaccaacgtcgacctaacagtaggaacgtgaacggaactagagactcgtacgaccgtaacgtacggtaccttaattacttgtgttagacgaagtacgtaacttaacttccttacttaactataacgtaacgagttaagtaaggttaaggtttcg

SEQ ID NO: 301194 - DNA, 545 bp, Homo sapiens
  misc_feature: GZ8MTXP01DR0TV.39.31.C09.1.454.CMB.2.raw
  modified_base (292)..(292): a, c, t, g, unknown or other
  misc_feature (292)..(292): n is a, c, g, or t
  modified_base (345)..(345): a, c, t, g, unknown or other
  misc_feature (345)..(345): n is a, c, g, or t
  modified_base (348)..(348): a, c, t, g, unknown or other
  misc_feature (348)..(348): n is a, c, g, or t
  modified_base (354)..(354): a, c, t, g, unknown or other
  misc_feature (354)..(354): n is a, c, g, or t
  modified_base (363)..(363): a, c, t, g, unknown or other
  misc_feature (363)..(363): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaaacaataagaattacttcgcttggtaccagcaagaaaccaggacagcctactaagtgctcatttacnggcatctacccgggagtccgggggtccctgaccgatcgagcggcaggcggtcnganacagtntttcactcncaccatcagcagccctgcaggctagaagatagtggactagtttattactgtacagactaagttattatagtagtcctgtagttacgtttgggaccggggtaccaagcgtaaggaagactaacgaaacgtaacgtggttacggcttgaaccacctaatcctgttccttcgttaacgtttcccg

SEQ ID NO: 301195 - DNA, 563 bp, Homo sapiens
  misc_feature: GZ8MTXP01CFGZF.39.31.C09.1.454.CMB.2.raw
  modified_base (229)..(229): a, c, t, g, unknown or other
  misc_feature (229)..(229): n is a, c, g, or t
  modified_base (297)..(297): a, c, t, g, unknown or other
  misc_feature (297)..(297): n is a, c, g, or t
  modified_base (458)..(458): a, c, t, g, unknown or other
  misc_feature (458)..(458): n is a, c, g, or t
  modified_base (507)..(507): a, c, t, g, unknown or other
  misc_feature (507)..(507): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtaccaaanaaataaagaattacttcgcttggaccagacaagaaaccaggacagcctactaagttgctcatttacgngggcatccgtacccggggagtcccgggggtccctaggacccgtattcgagcggcaggcgggtcctggagacagtatttcactctacaccatcagcacgcctcaggctagaagatgtagctaagtttactactgtcagcaggggtattagtgatagttccgngtacggttacgacgtaaaggaccgaaaggtgaaactacgaaaacgtacnggtacggcttacggccaacctaattcgtcgttcttcacttccccgttcccgtaacc

SEQ ID NO: 301196 - DNA, 572 bp, Homo sapiens
  misc_feature: GZ8MTXP01A7ZS2.39.31.C09.1.454.CMB.2.raw
  modified_base (404)..(404): a, c, t, g, unknown or other
  misc_feature (404)..(404): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagactccctggctgtgtctctgggcgagagggccaccatcaactgcaagtccagccagagttgttttacacaggtccaaacaataagaattacttcgcttggtaccagcagaaaccaggacagcctcctaagttgctcatttactgggcatcgtaccccggggagtcccgggggtcccctggaccgattcgagccggcaggcgggtcctggagacagtatttcactctcaccatcagcagccctgcaggctgaagngtgtgactagtttatactgtcagagtagttattagtagtacgtccgtacgtagttacggtttcggggaccggggtacgacggtcgtaaggacgaacgtaaccgaaacgtacgtggttcggcttacgaacctacctaacgttcgttcgttcttaaccgttaacttcccg

SEQ ID NO: 301197 - DNA, 589 bp, Homo sapiens
  misc_feature: GZ8MTXP01D50T0.39.31.C09.1.454.CMB.2.raw
  modified_base (404)..(404): a, c, t, g, unknown or other
  misc_feature (404)..(404): n is a, c, g, or t
  modified_base (428)..(428): a, c, t, g, unknown or other
  misc_feature (428)..(428): n is a, c, g, or t
  modified_base (436)..(436): a, c, t, g, unknown or other
  misc_feature (436)..(436): n is a, c, g, or t
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagcgtgggtgcgacacggcccctggacaagggcttgaggtggagtgggatggatcgagcaacttacaagtaggaaacacaaacgtatagacacaataaactttccgaagggtcagagtcatcatcgaccanagacacactacaacgacgcacgtnaccctaanagtacggaacgtaggaacggtaacctagaagtacgtcgacgaacgtacgtacgtacttaattagttaagttggttagacgaagtaacgtaaaccttaaacgtttcccttaacttaactaattaacgtaacggagttagttaacggttaagttg

SEQ ID NO: 301198 - DNA, 560 bp, Homo sapiens
  misc_feature: GZ8MTXP01CKVL1.39.31.C09.1.454.CMB.2.raw
  modified_base (532)..(532): a, c, t, g, unknown or other
  misc_feature (532)..(532): n is a, c, g, or t
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagcgtgggtgcgacaggcccctggacaagggcttgagtggatgggatggatcagcacgttacaatggaaacacaaagtatgcacataaactttccaagggcagagtcatcatcgaccaacagacaacactacccaacgacgacaacgtcgaccctaacagttcggaaacgttggaacggtaaacctggaagaatcgtagacgactacggtcttaagtattaagttgagtcgagtagaacttaaacttccttaccttaanataagttacgacgttatggttaagttcg

SEQ ID NO: 301199 - DNA, 658 bp, Homo sapiens
  misc_feature: GZ8MTXP01ECBM1.39.31.C09.1.454.CMB.2.raw
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcgagtgaacgtctcctgcaaggcttctggttacacttttagctagttatggtgtcagcgtgggtgcgacgacggcccctggacgaagggtcttggaggtggagtggggatggatcgagactaaacgttaaaagtacggaaaacaacgtaaagtatacgactaacgtaattaaacgtttacccgaagggtcaaggtacttacaatacaacgtacgaaaccacaacgaacaacaactaccgaacgacgtaccaactcgaccctaacaagttaacgggaaaccttaggggaaacggtaaccgtagaacgtactacgacggacgaaccgtacggtacctttaattagttgttgtcgacgtaaacgaacgtaacttaaactttcccgttcttaactaacgttaagttaaccgtaaggtagttaaggtaacggttcgtttaacg

SEQ ID NO: 301200 - DNA, 574 bp, Homo sapiens
  misc_feature: GZ8MTXP01DDRKE.39.31.C09.1.454.CMB.2.raw
  modified_base (300)..(300): a, c, t, g, unknown or other
  misc_feature (300)..(300): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagaggccaccatcaactgcaagtccagccagtagtgttttacacaggtaccaaacaaataagtaattacttcgcttaggtaccagcaagaaaccaggacagccctactaagtgctctatttacgnggcatccgtaccccgggagttcccggggtccctgacccgtatcgagcggcaggcggtctgagcagtactttccacttctcaacccatcagcacgcctgcaggctgaagatgtggacttagtttatactgtacagactaagttattaatacgttacgtcctagtacggttaacgtttcggggacccggggtaccaaggtcgtaagggacttacgtacgaaacggtaacgtggttacggcttacgaaccaaccttcttcgtcttctcttcgttccg

SEQ ID NO: 301201 - DNA, 583 bp, Homo sapiens
  misc_feature: GZ8MTXP01DSLT5.39.31.C09.1.454.CMB.2.raw
  modified_base (286)..(286): a, c, t, g, unknown or other
  misc_feature (286)..(286): n is a, c, g, or t
  modified_base (293)..(293): a, c, t, g, unknown or other
  misc_feature (293)..(293): n is a, c, g, or t
  modified_base (328)..(328): a, c, t, g, unknown or other
  misc_feature (328)..(328): n is a, c, g, or t
  modified_base (372)..(372): a, c, t, g, unknown or other
  misc_feature (372)..(372): n is a, c, g, or t
tcagtcgcactagtcacgaccggtgctcgatttagacgtctcatcaaggaaggaaggggcagcaagatggtgttgcagacccagatcttcatttctctgttgctctggatctctggtgcctacggggacatcgtgatgacccagtctccagactccctggctgtgtctctgggcgagagggccaccatcaactgcaagtccagccagagttgtttacacaggtccaaacaataagaattactcgcttggtaccagcaagaaaccaggacagcctacctaagtgctnatttacngggctatcctaccgggagtccggggtcctgaccgnttcagcggcagccggtctagagacagtacttcaactctcaaccntcagcagcctgcaggctagaagagtgtgctagttatactgtcagggctagttattatagtacgtcctacgtaacgttacgttttggggacccgggggaacctaaggtccgttagggagtaaacgttacgaaaaaccggtaaccgttggttcgggaccgttaacggaccgaacccgttagttccgttacgtttccgttaacgtttaaccccg

SEQ ID NO: 301202 - DNA, 627 bp, Homo sapiens
  misc_feature: GZ8MTXP01A3Y1G.39.31.C09.1.454.CMB.2.raw
  modified_base (292)..(292): a, c, t, g, unknown or other
  misc_feature (292)..(292): n is a, c, g, or t
  modified_base (332)..(332): a, c, t, g, unknown or other
  misc_feature (332)..(332): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccaacggggacatcgtgatgacccagtctccagactccctggctgtgtctctgggcgagagggccaccatcaactgcaagtccaaccagagtgttttatacagttaccaaacaaataaaactacttagcttggcaccagcagaaacaggacagcctctagagtgctcatttacngggcatccgtaccccgggaatcccgggggtccctgaccgnttcgagtgcagcggactcgtagggacagtactttcactctcaccatccagcagccctgctaggctagaagtagtggtgctagtttactactagtactaaccaatttaattaaacttaaactaccttacctacgtaacgttaccgttttagggacccgtaacgggggtaaccctaaaggtccgtaagggtaaacgttagtaaaccgaaaacccggtaaagttcggttacgggttccttacggaaccctaacccgtaacttccgttcgttacctttaaccgttaacgttttcccccg

SEQ ID NO: 301203 - DNA, 661 bp, Homo sapiens
  misc_feature: GZ8MTXP01DL59C.39.31.C09.1.454.CMB.2.raw
  modified_base (301)..(301): a, c, t, g, unknown or other
  misc_feature (301)..(301): n is a, c, g, or t
  modified_base (632)..(632): a, c, t, g, unknown or other
  misc_feature (632)..(632): n is a, c, g, or t
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagcgtgggtgcgacaggcccagtgganaagggcttggagtggagtgggatggatcagcattacaatggaaacacaaagtatagacaactaaacttaaatttcccgaaaggggtaccaaaggtacgtacgtaataccaagtaccgaaccaacaacgaacaaaccaactacccgaaaccggaagccctaaccggttacgaccctaaacgtacgtaacggggggaaactttaggggaaaccggtaaaccctaggaacgtacttaccgtaagggaaccgtaaaccgaccggtaacctttaattaaatttagttcggtacggacgtaaagacgttaaaaccttaactttaccctaaccttaanaactttaagtacgagtaagttaaggtaag

SEQ ID NO: 301204 - DNA, 621 bp, Homo sapiens
  misc_feature: GZ8MTXP01CUPZL.39.31.C09.1.454.CMB.2.raw
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagcgtgggtgcgacgacggccccgtggaccgaagggtcttggaggtggagtgggatggatcgagcaactttaacaaagtaggaaacaactaaaacgtatagacaactaattaaaactttcccgaagggtacaagacgtacatacatacgaacccacaacgacacactacccgaacgacgacactacgacctaacacgtacggaacgtaggaacggaacctagagtactcgtagaccgacgtacggtaccttagtaattaagttggttagacgttaagaacgtaacttaaacgtttcccttaccttaactagttaacgttaacgagttagtaagggttaacgtttaag

SEQ ID NO: 301205 - DNA, 665 bp, Homo sapiens
  misc_feature: GZ8MTXP01EV94U.39.31.C09.1.454.CMB.2.raw
  modified_base (343)..(343): a, c, t, g, unknown or other
  misc_feature (343)..(343): n is a, c, g, or t
  modified_base (417)..(417): a, c, t, g, unknown or other
  misc_feature (417)..(417): n is a, c, g, or t
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagtctgggtgcgacgacggccccgtggacgagggtcttaggagtggagtgggatggatcagctacttanaataggaaacactaaagtatagacaactataaactttccgaagggtacaagtacgtacatacagtacgaaccanacgaacacactaccgaacgacgtacactcgtacctatacgtacggaacgtaggtaaacggaaccgtggaacgtacgtcgtacggaaaccgtaccgtaaccggttacctttaagtttaacgtttaagttcggttaggaccggttaaagggtaaacgtaaaaccgttaaacctttcccttaaccctttaaactaaacgttttaacgttaaaccggtacggttaacgttaacgggttaaaacgtttttcgg

SEQ ID NO: 301206 - DNA, 586 bp, Homo sapiens
  misc_feature: GZ8MTXP01DS32Z.39.31.C09.1.454.CMB.2.raw
  modified_base (290)..(290): a, c, t, g, unknown or other
  misc_feature (290)..(290): n is a, c, g, or t
  modified_base (353)..(353): a, c, t, g, unknown or other
  misc_feature (353)..(353): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagactccctggctgtgtctcgtgggcgaggacgggccaccatcaactgcaagtccagccagagtgttttacacggtacaacaataagtaattacttcgcttggtaccagcagaacaggacagcctctaagtgctctattacnggcagtcctacccggggacgtcccgggtcctgaccgtattcaggcgcgaggcgggtctagganacgagtatttccaacttctcaccatcacgcacgcctgcaggctaggaagtagtggtaggtacttaggtttacttactgtcagctaaggttacttagtagtacgtcctagacgtacggtttcggggccggggtaacacggtcgtgggtaacgacttaaccgaaaacggttacgttgggtacgcgttcggacctaacctattccttagtccttactaaccttccgttaacccccg

SEQ ID NO: 301207 - DNA, 687 bp, Homo sapiens
  misc_feature: GZ8MTXP01DUVGE.39.31.C09.1.454.CMB.2.raw
  modified_base (302)..(302): a, c, t, g, unknown or other
  misc_feature (302)..(302): n is a, c, g, or t
  modified_base (400)..(400): a, c, t, g, unknown or other
  misc_feature (400)..(400): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgaggagggcccaccatcaactgacaagtccagccagtagtgttttacacaggtaccaaacaaataagtaattacttcgcttaggtaccaacagaaaccaggacagcctacctaagttgctcatttacngggcagtccgtacccggggacgtccccgggggtccctgaccgtattcaggcgcaggcggtctgagacagtactttccaactctcacctataccaaacncgcctagcgacggcttaggaaatagttggtacggtacgttaaggttttactttacgtcgtaaccaggtaaccgttaagtttaagtttaagttaacggtttaacgtttacccgttacgtaaacggttcccggtttttacgggggaaccccggggggtacctaaacgggtccggttagggaacggtaaacttaaccgaaaacggtaaaccgttggtacgggtcttacgggccttaacccttaattaccgttcggttcctacttacctttcccgttaaccccgttaaccc

SEQ ID NO: 301208 - DNA, 560 bp, Homo sapiens
  misc_feature: GZ8MTXP01AYLXH.39.31.C09.1.454.CMB.2.raw
  modified_base (300)..(300): a, c, t, g, unknown or other
  misc_feature (300)..(300): n is a, c, g, or t
  modified_base (539)..(539): a, c, t, g, unknown or other
  misc_feature (539)..(539): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgaggagggccaccatcaactgacaagtccagccagtagttgtttacacaggtaccaaacaataagaattactcgcttggaccagcaagaaaccaggacacgcctacctaagtgctactatttacgnggcactccgtaccccgggtaggtcccgggtccctgacccgtattcgaggccgcgaggcggtctgagacagtattcactctcacatcagcacgcctgacgaggctagaagtagtggtgtacttagtttactacgtgtacagacgtaagttattaataggtacgtcctagtacgttacggtttcgggaccggggtacagtcggtaagaagataacgaaagtatgttggcttgaacctactnttctcgttctcttcttccccg

SEQ ID NO: 301209 - DNA, 630 bp, Homo sapiens
  misc_feature: GZ8MTXP01BG1YS.39.31.C09.1.454.CMB.2.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtaccaaacaataagaattacttcgcttggaccagcaagaaaccaggacacgcctacctaaagttgctctatttactgggcatccgtaccccggggacgttcccggggtccctggacccgtattcgaggccggcgacggtcggggtccctggagacgagtatttaccactctcaacccatacaagcaacgcctgcgaggctagaaagtagttggtgtacgttagtttattacgtgtacacgtagtagttaatttatagttacgtccttacgtagttaccggttttggggaaccccgggggtaactaacggcgttaagggaaagttacgtaaccgttaaaacggtaactgggttacgttcgttacgaacgtaccctaagttcctacggttaccttcgttaactttccccg

SEQ ID NO: 301210 - DNA, 699 bp, Homo sapiens
  misc_feature: GZ8MTXP01BOF04.39.31.C09.1.454.CMB.2.raw
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttctggttactattttagctagttatggtgtcagtcgtgggtgcgacgacggcccccgtggaccgaagggtcttggaggttggagttggggatagggatcgagtcctaacttaacaaagtacggaaaacaacgaaaaggtatagacctaactaattaaaacgttcccgaaggggacaaggtagtcatacatacgaacccagaagacaacactacccaacgacgaccacgtacgacctaagagttacgggaaacgtacggaacgggtaaaccctggaacgtactaccggtacggaacccgaaccgtacccgggttacctttaaacgttagtttaacgttggttacggaccgttaagtaaacggttaaaccttaaaaccgttttccccgttaacctttaaactaactttaaacgttaaccccggaacggttaaggttaaccgggttaaacgtttaacgg

SEQ ID NO: 301211 - DNA, 713 bp, Homo sapiens
  misc_feature: GZ8MTXP01BSH2B.39.31.C09.1.454.CMB.2.raw
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagcgtgggtgcgacgacggcccctggaccgaagggtcttggagtggagtggggatggatcgaagtactaaacgtttaaaagtacggaaaacaacgtaaaagtatacgacaactaattaaactttacccgaagggtcaagtaacgtcatcaagtacgaaccacagacacaactacccgaacgacgacaacgtcgacccttaacgaacgttaacgggaaaccgtacgggggaaacgggtaacccgttaggaacggtaacttaccggtacggaaaccggtaacccgtaaccgggttaccctttaaacttaacgtttaagttaacgggttaacggaccggtaaaggttaaacgtaaaccgttaaactttccccgttaacctttaactaacgtttaacgttaaccggaaccgtaaggttacgggtaaagtttcggttttaaccg

SEQ ID NO: 301212 - DNA, 706 bp, Homo sapiens
  misc_feature: GZ8MTXP01DW39T.39.31.C09.1.454.CMB.2.raw
tcagtcgcactagtcacgaccggtgctcgatttagacgtctcatcaaggaaggaaggggacccaaaaaccacacccctccttgggagaatcccctagatcacagctcctcaccatggactggacctggagcattccttttcttggtggcagcagcaacaggtgcccactcccaggttcaattggtgcagtctggagctgcggtgaaggaggccgtggggcctcagtgaacgtctcctgcaaggcttcgtggttactacttttagctagttatggtgtcagcgtgggtgcgacgacggccccgtggaccgaagggtcttggaggtggagtggggatggatcgagctaacttaacaagtaggaaacaacgtaaaagtatagactaactaattaaaacgttccgaaggggacaaggtacgttacaacttacaagtacgaacccaacaacgaaccaactaacgtacccgaaacgacgacctacctacgacccttaacgagtacggaaacgtacggaaacgggtaaacctaggaacgtagtccgtaacggaacccgaaccgtacccgggttaacctttaagttaacgtttaagttaggttacggtaaccggaaaggtaaacgtaaccttaaaaccgtttccccttaacccttaaactaacgtttaaacgtttaacccggaacggttaagttaacgggttaacgttttccgg

SEQ ID NO: 301213 - DNA, 557 bp, Homo sapiens
  misc_feature: GZ8MTXP01BYNYR.39.31.C09.1.454.CMB.2.raw
  modified_base (290)..(290): a, c, t, g, unknown or other
  misc_feature (290)..(290): n is a, c, g, or t
  modified_base (399)..(399): a, c, t, g, unknown or other
  misc_feature (399)..(399): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgtttacacaggtccaaacaataagaattacttcgcttggtaccagcagaaaccagacagcctctaagtgctcatttacnggcatccgtacccgggagtcccggggtccctgaccgtattcgacgcggcgaggcggtcctgacgacagtatttcactctacaccatcagcacgcctgcaggctagaagntgtgctagtttatactgtacagcgtagttattaatagtacgtcctgtagtacggtttcgggacccgggggtacaacggcgtaaggaagactaacgaaacgtaacgtggttacggcttacgaactacctaactctacgttccttcttaacgtttccccg

SEQ ID NO: 301214 - DNA, 675 bp, Homo sapiens
  misc_feature: GZ8MTXP01EYFF9.39.31.C09.1.454.CMB.2.raw
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagcgtgggtgcgacgacggccccgtggacgaaggtcttggagtggagtgggatggatcgagctaacgttacgaagtacggaaaacaacgtaaaagtatagactaactaatttaaaacgtttacccgaaggggtaccaaagggtacgtactaatacagtacgaacccaagaacgaaccacactaccgaacgacgacctacgtacgaccctaacgagtacgaaacggtaggaaacgggtaacctaggaacgtacgtcgtaacggaaccgaaccgtaccggttacctttaagttaagtttaagtttcggttacggacggttaaacgtaaacgtaaaccttaaaccgtttcccttaccttaaacgtatttaacgtaacgtacgttaagtaaggttaaacgtttcg

SEQ ID NO: 301215 - DNA, 572 bp, Homo sapiens
  misc_feature: GZ8MTXP01A2TAW.39.31.C09.1.454.CMB.2.raw
  modified_base (304)..(304): a, c, t, g, unknown or other
  misc_feature (304)..(304): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgaccccagtctccagactccctggctgtgtctctgggcgagagggccaccatcaactgcaagtccagccagagttgttttacacaggtaccaaacaataagaattacttcgcttggtaccagcaagaaacccaggacacgccctacctaagttcgctctatttacgngggcatccgtacccggggagtcccgggggtccctggacccattcagcggcaggcgggtctggagacagtatttcacctctcaccatcagcagcctgcaggctagagatgtggactagtttattacgtgacagcgtaagttattatacggttacgtccttcgaagtttccgtttcgggggcccgggggaacctaaggctaagggagttaactacaaacgactggttaggccttgaaccacaacttctcgttaccttcgaactttccccg

SEQ ID NO: 301216 - DNA, 653 bp, Homo sapiens
  misc_feature: GZ8MTXP01AXUVJ.39.31.C09.1.454.CMB.2.raw
  modified_base (518)..(518): a, c, t, g, unknown or other
  misc_feature (518)..(518): n is a, c, g, or t
  modified_base (522)..(522): a, c, t, g, unknown or other
  misc_feature (522)..(522): n is a, c, g, or t
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttctggttactacttttagctagttatggtgtcagcgtgggtgcgacgacggccctggacgagggtcttggagtggagtggggatggatcgagtactaacttaacgaaagtacggaaaacaacgtaaaagttatagactaaactaacgtttaaaactttcccgaaggggtctaaaggacgttaccaattacaagtacgaaccaacaacgaacaacactacccgaacgacgaccacctacgaccctaagaacgtacggaacgtaggaacggtaaccngganacgtcgtaggaaccgaccgtaccggtacctttaattacgttaagttggacgtacggaagtaaacgtaacttaaaccgtttcccttaccttaactattaacgttaacggacgttagttaaggttaacgtttg

SEQ ID NO: 301217 - DNA, 536 bp, Homo sapiens
  misc_feature: GZ8MTXP01DQUSG.39.31.C09.1.454.CMB.2.raw
  modified_base (351)..(351): a, c, t, g, unknown or other
  misc_feature (351)..(351): n is a, c, g, or t
  modified_base (393)..(393): a, c, t, g, unknown or other
  misc_feature (393)..(393): n is a, c, g, or t
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacaggcccctggacaagggcttggagtggatgggatggatcagcacttacaatggaaacacaaagtntagcacataaactttccgaagggcagagtcatcatcgaccanagacacatccacgagacactgacctacatcggaactggacggaacctggacgatcgtgaaccgctacggtccttaatacttaagttgttgcgttaagagtaacttaaacgttccttactaacataatacgacgatggaagttg

SEQ ID NO: 301218 - DNA, 619 bp, Homo sapiens
  misc_feature: GZ8MTXP01EM7Y3.39.31.C09.1.454.CMB.2.raw
  modified_base (310)..(310): a, c, t, g, unknown or other
  misc_feature (310)..(310): n is a, c, g, or t
  modified_base (404)..(404): a, c, t, g, unknown or other
  misc_feature (404)..(404): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgaggacgggccaccatcaactgcaagtccagccagtagttgttttaacacaggtaccaaacaaataagtaattacttcgcttaggtaccagacaagaaaccaggacacgccctactaagttcgctctatttacgngggcatccgtacccgggacggtcccgggggtcctcgacccgtattccgagcgcgaggcgggtcctggacgacagtactttaccactcctcaccntcagcacgcctgcgaggcgtagaagtagttggtacgtacttagtttattacgtgtacgtagtacgtagttaatttaagtacgttagttccgtacgtaacgttacggttttcggggaccggggtaccgtaacggcgtaagggaacgaataaccgaaacgtacgtcggttacggcacgaacctacctaacttctcgttaccttcgttaaccttcccg

SEQ ID NO: 301219 - DNA, 607 bp, Homo sapiens
  misc_feature: GZ8MTXP01DSAQ4.39.31.C09.1.454.CMB.2.raw
  modified_base (196)..(196): a, c, t, g, unknown or other
  misc_feature (196)..(196): n is a, c, g, or t
  modified_base (399)..(399): a, c, t, g, unknown or other
  misc_feature (399)..(399): n is a, c, g, or t
  modified_base (430)..(430): a, c, t, g, unknown or other
  misc_feature (430)..(430): n is a, c, g, or t
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactcccaggttcaattggtgcagtctggganctgcggtgaagaggcctggggcctcagtgaacgtctcctgcaaggcttctggttacacttttagctagttatggtgtcagctgggtgcgacaggcccctggacaagggcttgagtggatgggatggatcagcacgttacaatggaaacacaaaacgtatagcaactataaaactttccaaggggcagagtacatcatgaccanagacacatccaacgagacactgaccctaaanacgtagaacgtaggaacggaaccgtagagtactacgtacggaaccgaaccgtaccggttaccttaagttaagttaagttacgttacggtacgaacggtaaacgtaaccttaaacgttccttaccgttaacttaacgttaacgttaacggacgttacgttaagggttaacggttaacg

SEQ ID NO: 301220 - DNA, 714 bp, Homo sapiens
  misc_feature: GZ8MTXP01CEP7D.39.31.C09.1.454.CMB.2.raw
  modified_base (222)..(222): a, c, t, g, unknown or other
  misc_feature (222)..(222): n is a, c, g, or t
tcagtcgcactagtcacgaccggtgctcgatttagacgtctcatcaaggaaggaaggggacccaaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctnagtgaacgtctctgcaaggtcttcgtggttactacttttagctagttagtggtgtcagcgtgggtgacgacgacggccccgtaggacgaagggtcttaggagtggagtggggatgggatacgaggtacaacgtttaacgaaagttacggaaaactacgtaaaaggttataggaactaaactatttaaaaacgtttcccggaaggggtacctaaaggtacgtacaagtaccgtaagaccgaacccaagaacggaaccaacgaactacccgaacggtacactacaccgtacctaacgacgtaacgggaactgggaaacggtaccgtaggtaacgtagtaccggtaacgaaccgtacgtaaccggtttacctttaacgttaagtttaacgttggttcggaaccggttaaagtaaacgtaaccttaaactttccccgttaacccttaagaagtttaaccgttaacggacgttacgttaagggttaacttttaaccg

SEQ ID NO: 301221 - DNA, 692 bp, Homo sapiens
  misc_feature: GZ8MTXP01A5E1C.39.31.C09.1.454.CMB.2.raw
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctctgcaaggcttctggttactacttttagctagttatggtgtcagtcgtgggtgcgacgacggccccgtaggaccgaagggtcttggaggtggagtgggatggatcgagctaacttacaaagtacggaaaacaacgaaaagtatagactaactaattaaaacgtttacccgaagggtaccaaaggtacgttaccaattaccaagtaccgaaccaacgaacggaaccacctaacacccaaacggacgaccaccgtacgaccttaaccgaagttacggaacgtacggaacggaacctaggaagtacgttcgacggaaccgacctaaccgggtacctttaattaagtttaagttcgggttacgacggttaaacgaaacggttaaacttaaaaccgttttcccttaacctttaaactaactttaacgttaaccggaacggttacgttaaggttaacgttttaacg

SEQ ID NO: 301222 - DNA, 624 bp, Homo sapiens
  misc_feature: GZ8MTXP01AJS8A.39.31.C09.1.454.CMB.2.raw
  modified_base (475)..(475): a, c, t, g, unknown or other
  misc_feature (475)..(475): n is a, c, g, or t
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttcgtggttactacttttagctagttatggtgtcagtcgtgggtgcgacgacggccccgtaggacgaagggtcttaggaggtggagtgggagtggatcgagtctaactttaacaagtaggaaaactaacgaaaagtatagacaacgtaattaaaacgtttccgaagggtacaagggtactcaatcaatacgaaccacgaacgacacacaccgaacgacgacacgtcgacctaanacgtaggaacgtaggaacggtaaccgtaggaagtacgtcgaggtaaccacgtaccgttacttaagttattaagtcgttagacgagtaactaacttaacgttccttaactaacgtaattaacgaacgtagttagtaacggttaagtttcg

SEQ ID NO: 301223 - DNA, 538 bp, Homo sapiens
  misc_feature: GZ8MTXP01CXF6U.39.31.C09.1.454.CMB.2.raw
  modified_base (429)..(429): a, c, t, g, unknown or other
  misc_feature (429)..(429): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagaggccaccatcaactgcaagtccagccagagtgttttacacaggtccaacaataagaattacttcgcttggtaccaacagaaaccaggacagcctcctaagttgctcatttactggcatctacccgggagtccgggtccctgaccgattcagcggcagcgggtctgagacagatttcaactctcaccatcaacagcctgcaggctgaagatgtggactagtttatactgtcagctagtattatagtatcctnagtacgttttggaccgggggacctaaggcgtcggaagtaagtacaaaacggtaacgttggtacggcttcggcttaccaatctcgttaccttcacgttccttccccgtcc

SEQ ID NO: 301224 - DNA, 704 bp, Homo sapiens
  misc_feature: GZ8MTXP01AHVHT.39.31.C09.1.454.CMB.2.raw
  modified_base (210)..(210): a, c, t, g, unknown or other
  misc_feature (210)..(210): n is a, c, g, or t
  modified_base (224)..(224): a, c, t, g, unknown or other
  misc_feature (224)..(224): n is a, c, g, or t
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtcgcccactcccaggttcaattggtgcagtctgaagctggcggtagaagnggccgtggggcctnagtgaacgtctcctgcaaggtcttcgtggttactacttttagctagttagtggtgtcagtcgtgggtgcgacgcgggtcccctaggacgaagggtcttggagtggagtggggagtggactcgaagtcctaacgttaacaaagtacggaaaactaacgtaaagtatacgacaaacgtaattaaaacgttccgaagggtcaaaggtagttacaattacaagtaccgaaacccaacgaacgaacccaacgacctaacccgaccggaatccctacgtacgaccctaagtacgtacgggaaacgtaggaaacggtaaccgtaggaacgtctacggtacggaaaccgaccgtaccggttacttttaagttaacgttgttacggacgggacgaaacggttaaacgtaaaccttacccttttacccgttaacctttaactaaaggtttaaccgtaacccgaaggttaggtaacggttaacgtttaacg

SEQ ID NO: 301225 - DNA, 724 bp, Homo sapiens
  misc_feature: GZ8MTXP01AHDP1.39.31.C09.1.454.CMB.2.raw
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtcgcccactccccaggttcaattggtgcagtctggagctggcggtgaagaggccgtggggcctcagtgacgtctcctgcaaggtcttcgtaggttactacttttagctagttagtggtgtcgagtgtgggtcgcgacgacggccccgtaggacgaagggtctggaggtggagtgggataggatacgagactaacgttaacaagtacggaaaacaactaaacgtatagactaactaattaaacgttaccggaaggacgaagtacgtacaatacaacgtaccgaaccaacgacgaaccgaactacctacccgaaacgacgacctaaccgacgtaacccctaagacgttaaacggaacgggttaggaaaccgggtaacaggtaacgtcttaccgaggtaaacccggaacgtacccggttaactttaaattcggtttaagtgggttacggaaaccgttaaagggtaaacccgtaaactttaaaaccgtttccccgttaaaccttaaaccgtaatttaacccggggttaaacccgtaagttaggggttaaccgttaaagggtttttccg

SEQ ID NO: 301226 - DNA, 701 bp, Homo sapiens
  misc_feature: GZ8MTXP01AS0NN.39.31.C09.1.454.CMB.2.raw
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactcccaggttcaattggtgcagtctgggagctggcggtgaagaggccgtggggcctgagtgaacgtctctgcaaggcttctggttactattttagctagttatggtgtcagcgtgggtgcgacgacggccccgtggaccgaagggtcttggagtggagtgggagtggactcgagactaaacgtttaaaagacggaaaacaacgtaaagtacgtagactaacgtaattaacgtttaaccgaagggcaaggtaacgtacacgtacaacgtacgaaacccacgacgaacaacgtacaccgaacgacgacaccgtacgacctaacacgtaacgtaacgtaggggaaacggtaaccgttaggaacgtaacgttccgaacggaaccggtaccgtaaccggttacctttaaagttaacgtttaggttaaggttacggaccggtaaagttaaaccggtaaaccttaaaccgtttcccgttaaccttaacgtaacttaacgtttaacggaacgtaggttaaccggtaagtttaacggtttaacg

SEQ ID NO: 301227 - DNA, 632 bp, Homo sapiens
  misc_feature: GZ8MTXP01C8P3J.39.31.C09.1.454.CMB.2.raw
  modified_base (298)..(298): a, c, t, g, unknown or other
  misc_feature (298)..(298): n is a, c, g, or t
  modified_base (465)..(465): a, c, t, g, unknown or other
  misc_feature (465)..(465): n is a, c, g, or t
  modified_base (475)..(475): a, c, t, g, unknown or other
  misc_feature (475)..(475): n is a, c, g, or t
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactcccaggttcaattggtgcagtctggagctgcgggtgaaggacggccgtggggcctcagtgaacgtctccgtgacgaaggcttcgtggttaactacgtttttagctagttagtcggtgtcagtcgtgggtncggacaggcccccgtaggaccgaagggcttggagtggagtggggatggatcgagcaaacgttaaaatacggaaaacaactaaaggtataggactaactaacgttaaactttacccggaaaggggtcaaggtaagttacaagtacaatacgacccaacagaactacancccgaagganacctacgcacctacgtacacggaacttaggggaacgggtaaccttagaaccgattccgtagaaaccggactccggtaactttaatatttagtgtcggagtacggaagtactaacttcttcttaacgtaagtataaccgagtagagtcgttcgtttaa

SEQ ID NO: 301228 - DNA, 698 bp, Homo sapiens
  misc_feature: GZ8MTXP01AH1CV.39.31.C09.1.454.CMB.2.raw
  modified_base (221)..(221): a, c, t, g, unknown or other
  misc_feature (221)..(221): n is a, c, g, or t
  modified_base (243)..(243): a, c, t, g, unknown or other
  misc_feature (243)..(243): n is a, c, g, or t
  modified_base (272)..(272): a, c, t, g, unknown or other
  misc_feature (272)..(272): n is a, c, g, or t
  modified_base (372)..(372): a, c, t, g, unknown or other
  misc_feature (372)..(372): n is a, c, g, or t
  modified_base (430)..(430): a, c, t, g, unknown or other
  misc_feature (430)..(430): n is a, c, g, or t
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctnagtgaacgtctctgcagtcttntggttactactttagctagttatggtgtnagtcgtgggtcgcgacgacggccccgtaggacgaagggtcgttaggaggtggagtggggatggatcagctaacgtaagaataggaaacaacgtaaagtanacgacaactattaaacgttccgaagggtacagggtagtacatacgatacgaacccaanacgaaccacaacctaccaacggacactactcggacctaacgagtacggaacgtaggaacggtaacctaggtaagtacgtacgtaccggaaccgtaccgtaccggttaacctttaagttacgttaagttcggaacggtacggttaaaggtaaaccggttaaactttaaacccgtttaccccgttaacccttttaaacgtaaacgtttaaacccggttaaacccgggtaacggttaacgggtttaaacgggttaacggtttttaaacggg

SEQ ID NO: 301229 - DNA, 695 bp, Homo sapiens
  misc_feature: GZ8MTXP01B6Q27.39.31.C09.1.454.CMB.2.raw
  modified_base (212)..(212): a, c, t, g, unknown or other
  misc_feature (212)..(212): n is a, c, g, or t
  modified_base (309)..(309): a, c, t, g, unknown or other
  misc_feature (309)..(309): n is a, c, g, or t
  modified_base (373)..(373): a, c, t, g, unknown or other
  misc_feature (373)..(373): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtggcgagacggccacatcaactgcaagtccagccagtagttntttaacacaggtaccaaacaataagtaactttacttcgtcgttacggtaccaagacaacgaaaccgaggacacgcctactaagttgctctatttcgnggctacgttccgtaccccggggacggttccccggggtcccctaggacccgtagttcgagccggnacggcggtctaggacgatacgtactttaccgactcctacacccatccgacgcgtaacgtccctgacgacggtactaggaaagttgtacgggttacgtactttaacggttttactacgtgtacgacgtacggttagtttaactttaagtaccgtttcgttaccctaacggtacggtttaaccgggtttaccgggggacccgggtaaactaccggtggtaacggtaaacttagttaaacccgaaacgtaccggtttgcccgggttaacttccgtaactaacgttaactttccggtcgttaccttccccttaagtttccccccgg

SEQ ID NO: 301230 - DNA, 712 bp, Homo sapiens
  misc_feature: GZ8MTXP01AL9ZY.39.31.C09.1.454.CMB.2.raw
  modified_base (380)..(380): a, c, t, g, unknown or other
  misc_feature (380)..(380): n is a, c, g, or t
  modified_base (402)..(402): a, c, t, g, unknown or other
  misc_feature (402)..(402): n is a, c, g, or t
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcgagtgaacgtctcctgcaaggcttctggttactacttttagctagttagtggtgtcgagtcgtgggtgacgtacgacggccccgtaggacgaagggtcttggagtggagtggggataggatacgagctaacttacgaagtaggaaacaacgtaaagtangactaactattaaacgttccgnggtacagagtcatacatacgacacagacacacacctttacgacgtacactacgacctaacgtaacgtacggtaacgggtacggtaacggtaaaccgtacggaacgtaacgtacgtaccggaaaccggtaacccggtaaccgggttaacccgtttaacttaacgtttaacgtttaggttacgggtaacccggttaaggtaaacggtaaaccgttaaacccgtttaacccgtttaacccgttaaaccgttaaacttaaacgtttaaaccggtaacccggttaacggttaacgggttaagggttttaacccgg

SEQ ID NO: 301231 - DNA, 688 bp, Homo sapiens
  misc_feature: GZ8MTXP01DLDLF.39.31.C09.1.454.CMB.2.raw
  modified_base (448)..(448): a, c, t, g, unknown or other
  misc_feature (448)..(448): n is a, c, g, or t
tcagtcgcactagtcacgaccggtgctcgatttagacgtctcatcaaggaaggaaggggacccaaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggtcttcgtggttactacttttagctagttatggtgtcagtcgtgggtgcgacgacggccccgtggacgaagggtcttaggaggtggagtggggatggatcagctaacttaacaagtacggaaaacaacgtaaaagtatacgactaaactaattaaaacgtttaccggaagggtacaaaggtacgtactagtacagtacgaacccaanaacgaacacaactaccgaaacgacgacaccgtacgtacctaacgaacgtacgggaaacggttacggaaacggtaaacccgtaggaacgtaacctcgtaacggaaaccggtaccgtaaccgggttaccttaaattatttaagttggttacggtaacggaagtaaacgtaacttaaaaccgtttcccttaacttaactaaagttaacgttaacggtacgttacgttaaggttaaagttttcg

SEQ ID NO: 301232 - DNA, 709 bp, Homo sapiens
  misc_feature: GZ8MTXP01A1FUN.39.31.C09.1.454.CMB.2.raw
  modified_base (356)..(356): a, c, t, g, unknown or other
  misc_feature (356)..(356): n is a, c, g, or t
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagctgggtgcgacaggcccctggacaagggcttgagtggagtgggatggatcgagcacttacaagtaggaaacacgaaagtntagacaactaattaaaacgtttcccgaaggggcaagggtaagtaccaatcgaatcggaacccaacgaacgaaccacaactacccaacggacgaccaaccgtacgacccttaacgaacgttacgggaaacgttacgggaaacggtaaacccttagggaaacggtacttaccggttacggaaacccggtaaccgtaacccgggttaccctttaaagttaagtttaaagttcggttacggacggttaaacggtaaacggttaaaccttaaaaccgtttcccctttaacccgtttaactaacgtttaaccgtttaaccgggtaaccggttaaggttaacggggttaaacggtttcgg

SEQ ID NO: 301233 - DNA, 572 bp, Homo sapiens
  misc_feature: GZ8MTXP01CZJ21.39.31.C09.1.454.CMB.2.raw
  modified_base (243)..(243): a, c, t, g, unknown or other
  misc_feature (243)..(243): n is a, c, g, or t
  modified_base (325)..(325): a, c, t, g, unknown or other
  misc_feature (325)..(325): n is a, c, g, or t
  modified_base (355)..(355): a, c, t, g, unknown or other
  misc_feature (355)..(355): n is a, c, g, or t
  modified_base (423)..(423): a, c, t, g, unknown or other
  misc_feature (423)..(423): n is a, c, g, or t
  modified_base (485)..(485): a, c, t, g, unknown or other
  misc_feature (485)..(485): n is a, c, g, or t
  modified_base (507)..(507): a, c, t, g, unknown or other
  misc_feature (507)..(507): n is a, c, g, or t
  modified_base (539)..(539): a, c, t, g, unknown or other
  misc_feature (539)..(539): n is a, c, g, or t
tcagtcgcactagtcacgaccggtgctcgatttagacgtctcatcaaggaaggaaggggacccaaaaaaccacacccctccttgggagaatcccctagatcacagctcctcaccatggactggacctggagcatccttttcttggtggcagcagcaacaggtgccactcccaggttcaattggtgcagtctggagctgcggtgaagaggcctggggcctcagtgaacgtctctgcaaggcttntggttacacttttagctagttatcggtgtcagtcgtgggtgcgacgacggcccctggacagggcttgaggtgagtgggatgntcagctattacaagtagaaacactaaagtntagcaatataaaacgtttcccgaaggggtacagggactaccaactactacgacccacaagaccactanaccacgaacgcacgtcgacctacagtacgacgtagggaacggtaaccgtgacgagtccgtanaccgtacgcgtacttagtattntgtgacgtagttacgactaacttcttcttatnttacgttaacgagtattggtaattcggtttaac

SEQ ID NO: 301234 - DNA, 799 bp, Homo sapiens
  misc_feature: GZ8MTXP01BKR6Y.39.31.C09.1.454.CMB.2.raw
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagtcgtgggtgcgacgacggccccgtggacgtaagggcttggagtggagtggggatggatcgagactaacttaacgaaagtaggaaaacaacgtaaaagtatagacaactaattaaaacgtttaccgaaggggtaccaaggtaacgtacaacgttacgaattaaccggacccaaacgaacggaaccaaactaaccgttaacccgaaaccggaacgtaccctaacgtacggtacccttaacgaaacgttaaccgggaaacggtaacggtaaaccggggtaaaccctagggtaaacgtaaccgtaccggttaacggaaacccggtaaccgtaaccggggttaacccttttaaacgtttaacgtttaacggttttgggttaacggaaccgggttaaacggtaaaaccggttaaaacccgtttaaaaaccgttttcccctttaaaccccggttttaaactaaacggtttaaaccgttttaaaccggggtaaacccgttaacggtttaacgggttaaagggttttaaccg

SEQ ID NO: 301235 - DNA, 513 bp, Homo sapiens
  misc_feature: GZ8MTXP01BHO3K.39.31.C09.1.454.CMB.2.raw
  modified_base (274)..(274): a, c, t, g, unknown or other
  misc_feature (274)..(274): n is a, c, g, or t
  modified_base (291)..(291): a, c, t, g, unknown or other
  misc_feature (291)..(291): n is a, c, g, or t
  modified_base (409)..(409): a, c, t, g, unknown or other
  misc_feature (409)..(409): n is a, c, g, or t
  modified_base (475)..(475): a, c, t, g, unknown or other
  misc_feature (475)..(475): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaaacaataagaattacttcgcttggtaccaacagaaaccaggacagccnctaagttgctcatttanggcatctacccgggagtccgggtccctgaccatttcagcgcagcgggtctggagacagatttcaactctcaccatcaaccagcctgcaggctagaagatgtggctagtttattacgtntcagcagtattatagtatctcagtctttgggaccgggggtaccagctggagaataccgaaagtacngtggcttgccacaatctgttctcttagtccttccgtcc

SEQ ID NO: 301236 - DNA, 666 bp, Homo sapiens
  misc_feature: GZ8MTXP01AX99L.39.31.C09.1.454.CMB.2.raw
  modified_base (301)..(301): a, c, t, g, unknown or other
  misc_feature (301)..(301): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagactccctggctgtgtctcgtgggcgaggacggccaccatcaactgacaagtccagccagtagttgtttacacaggtaccaaataataaagtaatttactcgtcttaggtaccagcaagaacaggacagcctactaagtgctactattacgnggcactccgtaccggattccgtcgtaccctgaccgtgtcgacgcggcgaggtcccggtctagacgactaagtacctttcaactctaccacctatcgaacgcacgtccgcgacgaacggtcgtagaagtagtacgttcggaacgtttagtttaacttacgtacgttacgtacggggtacttaggttaaatttaacgttaacgttacccgttcgtaaccgttacggtttaaccggttttccgggggacccggggtaaccctaaagggtcgtaacgggttacgtaaaccgttacggtaaaaacggtacggttcggttcggttacgtcgtacctaaccgtcgtcgttacgtttccgtttaaccgtcccg

SEQ ID NO: 301237 - DNA, 614 bp, Homo sapiens
  misc_feature: GZ8MTXP01B63BD.39.31.C09.1.454.CMB.2.raw
  modified_base (256)..(256): a, c, t, g, unknown or other
  misc_feature (256)..(256): n is a, c, g, or t
  modified_base (299)..(299): a, c, t, g, unknown or other
  misc_feature (299)..(299): n is a, c, g, or t
  modified_base (321)..(321): a, c, t, g, unknown or other
  misc_feature (321)..(321): n is a, c, g, or t
  modified_base (336)..(336): a, c, t, g, unknown or other
  misc_feature (336)..(336): n is a, c, g, or t
  modified_base (371)..(371): a, c, t, g, unknown or other
  misc_feature (371)..(371): n is a, c, g, or t
  modified_base (403)..(403): a, c, t, g, unknown or other
  misc_feature (403)..(403): n is a, c, g, or t
  modified_base (411)..(411): a, c, t, g, unknown or other
  misc_feature (411)..(411): n is a, c, g, or t
  modified_base (589)..(589): a, c, t, g, unknown or other
  misc_feature (589)..(589): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgagaggccaccatcaactgcaagtccagccagtagttgtttacacaggtccaaacaataagtattactcgtcttggtaccngcaagaaaccaggacacgcctacgtaagtgctactatttacgngggacacgtcgtaccccggggnggttcccgggtcccnggacccagtcgaggcgcgaggtccggtctgacganagtacttcactcacaccatcagtcacgtcccngacgacgnagagtagtggtacgtattagtttactacgtagtacgtagtacggttaagtttagttaacgttacgttaccgttacccgtacggttacggtttaccgggttaccggggtaccggggtaactaggtccgtaaggaacgttacgtaacgaaacgtacgtcggttcgcttacgaacctactnttcgtcttactcccgttcgttcccg

SEQ ID NO: 301238 - DNA, 682 bp, Homo sapiens
  misc_feature: GZ8MTXP01C9F8S.39.31.C09.1.454.CMB.2.raw
  modified_base (290)..(290): a, c, t, g, unknown or other
  misc_feature (290)..(290): n is a, c, g, or t
  modified_base (326)..(326): a, c, t, g, unknown or other
  misc_feature (326)..(326): n is a, c, g, or t
  modified_base (374)..(374): a, c, t, g, unknown or other
  misc_feature (374)..(374): n is a, c, g, or t
tcagtcgcactagtcacgaccggtgctcgatttagacgtctcatcaaggaaggaaggggacccaaaaaccacacccctccttgggagaatcccctagatcacagctcctcaccatggactggacctggagcatccttttctggtggcagcagcaacaggtgcccactcccaggttcaattggtgcagtctggagctgcggtgaagaggcctggggcctcgagtgaacgtctcctgaccaaggtcttcgtggttaacacttttagctaagttagtggtgtcagcgtgggtnacgacacggccctggactaagggcttagagtaggangggatggatcgacgctaacttaacgaaataggaaacaacgtaaaagtntacgacaactaacttaaaactttccgaagggactacggtaaacgacaatacaagtacgaaaccaacgaacgaaacctaacgaactaaccgaaggaacacctaacgtcgtaaccgtaagaaacgtaacggaaacgtaacgggaaacggtaaacctaggtaaacgtacgtacgacggtaaaccgtacgtaaccggttacttaattaagttaataggttagaacggaaacgtaacgtaaacttaaaccgtttcccttaaaccttaaataaacgttaacgttaaacggagttaacgtaacgttaagttaacg

SEQ ID NO: 301239 - DNA, 510 bp, Homo sapiens
  misc_feature: GZ8MTXP02F1AFA.39.31.C09.1.454.CMB.2.raw
  modified_base (490)..(490): a, c, t, g, unknown or other
  misc_feature (490)..(490): n is a, c, g, or t
  modified_base (501)..(501): a, c, t, g, unknown or other
  misc_feature (501)..(501): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaaacaataagaattacttcgcttggtaccagcaagaaaccaggacagcctcctaagttgctcatttactgggcatctacccgggagtccggggtccctgacccgattcagcggcagcgggtcctgagacagatttcactctcaccatcagcagcctgcaggctgaagatgtggcagtttatactgtcagcagtattatagtagtctcagactttaggtcggggaccgaacgacgtaggaggatacaaacgaaactacgtcggcgngcgacactctntctctactc

SEQ ID NO: 301240 - DNA, 571 bp, Homo sapiens
  misc_feature: GZ8MTXP02HPI4J.39.31.C09.1.454.CMB.2.raw
  modified_base (386)..(386): a, c, t, g, unknown or other
  misc_feature (386)..(386): n is a, c, g, or t
  modified_base (402)..(402): a, c, t, g, unknown or other
  misc_feature (402)..(402): n is a, c, g, or t
  modified_base (419)..(419): a, c, t, g, unknown or other
  misc_feature (419)..(419): n is a, c, g, or t
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggctctggttactacttttagcagttatggtgtcagctgggtgcgacaggcccctggacaaggcttgagtggatgggatggatcagcacttacaaataggaaacacaaagtatgacacataattcagggtcagagtcatcatgaccanagacacatcccagganacaactcgcccttaaanagtacggaaacgtaggaacgaactaggaacgacgtacgtacgaaccgacgtaccgtacttaattacgtttacgttacgtagacgaagtaacgtaactaaactttccctaacttaacgtaactaacgtaacgaacgtacgtacggtaacgtcg

SEQ ID NO: 301241 - DNA, 502 bp, Homo sapiens
  misc_feature: GZ8MTXP02G2G1Q.39.31.C09.1.454.CMB.2.raw
  modified_base (292)..(292): a, c, t, g, unknown or other
  misc_feature (292)..(292): n is a, c, g, or t
  modified_base (388)..(388): a, c, t, g, unknown or other
  misc_feature (388)..(388): n is a, c, g, or t
  modified_base (430)..(430): a, c, t, g, unknown or other
  misc_feature (430)..(430): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttacngggcatctacccgggagtccggggtcctgaccgattcagcggcagcgggtcctgagacagatttcactctcacatcagcagcctgcaggctgaagntgtggctagtttatactgtcagcagttattatagtagtcctnagtacgtttgggaccggggtaccaagcgtaggagatacaaacgactgtcgctgcgacatctgtctcattccc

SEQ ID NO: 301242 - DNA, 519 bp, Homo sapiens
  misc_feature: GZ8MTXP02JPRJB.39.31.C09.1.454.CMB.2.raw
  modified_base (370)..(370): a, c, t, g, unknown or other
  misc_feature (370)..(370): n is a, c, g, or t
  modified_base (384)..(384): a, c, t, g, unknown or other
  misc_feature (384)..(384): n is a, c, g, or t
  modified_base (451)..(451): a, c, t, g, unknown or other
  misc_feature (451)..(451): n is a, c, g, or t
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggatgggatggatcagcacttacaaatggaaacacaaagtatgcacataattcagggcagngtcatcatgaccanagacacatccacgagcaactgcctacatggaaactgagaacctgagatctgacgacacggccttaanatttaatgtgcgaagacgaacaaacttccctaccttaacacttaattaccgagtactacggaagttcg

SEQ ID NO: 301243 - DNA, 517 bp, Homo sapiens
  misc_feature: GZ8MTXP02HWOU2.39.31.C09.1.454.CMB.2.raw
  modified_base (345)..(345): a, c, t, g, unknown or other
  misc_feature (345)..(345): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctcctaagttgctcatttactgggcatccgtacccgggagtccggggtccctgaccgattcagcgcagcgggtcngagcagtattcactctcaccatccagcagccctgcaggctagaagatgtggctagtttattactgtcagtctagttattatagtagtcctctagtacgtttcgggccggggtaccaagcgtaggagatacaaacgtaactcgtagctgcaccagtctgtacttctacttccc

SEQ ID NO: 301244 - DNA, 510 bp, Homo sapiens
  misc_feature: GZ8MTXP02JSS8H.39.31.C09.1.454.CMB.2.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactggcatctacccgggagtccggggtccctgacccgattcagcggcagcgggtcctgagacagatttcactctcaccatccagcagccctgcaggctgaagatgtggctagtttatactgtcagtcagtatatagtagtctcagtactttgggccggggtacaagcgtggagatacaaaacgaacgtgtaggctgcaccatctgtccttacactttcccg

SEQ ID NO: 301245 - DNA, 513 bp, Homo sapiens
  misc_feature: GZ8MTXP02IRII7.39.31.C09.1.454.CMB.2.raw
  modified_base (502)..(502): a, c, t, g, unknown or other
  misc_feature (502)..(502): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaaacaataagaattacttcgcttggtaccagcagaaaccaggacagcctcctaagttgctcatttactgggcatcctacccgggagtccggggtccctgacccgattcagcggcagcggtctgagacagatttcactctcaccatcagcagcctgcaggctagaagatgtggctagtttatactgtcagcagtattatagtagtcctcagtacgtttcgggccgggggtaccaagcgtaggacgatacgaaaacgaactgtacggctgcaccatctntcttcacttcc

SEQ ID NO: 301246 - DNA, 587 bp, Homo sapiens
  misc_feature: GZ8MTXP02G6NJY.39.31.C09.1.454.CMB.2.raw
  modified_base (378)..(378): a, c, t, g, unknown or other
  misc_feature (378)..(378): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaaacaataagaattacttcgcttggtaaccaacagaaaccaggacagcctacctaagttgctcatttactgggcatccgtacccgggagtcccggggtcctgaccgattcagcggcagcggtctgagacagatttcactctcaccatccaaacngcctgcagctagaagagtgtggactagtttattacgtgtacagtactaagtattagtagtacgtcctacgtacgtacgtttcgggaccgggggtaaccaaggtccgtaggaacgtaactaacgaaaacgtaacgtaggtacggtacgtacggaccaaccctaagttccgttacggttaccttactaccttccctttacccccggtaccc

SEQ ID NO: 301247 - DNA, 514 bp, Homo sapiens
  misc_feature: GZ8MTXP02FGFJX.39.31.C09.1.454.CMB.2.raw
  modified_base (496)..(496): a, c, t, g, unknown or other
  misc_feature (496)..(496): n is a, c, g, or t
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctgggggcctcagtgaacgtctcctgcaaggcttctggttacacttttagcagttatggtgtcagctgggtgcgacaggcccctggacaaggcttgagtggatgggatggatcagcacttacaatggaaacacaaagtatgcacagaacctcagggcagagtcaccatcgacacagacacatccacgagcacggcctacatgacctgaggagcctgagatcgtgacgacacggccgtgtatactgtgcgagagagtcggggaaaatagtttgaactggtaaccctnttgactacgtgggacccg

SEQ ID NO: 301248 - DNA, 509 bp, Homo sapiens
  misc_feature: GZ8MTXP02F281Y.39.31.C09.1.454.CMB.2.raw
  modified_base (385)..(385): a, c, t, g, unknown or other
  misc_feature (385)..(385): n is a, c, g, or t
  modified_base (399)..(399): a, c, t, g, unknown or other
  misc_feature (399)..(399): n is a, c, g, or t
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacaggcccctggacaagggcttgagtggatgggatggatcagcacttacaatggaaacacaaagtatgacacataattcagggcagagtcatcatgaccanagacacatccagancactgacctacatggaactgagactgagatctagacgacacggacttatattatgtgacgtaagacgactaaacttcctactaacattacttacgacgtataggaatacg

SEQ ID NO: 301249 - DNA, 628 bp, Homo sapiens
  misc_feature: GZ8MTXP02GCMJ9.39.31.C09.1.454.CMB.2.raw
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagctgggtccgcgacacggcccctggaaccgaagggcttggaggtggagtggggatggatcgagctacttaacaaataggaaaacacaaaagtatgacaactattaaacttccgagggcagagtacatacatacgaaccacagacaacactacccgaaacgacgactaaccgtcgaccctaacgtaacgtacgggaaaccttaggaacggtaaacccgtagggaaagtaacttacgacggaaccgtaaccgaaccggtacctttaaatatttaacgttggtagacgaaagtaacgaaccttaaaacttccctacttaacaagttaacgtaacgacgtagtacggtaaagtttcg

SEQ ID NO: 301250 - DNA, 558 bp, Homo sapiens
  misc_feature: GZ8MTXP02GHKL3.39.31.C09.1.454.CMB.2.raw
  modified_base (396)..(396): a, c, t, g, unknown or other
  misc_feature (396)..(396): n is a, c, g, or t
  modified_base (450)..(450): a, c, t, g, unknown or other
  misc_feature (450)..(450): n is a, c, g, or t
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacaggcccctggacaagggcttgagtggatgggatggatcagcacttaacaagtaggaaaacacaaaagtatagacacataatttccgaggggcagagtcatcatcgaccanacgacacatacccacgacgacactgacctacataggaactggaagaacctgganatcgagacgacgacggacctttataatttacgttgtagtacgaaagacgtaacctaaaacttccctaccttaacgtaattacttaacgacgtacgtaggaacgtttag

SEQ ID NO: 301251 - DNA, 638 bp, Homo sapiens
  misc_feature: GZ8MTXP02HESSB.39.31.C09.1.454.CMB.2.raw
  modified_base (342)..(342): a, c, t, g, unknown or other
  misc_feature (342)..(342): n is a, c, g, or t
  modified_base (389)..(389): a, c, t, g, unknown or other
  misc_feature (389)..(389): n is a, c, g, or t
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggatgggatggatcagcattacaatggaaacanaaagtatgacacataatttccaggggacaggagtcatcatgaaccanacgacacactacccaacgacgacaaccgtcgacctaacgaattacggggaaaccttggaagggtaaaccctgggaacggactaccgtaggaaccgaccgtaaccgggtacccttttaaagtaactttttaaacgttcggtaggtaccggaaagtaacggtaaacctaaaaacgtttcccctaaccctttaaccgtaactttaaacgtttaaccggtaaaccgtaacgttaggggtaaaacgtttacggg

SEQ ID NO: 301252 - DNA, 512 bp, Homo sapiens
  misc_feature: GZ8MTXP02IXKQT.39.31.C09.1.454.CMB.2.raw
  modified_base (434)..(434): a, c, t, g, unknown or other
  misc_feature (434)..(434): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaaacaataagaattacttcgcttggtaccagcagaaaccaggacagcctcctaagttgctcatttactggcatctacccgggagtccggggtccctgacccgattcagcgcagcgggtcctgagacagtatttcactctcaccatcagcagcctgcagctagaagatgtggctagtttatactgtcagctagttattatagtagtcctntagtacgtttgggaccggggtaccagcgtaggagatacgaaacgaactgtacgctgcaccatcctgtcttcacttccc

SEQ ID NO: 301253 - DNA, 530 bp, Homo sapiens
  misc_feature: GZ8MTXP02GU3OG.39.31.C09.1.454.CMB.2.raw
  modified_base (374)..(374): a, c, t, g, unknown or other
  misc_feature (374)..(374): n is a, c, g, or t
  modified_base (385)..(385): a, c, t, g, unknown or other
  misc_feature (385)..(385): n is a, c, g, or t
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggatgggatggatcagcacttacaatggaaacacaaagtatgacacataattccagggcagagtnatcatgaccanagacacatacccagacgcactgaccctacatggaactggaacgaacctgagatcgtacgacgacacggtaccttatattagtgtgacgagacgactaacttaccctcttaacacttaagttaccgagtaacgtcggaaagtttcg

SEQ ID NO: 301254 - DNA, 512 bp, Homo sapiens
  misc_feature: GZ8MTXP02JOYWN.39.31.C09.1.454.CMB.2.raw
  modified_base (434)..(434): a, c, t, g, unknown or other
  misc_feature (434)..(434): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctcctaagttgctcatttactgggcatctacccgggagtccggggtcctgacccgattcagcggcagcgggtcctgagacagatttcactctcacatcagcagccctgcaggctagaagatgtggctagtttattactgttacagcagtattatagtagtcctnagtctttgggaccggggtacaagcgtaggagatacaaacgtaactgtcgctgcaccgatctgtcctttcactttcccg

SEQ ID NO: 301255 - DNA, 546 bp, Homo sapiens
  misc_feature: GZ8MTXP02FPNCE.39.31.C09.1.454.CMB.2.raw
  modified_base (290)..(290): a, c, t, g, unknown or other
  misc_feature (290)..(290): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattactcgcttggaccagcagaaaccaggacagcctctaagttgctctatttacgnggcatcgtacccgggagtccgggtcctcgaccgattcgagcgcaggcgggtctagacgacagtattccactctacacatcagcacggcctgacgaggtctaagaagtgtggtcggtacttagtttactacgtgtacgagtacttaagttatttagtaaggttctcctagtagttacggttcgggaccgggacaggcgtaggatactaacgaaacgtcgtcgtacgcgtagcaaccgttctctcttctactcgttcc

SEQ ID NO: 301256 - DNA, 533 bp, Homo sapiens
  misc_feature: GZ8MTXP02IVH2W.39.31.C09.1.454.CMB.2.raw
  modified_base (328)..(328): a, c, t, g, unknown or other
  misc_feature (328)..(328): n is a, c, g, or t
  modified_base (391)..(391): a, c, t, g, unknown or other
  misc_feature (391)..(391): n is a, c, g, or t
  modified_base (407)..(407): a, c, t, g, unknown or other
  misc_feature (407)..(407): n is a, c, g, or t
  modified_base (429)..(429): a, c, t, g, unknown or other
  misc_feature (429)..(429): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactggcatcgtacccgggagtcccggggtcctgacccgnttcagcgcagcggtctgagacagtattcactctcaccatcagcagcctgcaggctgaagatgngctagtttatactgtnagcagttattatagtagtcctntacgtacgtttcgggaccggggtacgagtcgtaggagtactacgtaaaacgaacgttcgtacggtacgtacgcctaccgaactctagtccttctactttccccg

SEQ ID NO: 301257 - DNA, 657 bp, Homo sapiens
  misc_feature: GZ8MTXP02HCK8F.39.31.C09.1.454.CMB.2.raw
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggtcttctggttactacttttagctagttatggtgtcagctgggtgcgacacggcccctggacaagggtcttgagtggatgggatggatcgagctacttacaagtggaaaacacgaaagtatagacaactattaaacttccgagggggtacaaaggtacgttaccaatccaatacgaacccagaacgaacaacactacccgaacgacgacctaacgtcgaccccttaagaacgttacgggaaaccttagggaaaccggaaacccgttagggaaacgtacttacggtacggaaccggaacgtaccgggttacctttaacttaagttttagttacggtagtacggaaagtacgtaaactaaaactttcccttaaacctaacgttaattaacgttaacgtacgtacgtaaggtaacgtttcg

SEQ ID NO: 301258 - DNA, 575 bp, Homo sapiens
  misc_feature: GZ8MTXP02GI9CF.39.31.C09.1.454.CMB.2.raw
  modified_base (293)..(293): a, c, t, g, unknown or other
  misc_feature (293)..(293): n is a, c, g, or t
  modified_base (379)..(379): a, c, t, g, unknown or other
  misc_feature (379)..(379): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgtttacacaggtccaaacaataagaattacttcgcttggtaccagcaagaaaccaggacagcctcctaagtgctcatttacnggcatccgtacccgggagtcccggggtccctcgaccgattcgagcggcaggcggtcctgagacagtactttcactctccacatcancagcctgcaggctaggaaagtagtggtggacttaggtttattacgtgtacagtactagttattaataggttactcctagtagttacggtttacgggaccggggtaacctaaggtcgtaggaacgtacgtaacgaaaacgtaacgtggtacggcctacgaaccgtaacctattcgtcgttaccttctactttccccg

SEQ ID NO: 301259 - DNA, 501 bp, Homo sapiens
  misc_feature: GZ8MTXP02FOLF1.39.31.C09.1.454.CMB.2.raw
  modified_base (363)..(363): a, c, t, g, unknown or other
  misc_feature (363)..(363): n is a, c, g, or t
  modified_base (492)..(492): a, c, t, g, unknown or other
  misc_feature (492)..(492): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatcacccgggagtcccggggtccctgacccgattcagcggcagcgggtcctgagacagattcactcncaccatccagcagcctgcaggctgaagatgtggctagtttatactgtcagcagtattatagtagtctcagtacgtttggccgggggaccaagctaggagatacaaacgaactacgtgctgcaccatctntctctactc

SEQ ID NO: 301260 - DNA, 568 bp, Homo sapiens
  misc_feature: GZ8MTXP02IXCMT.39.31.C09.1.454.CMB.2.raw
  modified_base (297)..(297): a, c, t, g, unknown or other
  misc_feature (297)..(297): n is a, c, g, or t
  modified_base (357)..(357): a, c, t, g, unknown or other
  misc_feature (357)..(357): n is a, c, g, or t
  modified_base (392)..(392): a, c, t, g, unknown or other
  misc_feature (392)..(392): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgaggagggccaccatcaactgcaagtccagccagagttgtttacacaggtaccaaacaataagaattacttcgcttaggtaccagcaagaaaccaggacagcctctaagttgctcatttacnggcatccgacccgggagtccgggtcctgaccgtattcagcgcaggcggtctgagacagtnttcactctcacatcagcagccctgcagctagaagntgtgactagtttatacgtgtacgagtctagttattagtagttacgtcctacgtagttacgtttcgggaccggggtaactaacgcgtacggacgtacgttaccgaaaacgtacgttacggtacggtacctacgaaccgtacctaacgttcctacgtttaccttacgtactttccccg

SEQ ID NO: 301261 - DNA, 563 bp, Homo sapiens
  misc_feature: GZ8MTXP02J30NA.39.31.C09.1.454.CMB.2.raw
  modified_base (249)..(249): a, c, t, g, unknown or other
  misc_feature (249)..(249): n is a, c, g, or t
  modified_base (283)..(283): a, c, t, g, unknown or other
  misc_feature (283)..(283): n is a, c, g, or t
  modified_base (350)..(350): a, c, t, g, unknown or other
  misc_feature (350)..(350): n is a, c, g, or t
  modified_base (361)..(362): a, c, t, g, unknown or other
  misc_feature (361)..(362): n is a, c, g, or t
  modified_base (364)..(364): a, c, t, g, unknown or other
  misc_feature (364)..(364): n is a, c, g, or t
  modified_base (369)..(369): a, c, t, g, unknown or other
  misc_feature (369)..(369): n is a, c, g, or t
  modified_base (374)..(374): a, c, t, g, unknown or other
  misc_feature (374)..(374): n is a, c, g, or t
  modified_base (396)..(396): a, c, t, g, unknown or other
  misc_feature (396)..(396): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagactccctggctgtgtctctgggcgagaggccaccatcaactgcaagtccagccagagtgtttacacagtccaacataagaattactcgctagtaccaanagaaccaggacagcctcctaagtgctcatttacnggcatcgtacccggagtccggggtccctgaccgattcagcgcagcggtctgagacagatttcactcncaccatcaacnncngcagnagagngtgtgtattatttatactgtanagatagttattagttagtacgtaccgtacgtacgttacggtttacggggaccgggaacgaacgtacgtacggaagtaacgtaacgaaaacgtaacgtggtacggtacgtacgtacctacctaacgttcgttcgttaccttacctaccgtttcccttaccccgtaccg

SEQ ID NO: 301262 - DNA, 671 bp, Homo sapiens
  misc_feature: GZ8MTXP02GTRBI.39.31.C09.1.454.CMB.2.raw
  modified_base (245)..(245): a, c, t, g, unknown or other
  misc_feature (245)..(245): n is a, c, g, or t
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttntggttactacttttagctagttatggtgtcagtcgtgggtgcgacgacggccccgtaggacgaagggtcttggaggtggagtggggatggatcgagctaacttaacgaaagtacggaaaacaacgaaaaggtatacgactaacgtaattaaacgtttaccgagggggacaaggtaagtaccaatacgaagtacgaaacccaacgaaacgaaccaacaactacccgaacgacgacctaactacgtaccctaagaagtacggaaacgtaggaacggtaaaccgtaggaacgtaacgtcgtaacggaaccgaaccgtaccggttacctttaagttaactttagtacggtaggacgaaagaacgtaaacctaaactttccctaacttaaacgtacttaaacgttacgaacgtaagtacggtaagtttacg

SEQ ID NO: 301263 - DNA, 532 bp, Homo sapiens
  misc_feature: GZ8MTXP02HMU45.39.31.C09.1.454.CMB.2.raw
  modified_base (290)..(290): a, c, t, g, unknown or other
  misc_feature (290)..(290): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagaggccaccatcaactgcaagtccagccagagtgtttacacagttaccaaacaaataaaactacttagctggcacagcagaaaccaggacagccctctagagtgctcatttacngggcatccgtacccgggaatcccggggtccctgaccgattcagtggcaggccggatcgtgggactagtactttcacctctacaccatcagcacgcctgcgaggctagaagatgtgactagtttattactagtacactaattattaataactactctactagtactttcggaccgtaggggacaagtcgtaggagaactacgaaacgtacgtagtacgctcgacactactctctacttactac

SEQ ID NO: 301264 - DNA, 598 bp, Homo sapiens
  misc_feature: GZ8MTXP02HFYVZ.39.31.C09.1.454.CMB.2.raw
  modified_base (344)..(344): a, c, t, g, unknown or other
  misc_feature (344)..(344): n is a, c, g, or t
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttcgtggttactacttttagctagttatggtgtcagcgtgggtgcgacgacggcccctggacgaagggcttggaggtggagtgggatggatcagcaacttanaaagtagaaaacacgaaagtatagactaactattaacgttccgagggacagtacgtactaatcagtacgaacccacaacgaacaaccactacccgaacgacgaccaactcgacctacgaacgtaggaactggaacgacctaggactataccgacgacgacacggtactaatagttactgtagacgaagtaacgaactaaacgtttccctacttaaacgtaattacgttaacgacgtagtaacggtaaagtttcg

SEQ ID NO: 301265 - DNA, 672 bp, Homo sapiens
  misc_feature: GZ8MTXP02HK5WL.39.31.C09.1.454.CMB.2.raw
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagcgtgggtgcgacgacggcccctggacaagggcttggaggtggagtgggatggatcgagcattacaataggaaacacaaagtatagacaacgtaattaacgtttaccgagggggacaaggtacgttaccaagttacaaattacgaaacccaacgaacgaacaacaactacccgaacgacgacaaccgtacgaccctaacacgtacggtaaaacttggaaacggaaccgttaggaacggtacttacggtaacggaaaccggtacgtaaccgggttacctttaaagttagttttaaacgttcggttaggaccggtaaagtaaacggtaaactaaaccgtttaccctacctttaaacgaactttaacgtaacgtaacgtacgttacggtaaacgtttacg

SEQ ID NO: 301266 - DNA, 524 bp, Homo sapiens
  misc_feature: GZ8MTXP02IRQPZ.39.31.C09.1.454.CMB.2.raw
  modified_base (391)..(391): a, c, t, g, unknown or other
  misc_feature (391)..(391): n is a, c, g, or t
  modified_base (417)..(417): a, c, t, g, unknown or other
  misc_feature (417)..(417): n is a, c, g, or t
  modified_base (441)..(441): a, c, t, g, unknown or other
  misc_feature (441)..(441): n is a, c, g, or t
  modified_base (498)..(498): a, c, t, g, unknown or other
  misc_feature (498)..(498): n is a, c, g, or t
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacaggcccctggacaagggcttgagtggatgggatggatcagcacttacaatggaaaacacaaagtatgacaacattaatttccaggggcagagtcatcatgaccanagacacatccacgagcactgacctanataggaactaggagaacctgaagntctagacgacacggacttaatattatgtgcgaagacgactaaacttcctaccttaanataacttacgacgtataggaagttcg

SEQ ID NO: 301267 - DNA, 693 bp, Homo sapiens
  misc_feature: GZ8MTXP02GBLQD.39.31.C09.1.454.CMB.2.raw
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgcaaggcttctggttactacttttagctagttatggtgtcagtcgtgggtgcgacgacggcccctggacaagggcttggagtggagtgggatggatcgagacacgttacaaagtggaaaacacaaagtatgacactattaacttaccgagggtcaagagtcatcatacgaaccacacgacaacgaactcccgaacgacgaccaacgtccgaccctaacgaaacgttacgggaaaccttacggaaacggtaacccgtaggtaacggaaacttccggtaacgaacccggaaaccgtaacccgggttaacctttaaagttaactttttaacgtttagggttaacggtaaccggaaaggtaaacggtaaacccgtaaaaccttttccccgttaaaccctttaaactaaacgttaaacgtttaaaccggaacgttaaaccggttacgggtaaagttttaccgg

SEQ ID NO: 301268 - DNA, 532 bp, Homo sapiens
  misc_feature: GZ8MTXP02FQX8O.39.31.C09.1.454.CMB.2.raw
  modified_base (447)..(447): a, c, t, g, unknown or other
  misc_feature (447)..(447): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtacccagcaagaaacccaggacagccctacctaagttgctctatttacgtgggcatccgtacccggggagtcccggggtccctggacccgattcgagcggcagcgggtctgagacagtattcactctcaccatcagcagcctgcaggctagaagagtgtggctagtttattactgtcagctagtattatagtagtcctnacgtacgtttcggccggggacagtctaggagatacgaaacgtaacgtgtacgctacgcgacctactctcgtctactactttcccg

SEQ ID NO: 301269 - DNA, 630 bp, Homo sapiens
  misc_feature: GZ8MTXP02GZJJ3.39.31.C09.1.454.CMB.2.raw
  modified_base (412)..(412): a, c, t, g, unknown or other
  misc_feature (412)..(412): n is a, c, g, or t
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttcgtggttactacttttagctagttatggtgtcagctgggtgcgacaggcccctggacaagggcttgaggtggagtgggatggatcgagcaacttacaaagtaggaaaacacaaaagtatagacactaataacgtttcgagggcaaggagtacatacagtacgacccaanacgacaacactaccgaacgacgacacgtacgacctaacgagtacggaaactacggaacggtaaacctggaagtacttacgacggtaaccggaacctaccgggttacctttaaagttaactttaggtttagtacgacggaaggtaaacgtaacctaaaactttcccctaacttaaactaacgtttaaacgtaacgtaacgaagttacggtaagtttacg

SEQ ID NO: 301270 - DNA, 619 bp, Homo sapiens
  misc_feature: GZ8MTXP02HEZQL.39.31.C09.1.454.CMB.2.raw
  modified_base (405)..(405): a, c, t, g, unknown or other
  misc_feature (405)..(405): n is a, c, g, or t
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacaggcccctggacaagggcttgagtggatgggatggatcagctacttacaaagtaggaaaacaacaaaagtatagacaactaattaaatttccgaggggcaagagtcatcatcgaaccanagacacactacccacgagacaactcgacctaacatacgggaaacctaggaagggaaacctaggaacgagttaccgaggaaccgaacgtaaccggtacctttaaataagtttacttaggtagaccgaaggaaacgtaaaccgtaaaactttccctaaccttaaacgtaattaaacgtttaacccggaacggtaacgttacggggtaaaatttcgg

SEQ ID NO: 301271 - DNA, 742 bp, Homo sapiens
  misc_feature: GZ8MTXP02HTHZC.39.31.C09.1.454.CMB.2.raw
  modified_base (328)..(328): a, c, t, g, unknown or other
  misc_feature (328)..(328): n is a, c, g, or t
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaaggaggcctgggggcctcagtgaacgtctcctgcaaggcttctggttactactttttagctagttatggtgtcagcgtgggtgcgacaggcccctggacaaggcttgagtggatgggatggatnagcacttacaaagtaggaaacacaaagtatagacaactaattaactttaccgagggggtaccaaaggacggttacctaacgttccgaaattacggaaacccaaacgaaacggtaaacccaaccgaacttacccccgaaacggaaccggaacctaaccgttacgaccccgttaaacaaacgttaacggggtaaaaccttacggggaaacgggtaaaaccccgttagggaaacggtaaacgttaccgttaacggaaaccggaaccgtaaaccgggttaaccctttaagttaaacttttaacgtttaggttacggaaccggtaaaggtaaacggtaaaccttaaaacgtttccccttaacctttaaacgtaacttaaacgtttaaccggaacgttaacgtacgggttaaaagtttcg

SEQ ID NO: 301272 - DNA, 508 bp, Homo sapiens
  misc_feature: GZ8MTXP02I5T2W.39.31.C09.1.454.CMB.2.raw
  modified_base (413)..(413): a, c, t, g, unknown or other
  misc_feature (413)..(413): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaaacaataagaattacttcgcttggtaccagcagaaaccaggacagcctcctaaagttgctcatttactgggcatctacccgggagtccggggtcctgacccgattcagcgcagcgggtctgagacagatttcactctcaccatccagcagcctgcagctgaagatgtggctagtttatactgtcagnagtattatagtagtcctcagtactttggccggggtacaagctaggagatacaaaacgaactgtacgctacgcaccaatctgtcttacactttccc

SEQ ID NO: 301273 - DNA, 587 bp, Homo sapiens
  misc_feature: GZ8MTXP02G1U5I.39.31.C09.1.454.CMB.2.raw
  modified_base (289)..(289): a, c, t, g, unknown or other
  misc_feature (289)..(289): n is a, c, g, or t
  modified_base (301)..(301): a, c, t, g, unknown or other
  misc_feature (301)..(301): n is a, c, g, or t
  modified_base (398)..(398): a, c, t, g, unknown or other
  misc_feature (398)..(398): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagttgtttacacaggtaccaaacaataaagaattacttcgtcttggtaccagcaagaaaccaggacagcctactaagttcnctctatttacgnggctactccgtacccggggaggtcccggggtccctacggacccgtattcgacggcggcgacggtcgggtcctaggagacagtactttcactctcacntcagcacgccctgcgaggctaggaaagtgtggtacgacttaaggttttactacgtgtacagtatagtttattactaggttactcctagtaaggttcggtttcggggaccggggaactaagcggttagagactacgaaacgtagtggtacgctagaaccgtactacgttctcgttcttacactttccccg

SEQ ID NO: 301274 - DNA, 651 bp, Homo sapiens
  misc_feature: GZ8MTXP02JDLPD.39.31.C09.1.454.CMB.2.raw
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctggatgcgacaggcccctggacaggcttgagtggatggatggatcagcacttacagtaggaaacaccgaaagtatgacacataacttccgagggacagagtacatcatcgaccacagaccacacgtacccacgacgacactcgacccttaacacgtacggtaaacctggaaacgggtaaacccgtagaaacggtacgtacgttacggaaccggaaccgtacccgggtacctttaaacgtttaacttttacgttaggttacgggaacggtaaacgtaacggtaaaacccgttaaaaccttttacccccttaacccgtttaaaacccaagtttaaaccgtttaaacccgaacggttaaacgttagggtttaaaaccg

SEQ ID NO: 301275 - DNA, 633 bp, Homo sapiens
  misc_feature: GZ8MTXP02J4Y1K.39.31.C09.1.454.CMB.2.raw
  modified_base (291)..(291): a, c, t, g, unknown or other
  misc_feature (291)..(291): n is a, c, g, or t
  modified_base (429)..(429): a, c, t, g, unknown or other
  misc_feature (429)..(429): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccaacggggacatcgtgatgacccagtctccagactccctggctgtgtctctgggcgagagggccaccatcaactgcaagtccaaccagagtgttttatacagttccaaacaaatacctaactacttagtctcggacaccagacagaaaccacggacacgcctcctagaggtnctctatttacgtcgggctacgtaccgtaaccccgggtaccggttaccggggttccccgtaccgtaccgtacgttaccgagttcggcgacggtaaccggcgtacgtcggtacggtagtactttactcctacttaccccnccactacacgacgacgacgtcgtacgacgacggtacgtaagtaagtagttaggttacggttacgtttaacgtttaactttacgttacttacctaactacttactacttactactactactactacgtacgtacgtacgtacggtacgtacggacgacgacgacgtacgtacgacgacgtaacgtcgtacgtctcgtctctactc

SEQ ID NO: 301276 - DNA, 557 bp, Homo sapiens
  misc_feature: GZ8MTXP02IKHTO.39.31.C09.1.454.CMB.2.raw
  modified_base (404)..(404): a, c, t, g, unknown or other
  misc_feature (404)..(404): n is a, c, g, or t
  modified_base (466)..(466): a, c, t, g, unknown or other
  misc_feature (466)..(466): n is a, c, g, or t
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacaggcccctggacaagggcttgagtggatgggatggatcagctacttacaagtaggaaacacaaagtatagacactattaactttcccgagggggcaaggacgtacatacatagaccanagacacatacccagacgcaactcgacctacagtacggaaactggacgacctgaacgatacgngacgacgacggtcttatatttacgtgtagcgtaagacgactaaaacttcctacttaactattaacgttacgagtacgtacggtacgttacg

SEQ ID NO: 301277 - DNA, 602 bp, Homo sapiens
  misc_feature: GZ8MTXP02F3GYB.39.31.C09.1.454.CMB.2.raw
  modified_base (411)..(411): a, c, t, g, unknown or other
  misc_feature (411)..(411): n is a, c, g, or t
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcgagtgaacgtctcctgcaaggcttctggttactacttttagctagttatggtgtcagctaggtgcgacacggcccctggacaagggcttggagtggatggggatggatcgagcaacttacaaagtaggaaaacacaaagtatgacaactataattccgagggcagagtcatcatgaaccagacacaactancccaaacgacgtacaacgttcgaccctaacgacgttaacgggaacctagggaaccggaaacctgggaactacgtccgaaggaaccaacgtaccggtactttataagtttaacttggagaccgtaagaacgtaactaaaacttcccttaacttaacaacttaacgttaccgaagtagtacggtaaagtttcg

SEQ ID NO: 301278 - DNA, 572 bp, Homo sapiens
  misc_feature: GZ8MTXP02FMHI9.39.31.C09.1.454.CMB.2.raw
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacaggcccctggacaagggcttgagtggatgggatggatcagcacttacaatggaaacacaaaagtatgacacataactttccgaggggcaggagtcatcatagaccacagacacatcccacgagcaactcgaccctaacagtacggaaactggaacggtaacctaggaagaactctaggaaccgacgaaccggtcctttaagtaactttaacgttgtagacggaaggaacgaactaaaacttccctaaccttaactacttaacttaccgaagtactaggaagttacg

SEQ ID NO: 301279 - DNA, 650 bp, Homo sapiens
  misc_feature: GZ8MTXP02GA8PY.39.31.C09.1.454.CMB.2.raw
  modified_base (388)..(388): a, c, t, g, unknown or other
  misc_feature (388)..(388): n is a, c, g, or t
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacaggcccctggacaagggcttgagtggatgggatggatcagcacttacaagtggaaacacaaagtatgacacataacttcaggggcagagtcatcatgaccanagacacatcccaacgacgacacgtcgacctaacaacgtaggaaaccttaggaaacggtaacccgttaggaacgtaattaccgtacggaaccgaaacgtaaccgggtaccctttaaagttaaactttaaacgtttcgggttaggtaccgggtaaaggaaacggtaaaccttaaaaacgtttcccctttaaccctttaaacgtaaacttttaaacgtttaaaccgggaaaccggttaacgttaacggggtaaaacgttttacgg

SEQ ID NO: 301280 - DNA, 618 bp, Homo sapiens
  misc_feature: GZ8MTXP02HZ5BJ.39.31.C09.1.454.CMB.2.raw
  modified_base (349)..(349): a, c, t, g, unknown or other
  misc_feature (349)..(349): n is a, c, g, or t
  modified_base (396)..(396): a, c, t, g, unknown or other
  misc_feature (396)..(396): n is a, c, g, or t
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagcagttatggtgtcagctgggtgcgacaggcccctggaccaagggcttgagtggatgggatggatcagctacttacaaagtaggaaacanaaaagtatagcaacataaatttccaggggacaagagtacaacctaanacgaccacacgaacacacaccgacgacgacactacgacctacgacgtacggaacgtacggaacggtaaccgtagacgtacgtacgaacggaaccgtaacgtaccggttacttaattaagttagttacggtacgacgaaacgtaaacgtaaacctaaacttaccctaacttaacgtaacgttaacgtaaacggtaacgtaacgtacggtaaacgttacgttac

SEQ ID NO: 301281 - DNA, 578 bp, Homo sapiens
  misc_feature: GZ8MTXP02IP43O.39.31.C09.1.454.CMB.2.raw
  modified_base (395)..(395): a, c, t, g, unknown or other
  misc_feature (395)..(395): n is a, c, g, or t
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagcgtgggtgcgacacggcccctggacaagggcttgagtggagtgggatggatcagcacttacaagtaggaaacacaaagtatgacacataagttccagggcagagtcatcatcgaaccanagacacactaccacgacgcactcgacctacagtacggaaactaggaacgaacctaggaagtacgtcgtacggaccgaacgaccggtaccttaagttaactttagttgtagacgaagtaacgtaacctaaaactttccctaccttaactaattaacgttacgaacgtactaggtaaacgtttcg

SEQ ID NO: 301282 - DNA, 572 bp, Homo sapiens
  misc_feature: GZ8MTXP02JBGJK.39.31.C09.1.454.CMB.2.raw
  modified_base (133)..(133): a, c, t, g, unknown or other
  misc_feature (133)..(133): n is a, c, g, or t
  modified_base (352)..(352): a, c, t, g, unknown or other
  misc_feature (352)..(352): n is a, c, g, or t
  modified_base (358)..(358): a, c, t, g, unknown or other
  misc_feature (358)..(358): n is a, c, g, or t
  modified_base (398)..(398): a, c, t, g, unknown or other
  misc_feature (398)..(398): n is a, c, g, or t
tcagtcgcactagtcacgaccggtgctcgatttagacgtctcatcaaggaaggaaggggacccaaaaaccacacccctccttgggagaatcccctagatcacagctcctcaccatggactggacctggagcanccttttcttggtggcagcagcaacaggtgcccactcccaggttcaattggtgcagtctggagctgcggtgaagaggcctggggcctcagtgaacgtctcctgcaaggcttctggttacacttttagcagttatggtgtcagctgggtgcgacgacggcccctggaccaaggggtcttggaggtggagtggggatggatcagcacttacaatggaaacanaaagtngcacatacttcagggcagacgtcatcatgaccagagaacncacacacgacgacactacgactacacgtacgtaacgtacgacgaacgtacgaacgacgtacgtacgacgacgaccgtaccgtactaacttaacgttagttagtacgacgaacgtaacgtaactaaacttaccttaacctaactaactaacgtaacgtacgtaacgtaaggtaag

SEQ ID NO: 301283 - DNA, 648 bp, Homo sapiens
  misc_feature: GZ8MTXP02HAT4E.39.31.C09.1.454.CMB.2.raw
  modified_base (492)..(492): a, c, t, g, unknown or other
  misc_feature (492)..(492): n is a, c, g, or t
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagcgtgggtgcgacacggcccctggacaagggtctgagtggatgggatggatcgagctaacttacaaagtaggaaactacaaaaccctatacgacaacgacgaaacccgtacccgagggggaccaaggtaccgtaccaccgaatacgaacccaacgaacgaaccaaccaactacccaacggacgacccgacggacccttaaacgacgttacgggaaccncgggaaggacgacccgtggaagtactcgtagaccgacggacgtccgttaggttactacgttggacgcgaacggagaaggttacggggtaaaattgtttacggaacgttacggttaaccccttgtttacggacctttaccgggacggggtaacccgg

SEQ ID NO: 301284 - DNA, 655 bp, Homo sapiens
  misc_feature: GZ8MTXP02JD0MM.39.31.C09.1.454.CMB.2.raw
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagcgtgggtgcgacgacggccccgtggacgaagggtcttggagttggagtgggatggatcgagctaacttacaaagtaggaaaacacaaaagtatagacaacattaacttccgagggcaagagtacatcatcgaaccacaagacacactacccgaacgacgaccactgaccctaagacgtacggaaactacggaacggaacctaggaacgacgtacgtacggaaccgaacgaccgggttaccttaagttaagtttacgttaggtacggtaacggtaaacgtaaacggtaaaccgttaaaaaccgtttcccttaaaccttaaacgtaaacttaaacgtttaaaccggaaaccggttaacgttaagggtaaacggtttaacgg

SEQ ID NO: 301285 - DNA, 551 bp, Homo sapiens
  misc_feature: GZ8MTXP02HJQWB.39.31.C09.1.454.CMB.2.raw
  modified_base (288)..(288): a, c, t, g, unknown or other
  misc_feature (288)..(288): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccaacggggacatcgtgatgacccagtctccagactccctggctgtgtctctgggcgagagggccaccatcaactgcaagtccaaccagagtgtttatacagttcaacaataaaactacttagcttggcaccagcagaaaccagacagcctctagagtgctcatttacgnggacataccgtaacccgggaagtcccgggtccctagaccgtattcgagtcggcaggcgactcgtagggacagtacttcactcctacaccatcagcacgcctagcagctagaagagtgtagactagttatactagtactaactaattaattaataatactactactagttacgttcgacgtagggacctaagacgtaggagtaactaacgaaaacgtaacgtacgtacgctacgaaccactaactctacgttcttactactccg

SEQ ID NO: 301286 - DNA, 660 bp, Homo sapiens
  misc_feature: GZ8MTXP02HHPB3.39.31.C09.1.454.CMB.2.raw
  modified_base (377)..(377): a, c, t, g, unknown or other
  misc_feature (377)..(377): n is a, c, g, or t
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctctgcaaggcttctggttacacttttagcagttatggtgtcagctgggtgcgacaggcccctaggacaagggcttggagtggagtgggatggatcagcacttacaataggaaacacaaagtatgacaatataattccgagggcaagngtacagtcaatacgaaccacaagaccaacactacccgaacgacgactaacctacggacccttaacgaacgttacggggaaaccctagggtaaacggtaaacccgttagggaaacgtaacgtaccgttaagggaaaccggtaccgtaaccgggttacctttaaaatttacgtttaagttacggttagaccggtaagaaacggtaaccttaaaacgtttccccttaaccgtttaaccgtaatttaaccgttaacggaaccgtagttaaccgggtaagtttaccgg

SEQ ID NO: 301287 - DNA, 621 bp, Homo sapiens
  misc_feature: GZ8MTXP02IY6VA.39.31.C09.1.454.CMB.2.raw
  modified_base (391)..(391): a, c, t, g, unknown or other
  misc_feature (391)..(391): n is a, c, g, or t
  modified_base (400)..(400): a, c, t, g, unknown or other
  misc_feature (400)..(400): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgaggagggccaccatcaactgcaagtccagccagagtgtttacacaggtaccaaacaataagaattactcgcttggtaccagcaagaaaccaggacagcctactaagttgctctatttacgtgggactatccgtaaccccggggacggtccccgggggtacccctggacccgattccaggcgcaggcggtcctagagacagtattcactctcaccancagcagccngcaggctagaagatgtcgatagtttatactgtacagtacgtaagttattaagttaagttacgtacccgttagtaacggttaccggttttcgggggaccccgggggtaaaccgaaaagggcgttagggaacgtaaactaaccgaaaaacggtaaaccgtggtacgggtactacggtaaccaaacccgtaattcccgtttacgttaccttactacctttcccg

SEQ ID NO: 301288 - DNA, 513 bp, Homo sapiens
  misc_feature: GZ8MTXP02GSTLB.39.31.C09.1.454.CMB.2.raw
  modified_base (441)..(441): a, c, t, g, unknown or other
  misc_feature (441)..(441): n is a, c, g, or t
  modified_base (470)..(470): a, c, t, g, unknown or other
  misc_feature (470)..(470): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatccgtacccgggaggtcccggggtcctgacccgattcaggcggcaggcgggtcctgagacagtatttcactctcaccatcagcagcctgcaggctagaagatgtgactagtttatactgtcagctagttattatagtagtcctnagtcgtttcgggccggggacagcgtgganagtacaaacgactgtacgctagcacactctgtcttacacttcc

SEQ ID NO: 301289 - DNA, 700 bp, Homo sapiens
  misc_feature: GZ8MTXP02G31AN.39.31.C09.1.454.CMB.2.raw
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccacctcccaggttcaattggtgcagtctggagctgcggtgaagaggccgtggggcctcagtgaacgtctcctgcaggcttcgtggttactacttttagctagttatggtgtcagtcgtgggtgcgacgacggccccgtaggacgaagggtcttggaggtggagtgggagtggatcgagactaacttaacaaagtacggaaaacaacgtaaaagtatagacaactaattaaacgttaccgaggggacaaggtacgtacatacagtacgaaaccagaacgaacaactacaccgaacggacacctacgtacctacctaacgtaacgtaacggtaaacctacgggaaacgtaaccctagggaaactacgttcggaacggaaacccggaaccgtaccggttaacctttaaagttaacgtttagttcggtaacgtaccgggaaaggtaaaacgtaaaccttaaaactttccccgttaaaccttaaagtaactttaaaccggttaacccggaaacgttaacggtaacgggttaaacgtttcgg

SEQ ID NO: 301290 - DNA, 619 bp, Homo sapiens
  misc_feature: GZ8MTXP02JAW1Q.39.31.C09.1.454.CMB.2.raw
tcagtcgcactagtcacgaccggtgctcgatttagacgtctcatcaaggaaggaaggggacccaaaaaccacacccctccttgggagaatcccctgagagctccgttcctcaccatggactggacctggaggatcgtcttcttggtggcagcagtcacaggagcccagtcccaggtgaacttggtgcagtcgtgggtttgaggtgaagagccgtgggcctcagtgaacggtcccctgccaggcttctggatacatcttcagcgcctattatatacacgtggtgcgccacggccccgtcggacgaaggccgtgaggttttttttttttggagtgggagtagtactaccgaaccccggacggaggtcggacgaacgaaacaaaataatacgaccacagagtatttacgaggacgcgggtacgaccagtacgacgtacggacgaccgtaccactaacaaaacaacgacctacatagtaagttacagtagacgtagaacgtaccaacgaccgacggaccgtacgtacttcgtgtcgacgagaggacgagtacgtaccgacgtagggaagtaagtcgacgtagttacgtaagttggtttgtagtgtcggtcgggacggtaacgg

SEQ ID NO: 301291 - DNA, 547 bp, Homo sapiens
  misc_feature: GZ8MTXP02JBYKH.39.31.C09.1.454.CMB.2.raw
  modified_base (263)..(263): a, c, t, g, unknown or other
  misc_feature (263)..(263): n is a, c, g, or t
  modified_base (291)..(291): a, c, t, g, unknown or other
  misc_feature (291)..(291): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccnggacagcctcctaagttgctcatttacnggcatcgtacccgggagtccggggtcctgaccgattcagcgcaggcggtctgagacagtatttcactctcaccatcagcagccctgcagctgaagatgtggctagtttatactgtcagtcagttattatagttacgtcctacgagtacgttttcggggacccgggggtaaccgagtccgtagggagacgttacgaaaacgtaacgtagtacggacgtcgaacctaccaacgttctagttccttactactttccccg

SEQ ID NO: 301292 - DNA, 652 bp, Homo sapiens
  misc_feature: GZ8MTXP02HJ5VO.39.31.C09.1.454.CMB.2.raw
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagcgtgggtgcgacaggcccctggacaagggcttgaggtggagtggggatggatcgagactaaacgttaaaagtagggaaaacaacgtaaaagtacgtagactaactaattaaagtttcccgaagggtccaaggtaacgtaccaagtacctaagtacgaaacccaacgaacgaaacccaacacgtacccgaaacgacgaccaaccgtacgtacccttaacgacgttacggaaaccgttagggaacggtaaaccgtgaacggtactacgtagaccgaaccgtacggtacctttagttacttagttgacgagaacgacgtaaactaacttcccttacttaacaattaacgtaaccgacgtaagtaggtaacgttagtttac

SEQ ID NO: 301293 - DNA, 638 bp, Homo sapiens
  misc_feature: GZ8MTXP02IDTHL.39.31.C09.1.454.CMB.2.raw
  modified_base (427)..(427): a, c, t, g, unknown or other
  misc_feature (427)..(427): n is a, c, g, or t
  modified_base (467)..(467): a, c, t, g, unknown or other
  misc_feature (467)..(467): n is a, c, g, or t
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagcgtgggtgcgacacggcccctaggacgaagggcttggaggtggagtgggatggatcgagactacttaacgaaagtaggaaaacactaaagtactagacaactaattaaactttccgaggggtaccaagacgtacatacatacgaacccaanacgaacactactacccgaacgacgctaacctcgccctaanagtacggtaacgtacggtaaacggaacctgaacgtacgtacgtacgaaccgaaccgtacgtacctttaagttaacgtttaacgttggtagacggtaaacgaacttaaacctaaactttccccttaacttaaactacgttaacttaaccgagttaagtacggtaaagtttcg

SEQ ID NO: 301294 - DNA, 646 bp, Homo sapiens
  misc_feature: GZ8MTXP02G81VD.39.31.C09.1.454.CMB.2.raw
  modified_base (300)..(300): a, c, t, g, unknown or other
  misc_feature (300)..(300): n is a, c, g, or t
  modified_base (442)..(442): a, c, t, g, unknown or other
  misc_feature (442)..(442): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgaggagggccaccatcaactgcaagtccagccagagttgtttacacaggtccaaacaataagaattacttcgcttggtaccagcaagaaaccaggacagcctacctaagttcgctctatttacgngggactacgtccgtacccggggacggtccccggggtccctcggacccgtattcgacggtcggcgaggtcgggtcctggacgacagtactttccacttctaccactactcgacgcacgcccgtgaccgaggtctaaggaaagngttggtacggtacgttaaggtttacttacgtgtaccgaagtacgtaagtttattaagtacggtacgttccctagtaggttacggtttcgggggacccggggtaactacggtcgtagggacgtaactaaccggtaaaacggtacgttggtacggtactacggaaccgacctacgttcgttacgttcctttactaccgtttccccg

SEQ ID NO: 301295 - DNA, 712 bp, Homo sapiens
  misc_feature: GZ8MTXP02FLAZW.39.31.C09.1.454.CMB.2.raw
  modified_base (239)..(239): a, c, t, g, unknown or other
  misc_feature (239)..(239): n is a, c, g, or t
  modified_base (278)..(278): a, c, t, g, unknown or other
  misc_feature (278)..(278): n is a, c, g, or t
  modified_base (312)..(312): a, c, t, g, unknown or other
  misc_feature (312)..(312): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatgacccagtcctccagacctccctggctgtgtctcgtgggcgaggacggccaccatcaactgacaacgtccagccagtagttgtttacacgacgtaccaaanaataagtacttactcgacttggaccagacaacgaaaccnggacacgtcctacgtaagtcgctactatttacgnggactacgtccggtacccggggtacggtcccgggtccctacggaccgtacgttcgacggccggacggacggtcgggtaccgtaggaacgtactacgttacttccaccttccgacctaacctatccgaacgcgtaaccgccgtcgacgtaccgggtacgaaggtaaaggtagttaggtacggttaactttaagttttaacgtaaccgtgtaaacgtacggtaagttaagttaagttaacgttaacggttaccgttaccccgttaggtaaacgggtttaccgggtttaccggggacccgggggaacctaagggtcgtaagggaactaacgaaaccgaaaccggttagtcggtacgtctacgtaacccacttacgttctacgttcctaccgtacctttccccg

SEQ ID NO: 301296 - DNA, 642 bp, Homo sapiens
  misc_feature: GZ8MTXP02FRCKU.39.31.C09.1.454.CMB.2.raw
  modified_base (294)..(294): a, c, t, g, unknown or other
  misc_feature (294)..(294): n is a, c, g, or t
  modified_base (354)..(354): a, c, t, g, unknown or other
  misc_feature (354)..(354): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggacccagcaagaaaccagacagcctcctaagttgctctatttacgnggcatccgtacccggggacgtcccggggtccctgaccgtatcgagcgcaggcggtctganacagtacttcactctcacatcagcagcctgacgaggctaggaagtgtagtcggtacttaagttttacttaacgtgtaccgagtacgtaagtttagtttaagttaacggtttaccgtaccgttacgttaaacgggtttaccgggtttttaccgggggaacccgggggtaaacccgtaaaagggtccggttaaagggaacggtaaacgtaaaccgtaaaacccggttacggttacggtcggtacttacggaacctaccgtacttcgtcgtttactacctactttcccccg

SEQ ID NO: 301297 - DNA, 553 bp, Homo sapiens
  misc_feature: GZ8MTXP02I0X7K.39.31.C09.1.454.CMB.2.raw
  modified_base (424)..(424): a, c, t, g, unknown or other
  misc_feature (424)..(424): n is a, c, g, or t
  modified_base (446)..(446): a, c, t, g, unknown or other
  misc_feature (446)..(446): n is a, c, g, or t
  modified_base (491)..(491): a, c, t, g, unknown or other
  misc_feature (491)..(491): n is a, c, g, or t
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagctgggtgcgacaggcccctggaccaagggcttgagtggatgggatggatcagcaacttaaaagtggaaacacaaagtatgacacaattaacttccgagggcagagtacagtcatgaccacagacacactccagacgcactcgacctangtacgaactgaacggacctganatcgagacgacgacggtccttaatattattagcgtacgaaggtanaacttaaacttaccctacttaacaattaacgtaacgtacgtagtacgtaaggttactttaac

SEQ ID NO: 301298 - DNA, 669 bp, Homo sapiens
  misc_feature: GZ8MTXP02JL3ZR.39.31.C09.1.454.CMB.2.raw
  modified_base (195)..(195): a, c, t, g, unknown or other
  misc_feature (195)..(195): n is a, c, g, or t
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactcccaggttcaattggtgcagtctgganctgcggtgaagaggcctggggcctcagtgaacgtctcctgcaaggcttctggttacacttttagctagttatggtgtcagctgggtgcgacaggcccctggacagggctgagtggatgggatggatcgagcacttacaatggaaaacacgtaaagtatagacactaattaacgtttaccgaggggactaaggtagttaccaagttacagttacggaacccaacaacggaaccaacacgttacccaacggacgacctacgtccgacccttaacaagtacggtaaacgacggaacggtaacctagggaactacgtacctaggaaccgaccgtaaccggtacctttaaattaacgtttagttacggttaggaaccggtaggtaaacgtaaccttaaaccgtttacccgttacccttaaacgtaacgtttaaacttaacccgggtaagtaaccgtttacggggtaaacgttttaaccg

SEQ ID NO: 301299 - DNA, 557 bp, Homo sapiens
  misc_feature: GZ8MTXP02JIPD5.39.31.C09.1.454.CMB.2.raw
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtgcgacaggcccctggacaagggcttgagtggatgggatggatcagcacttacaataggaaacacaaagtatagacactataatttccgaggggtcagagtcatcatgaccacagacacatcccgaagacgcactcgacctacataggaactggaagaaccctggaatacgtccgagtaaccggacaccggtacttaactatttacgttggtgacgtaagaacgtaactaaaacttcctaccttaacaattacttacggacgtattaggacgtttag

SEQ ID NO: 301300 - DNA, 571 bp, Homo sapiens
  misc_feature: GZ8MTXP02JR6PT.39.31.C09.1.454.CMB.2.raw
  modified_base (394)..(394): a, c, t, g, unknown or other
  misc_feature (394)..(394): n is a, c, g, or t
  modified_base (427)..(427): a, c, t, g, unknown or other
  misc_feature (427)..(427): n is a, c, g, or t
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacctttacaactatggtatcagttgggtgcgacaggcccctggacaggcttgagtgagtgggatggatcagcgcttacaagtggtcacacaaactatgacacagaacctcagggcagagtcaccatacgaccacacgacacanccacgagcacggctacatcgacctagacggacnccgtagacgtacgctagaaccgactaccgggccgttagttaacttacgtggttacggacggagaggtaaggtacggggtaaaattcttttacggacgttcgtacccttagtttacgaacgtttacggcgggaccgtaaccgggg

SEQ ID NO: 301301 - DNA, 601 bp, Homo sapiens
  misc_feature: GZ8MTXP02G4LOK.39.31.C09.1.454.CMB.2.raw
  modified_base (411)..(411): a, c, t, g, unknown or other
  misc_feature (411)..(411): n is a, c, g, or t
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggtcttctggttactacttttagctagttatggtgtcagtcgtgggtgcgacacggcccctggacagggcttggagtggagtggggatggatcgagctacttacgaagtaggaaacacaaacgtatagacaactattaacgttccgagggtacagacgtacatcatacgacanacgaacacgactacccgacgacgacacgtcgacctaacgagtacggaacgtaggaacgtactaggacgtatcgtaggaaccgacgtacggtacctttaagtacgtttagtcggtagacgtaaagaacgtaaccttaaaaccttcccttaactaacgtataaacgttacgacgtacgtaggtaacgtttcg

SEQ ID NO: 301302 - DNA, 702 bp, Homo sapiens
  misc_feature: GZ8MTXP02J2VMK.39.31.C09.1.454.CMB.2.raw
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggtcttcgtggttactacttttagctagttagtggtgtcgagtcgtgggtgcgacgacggcccctaggacgaaggtcttggagtggagtgggatggatcgagtcacttacaagtacggaaacaacgtaaagtactagactaacgtaattaacgtttaccgagggggtaccaaggtacgtactactacgtaataccggaaaccctaaacgaacgaacctaacctaacgacccaacgggacacccgtacgttaccggacccttaacgaacggttacggaaacgtacgggaacggtaaacccgttggaacgttacgaccgtaacggaacccgtacgtaaccggttaccttaaagttacgtttagtcgggttacgacggtaaagtaaccggtaacgtaaaccgtttccccttaaacctaacgttaacgttaacgttaccggtaaacgtaggtaacggtacgttttacg

SEQ ID NO: 301303 - DNA, 581 bp, Homo sapiens
  misc_feature: GZ8MTXP02HAEFD.39.31.C09.1.454.CMB.2.raw
  modified_base (292)..(292): a, c, t, g, unknown or other
  misc_feature (292)..(292): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctcctaagttgctcatttacgnggcatccgtacccgggaggtccgggtcctgaccgtatcagcgcgaggcggtcctgacgacagtattcactctcacatcagcacgcctgacgacggctagaagtagtggtggacttaagtttacttacgtgtacagtacgtagttattaagtagtacgtcctacgtacgttacgtttcggggaccggggtaacaaggtcgtagggacgtaacgtaaccgtaaaacgtaacgtacggtacggtactacgaaccgtaacctacgttcgttacgttaccttacgtacttcccg

SEQ ID NO: 301304 - DNA, 546 bp, Homo sapiens
  misc_feature: GZ8MTXP02I5NLP.39.31.C09.1.454.CMB.2.raw
  modified_base (282)..(282): a, c, t, g, unknown or other
  misc_feature (282)..(282): n is a, c, g, or t
  modified_base (394)..(394): a, c, t, g, unknown or other
  misc_feature (394)..(394): n is a, c, g, or t
  modified_base (422)..(422): a, c, t, g, unknown or other
  misc_feature (422)..(422): n is a, c, g, or t
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagctgggtncgacaggcccctggacaagggcttgagtggatgggatggatcgagcacttacaatggaaacacaaaagtatgacacgtataactttccgaggggcagagtcatcatgaccanagacacatccacgagcactcgaccctanataggaacctggaacgaacctagagagtcgtagacgacgacggtactatattacgtgtgacgaagacgactaaacgtttccctacttaactaacttaactaacgacgtagtacggaagtttacg

SEQ ID NO: 301305 - DNA, 612 bp, Homo sapiens
  misc_feature: GZ8MTXP02HR8LN.39.31.C09.1.454.CMB.2.raw
  modified_base (294)..(294): a, c, t, g, unknown or other
  misc_feature (294)..(294): n is a, c, g, or t
  modified_base (302)..(302): a, c, t, g, unknown or other
  misc_feature (302)..(302): n is a, c, g, or t
  modified_base (405)..(405): a, c, t, g, unknown or other
  misc_feature (405)..(405): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtagttttacacaggtaccaaacaataagtaattacttcgcttaggtaccagacaagaaaccaggacagccctacctaagttgctnatttacgngggcactccgtacccggggacgtcccggggtccctaggacccgattcaaggcggacgaggcgggtccctggacgacagtactttccactcctccaacatcaanccagccctgacgaggcgtagagatggtacggtcttaagtttattactgtacagtacatttattagtagttacgtcctacgtacggttacggtttcggggacccggggtacctaaaggcgttagggaacgtacgtaacgtaaaaccggtaccgttgggtacggacctggaacctaccctagtcttacgtccttactacctttcccccg

SEQ ID NO: 301306 - DNA, 591 bp, Homo sapiens
  misc_feature: GZ8MTXP02FFHVO.39.31.C09.1.454.CMB.2.raw
  modified_base (306)..(306): a, c, t, g, unknown or other
  misc_feature (306)..(306): n is a, c, g, or t
  modified_base (325)..(325): a, c, t, g, unknown or other
  misc_feature (325)..(325): n is a, c, g, or t
  modified_base (343)..(343): a, c, t, g, unknown or other
  misc_feature (343)..(343): n is a, c, g, or t
  modified_base (352)..(352): a, c, t, g, unknown or other
  misc_feature (352)..(352): n is a, c, g, or t
  modified_base (369)..(369): a, c, t, g, unknown or other
  misc_feature (369)..(369): n is a, c, g, or t
  modified_base (392)..(392): a, c, t, g, unknown or other
  misc_feature (392)..(392): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgagagggccaccatcaactgacaagtccagccagtacgttgttttacacacggtaccaaacaataagtaattacttcgcttagacccagcaagaaaccaggacagcctaccgtaagttgactcatttacgngggcacgtccggtaccggngtccggggtcctgaccgntcgagcggnacggcggtcctgagacngtacttcacttcacacatcacgnacgctgcgagcagagatgaggtactagtttatacgtgtacagactagtaattagtaacggttactccgtacgtaacggttacgtttcggggacccggggaactacggacgttaggaacgtaactacgaaaaccggtacgtaggttcggcttacgaacctaaaccgtactccgttagttccctaactacctttcccccgg

SEQ ID NO: 301307 - DNA, 511 bp, Homo sapiens
  misc_feature: GZ8MTXP02JJ4HX.39.31.C09.1.454.CMB.2.raw
  modified_base (322)..(322): a, c, t, g, unknown or other
  misc_feature (322)..(322): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttacacaggtccaacaataagaattacttcgcttggtaccagcagaaaccaggacagcctctaagtgctcatttactggcatctaccgggagtccggggtcctgacccgnttcagcgcaggcggtcctgagacagattcatctcacatcagcacgctgcaggctgagatgtggactagtttatactgtacagtcagttattatagtagtcctacgagtacgtttgggaccggggtacaagctaggagatacgaaacgactcgtaggcctagaacctacgactcgtgtcttacacttccc

SEQ ID NO: 301308 - DNA, 567 bp, Homo sapiens
  misc_feature: GZ8MTXP02HRQE7.39.31.C09.1.454.CMB.2.raw
  modified_base (297)..(297): a, c, t, g, unknown or other
  misc_feature (297)..(297): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccaacggggacatcgtgatgacccagtctccagactccctggctgtgtctctgggcgagagggccaccatcaactgcaagtccaaaccagagttgttttatacagttccaaacaaataaaaactacttagcttggcaccagcaagaaaccaggacagcctcctagagtgctcatttacngggcatctaccccgggaatccggggtccctgaccgattcagtgcagcgatctgggacagtatttcaactctacacatcagcagccctgcaggctgaagatgtggactagtttatactgtacaccaattattaataatactactactacgtacgtttaggaccgtaagggtaacccaaagtaccgtacggaagtactaccgaaaacgtaaacgtaggtacggtacgtacgaaccgtacctaacgtccttacgttaccttactaacttcccg

SEQ ID NO: 301309 - DNA, 569 bp, Homo sapiens
  misc_feature: GZ8MTXP02H85L3.39.31.C09.1.454.CMB.2.raw
  modified_base (382)..(382): a, c, t, g, unknown or other
  misc_feature (382)..(382): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccaacggggacatcgtgatgacccagtctccagactccctggctgtgtctctgggcgagagggccaccatcaactgcaagtccaaccagagttgttttatacagttaccaaacaaataaaactacttaagcttggcaccagcagaaaccaggacagcctactagagtgctacatttactgggcatccgtaccccggggaatccggggtccctgacccgattcgagtgcagcggatcgtgggacagtattcactctcaccatcancagcctgcaggctagaacgagttgtaggtctagttactttactgttaccaactaaattatttaattaactactacctacacgttactttggaccgtaacggggactaagcgtaggacgtaactaacgaaaacgtactaggtacggtactgaaccgtaccacttccgttagtccttactaccttcccg

SEQ ID NO: 301310 - DNA, 540 bp, Homo sapiens
  misc_feature: GZ8MTXP02G6726.39.31.C09.1.454.CMB.2.raw
  modified_base (297)..(297): a, c, t, g, unknown or other
  misc_feature (297)..(297): n is a, c, g, or t
  modified_base (334)..(334): a, c, t, g, unknown or other
  misc_feature (334)..(334): n is a, c, g, or t
  modified_base (398)..(398): a, c, t, g, unknown or other
  misc_feature (398)..(398): n is a, c, g, or t
  modified_base (492)..(492): a, c, t, g, unknown or other
  misc_feature (492)..(492): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgtttacacaggtccaaacaataagaattacttcgcttggtacccagcaagaaaccaggacagcctacctaagttcgctcatttacngggctatcgtacccgggagtcccgggtcctgaccgtntcagcggcaggcggtctgagacagtattcactctcacatcagcagcctagcagctagaagatgnggtctagtttatacgtgtacagactaagttacttaagttagtacgttccctagtaggttacgtttcggggaccggggtaaccaagtcgtagganatacaaagtagtcgacgctagccgtacacgttctgtcttcactttccc

SEQ ID NO: 301311 - DNA, 510 bp, Homo sapiens
  misc_feature: GZ8MTXP02F9DXI.39.31.C09.1.454.CMB.2.raw
  modified_base (386)..(386): a, c, t, g, unknown or other
  misc_feature (386)..(386): n is a, c, g, or t
  modified_base (389)..(389): a, c, t, g, unknown or other
  misc_feature (389)..(389): n is a, c, g, or t
  modified_base (428)..(428): a, c, t, g, unknown or other
  misc_feature (428)..(428): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagaggccaccatcaactgcaagtccagccagagtgtttacacaggtccaaacaataagaattacttcgcttggtaccagcaagaaaccaggacagcctcctaagttgctcatttactgggcatcctaccgggagtccggggtccctgaccgattcagcgcagcggtctgagacagattcactctcacatcagcagcctgcaggctagaagntgngactagtttatactgtcagcagttattatagtagtcctnagtacgtttgggccggggaacagcgtaggagatacgaaaacgtacgtgtacggctgaacctacatcctgtactcacttcccg

SEQ ID NO: 301312 - DNA, 610 bp, Homo sapiens
  misc_feature: GZ8MTXP02IAZ0F.39.31.C09.1.454.CMB.2.raw
  modified_base (432)..(432): a, c, t, g, unknown or other
  misc_feature (432)..(432): n is a, c, g, or t
  modified_base (443)..(443): a, c, t, g, unknown or other
  misc_feature (443)..(443): n is a, c, g, or t
  modified_base (470)..(470): a, c, t, g, unknown or other
  misc_feature (470)..(470): n is a, c, g, or t
tcagtcgcactagtcacgaccggtgctcgatttagacgtctcatcaaggaaggaaggggacccaaaaaccacacccctccttgggagaatcccctagatcacagctcctcaccatggactggacctggagcattccttttcttggtggcagcagcaacaggtgcccactcccaggttcaattggtgcagtctggagctgcggtgaagaggcctggggcctcagtgaacgtctcctgacaaggtcttctggttactacttttagctagttagtggtgtcagcgtgggtgcgacgacggcccctggacaaggggtcttggagtggagtggggatggatcgagactacttacaaagtaggaaaacacgaaagtagtacgactaacgtaattaacgtttccggagggtacaagtacgtacattcgaatcgaaccanacgaacactancccaacgagacctacgtcgaccctaanacgtaggaactaggaacgtacctaggaagtactacgtacgaacgacgtaccggtactttaataacgttgttacggtcgacgaagaacgtaactaactttccacttaactattaacgtacgaacgtagtacggtaatttcg

SEQ ID NO: 301313 - DNA, 703 bp, Homo sapiens
  misc_feature: GZ8MTXP02JLAUY.39.31.C09.1.454.CMB.2.raw
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcagtgaacgtctcctgacaaggtcttcgtggttactacttttagctagttatggtgtcagcgtgggtgcgacacggcccctaggacgaacggggtcttggaggttggagtggggatggatcgagctacttaacaagtacggaaaacacgtaaagtatagactaactaagttaacttaccgagggggtactaaggtaacgtactaacttacgaaacgtaccggaaaccctaaaccgaaggaaacccaactaaaccgtaccccgaaacggaccaaccgtaccgttacgaaccctaacgtaaggtaaccggaaacgttaacgggaaccggtaacccgtaggtaacgtaacgttccgacggaaaccgtaacgtacccgggttaacctttagtaaacgtttacgttaggtacggtacgaaacggtactaaaacgttaacttaccccttaataaccgtaattacgtaacgatacgtacgtaagtttacg

SEQ ID NO: 301314 - DNA, 667 bp, Homo sapiens
  misc_feature: GZ8MTXP02I8GVN.39.31.C09.1.454.CMB.2.raw
  modified_base (418)..(418): a, c, t, g, unknown or other
  misc_feature (418)..(418): n is a, c, g, or t
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactactttagctagttatggtgtcagcgtgggtgcgacgacggcccccgtaggaccaagggtcttggaggtggagtggggatggatcgagcaacttacaagtaggaaaactacgaaagtatcgacaactattaacgttccgagggtcaggtagtacatcatagacccanacgacacactcccgaagacgtacaccgtacgaccctacgaagtacggaaacgttacggaaaccggtaacccttagggaacgtacgtaccgtacggaacccggtaaccgtaccggttacctttaagtaagtttaacgttaggtaaggaccgtaaaaggtaaacgtaaccgttaaaaactttccctaacccttaaacgttaacgtttaaacgttaaccggtaaccgtaagtaacggggtaaacttttacgg

SEQ ID NO: 301315 - DNA, 648 bp, Homo sapiens
  misc_feature: GZ8MTXP02GHOU2.39.31.C09.1.454.CMB.2.raw
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactcccaggttcaattggtgcagtctgaagctgcggtgaagaggcctggggcctcagtgaacgtctcctgcaaggtcttctggttactacttttagctagttatggtgtcagctgggtgcgacacggcccctggacaagggcttgaggtggagtggggatgggatcgagtacaacgttacaaagtaggaaaactacgaaaagtatacgacaactaattaacttaccgaggggtacaaggacgttacagtactagtacgaacccacaacgaccaacactacccgagacgacacttcgacccttaacgagttacggaaacctaggaacgaacccgtaggaacgtacgtcgtagaaccggaacctaccggttaccttaagtttaactttacgttagggttacacggttaaacgactaaaccgtaaactttccccttaacttaactaacgttaacgttaaacgaccgtagtaacgggtaatttaccg

SEQ ID NO: 301316 - DNA, 730 bp, Homo sapiens
  misc_feature: GZ8MTXP02F90TD.39.31.C09.1.454.CMB.2.raw
  modified_base (278)..(278): a, c, t, g, unknown or other
  misc_feature (278)..(278): n is a, c, g, or t
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtggggcctcgagtgaacgtctcctgcaaggcttctggttactacttttagctagttagtggtgtgngtcgtggtcgacgacgaccggcccgtaggacgtaggtcgtaggaggtggtaggtgggtagtaggtagtacgagtacctaacgttaaacgaaagtaaacggaaaactaaacgtaaagtagtaccgaactaacttaaacgtttaaccgttaacggacgggtaacgtaaaggtacgtactaacgtacgtacgtacgaaacccaaagaaccaaccaaacgtactaaccccgaaagcccgaacctaccgtacgaaccctaacgtaaacggtaaacgaccgtaagggtaaaccgtaaccggtaggaataaccgtcgaaacggaaccgtaaccgtaccggtttaaactttagttaacgtttaggtcgtacggaacgtaaaaggtaacgtaaaccttaaaccgttccctttaaactaaagttaacttaaccgaacggtaagtagtaacggtacgtttacg

SEQ ID NO: 301317 - DNA, 649 bp, Homo sapiens
  misc_feature: GZ8MTXP02GVKOZ.39.31.C09.1.454.CMB.2.raw
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagcgtgggtgcgacaggcccctggaccaagggcttggagtggagtgggatggatcgagcaacttaacaagtaggaaaacaacaaaacgtagtacgactaaactaagttaaacgtttccgagggggtaccaaggtacgttaccaagtcaaagtcgaaaccaacaacgaccaacactacccaacgacgactaccgtacgaccctaacgaagtacggaaacgttcggaaacggtacctaggtaacggtacttaccgaggaaccgaaccgtaccggtacctttaaagttaatttagttacggtacgacggtaaagaacgtaactaaactttaccctacttaacgtattaacgttacgacgtaaagtacggtaagtttacg

SEQ ID NO: 301318 - DNA, 754 bp, Homo sapiens
  misc_feature: GZ8MTXP02H6YCL.39.31.C09.1.454.CMB.2.raw
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactcccaggttcaattggtgcagtctggagctggcggtggaagaggccgtggggcctcgagtgaacgtctcctgacgaaggcttcgtggttactacgttttagctagttagtggtgtcgagcgtgggtcgcgacgacggccctggaacgtagggtcttggaggtggagtgggagtggatcgagctattaacaagtaggaaacaagtaaagtatacgacaactaacttaacgttacgaggggactaaggtacgtaccgattaccgaaagttcgaacccaagaacgaacctaaccgaactacccgaaaacggtacgaccctaacggtaccgtacctaaccgaaggtaacccgggtaaaacgtcgggtaaaacgggtaacccgtaagggaacgtacccggtttaacgaacggtaaaacccggacgtaaaacccccgggttattttaaaagtttaccgtttaggttacgttaaccgggaaacgggtaaacgttaaacggtaaaacccttaaaccggtttttcccttaacctttaaaagtacgtttaaaacggttaccgaaaggtaacggtttacgggttaaaacggttttccg

SEQ ID NO: 301319 - DNA, 622 bp, Homo sapiens
  misc_feature: GZ8MTXP02F4W3J.39.31.C09.1.454.CMB.2.raw
  modified_base (270)..(270): a, c, t, g, unknown or other
  misc_feature (270)..(270): n is a, c, g, or t
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggccgtgggcctcagtgaacgtctctgcagcttcgtggttactacttttagctagttatggtntgagcgtgggtgcgacgacggccccgtaggaccgaagggtcgttagaggtggagtgggtagtggatcgagctaacgttaacgaaagtaggaaaacaacgaaaaggtatacgacaactaattaaacgttccgagggtccagacgttacatactatacgaaccaacaacaacacaacgacccgaaacgacgacaacgtcacctacgagtacggaaactagggaacgtacctagagtacgtcgacgacgaacgacggttaccttaaatagtttagtgtagacgaaagtaacgtaaccttaaacgttcctaccttaagtaactttacgtaaacggtagtacgtaaggtaacgtttg

SEQ ID NO: 301320 - DNA, 543 bp, Homo sapiens
  misc_feature: GZ8MTXP02IUVH1.39.31.C09.1.454.CMB.2.raw
  modified_base (316)..(316): a, c, t, g, unknown or other
  misc_feature (316)..(316): n is a, c, g, or t
  modified_base (323)..(323): a, c, t, g, unknown or other
  misc_feature (323)..(323): n is a, c, g, or t
  modified_base (341)..(341): a, c, t, g, unknown or other
  misc_feature (341)..(341): n is a, c, g, or t
  modified_base (343)..(343): a, c, t, g, unknown or other
  misc_feature (343)..(343): n is a, c, g, or t
  modified_base (347)..(347): a, c, t, g, unknown or other
  misc_feature (347)..(347): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacgggacatcgtgatgacccagtctccagactccctggctgtgtctctgggcgagagggccaccatcaactgcaagtcagccagagtgtttacacaggtccaacaataagaattactcgcttggtacagcaagaaaccaggacagcctcctaagttgctcgatttactgggcatcgtacccggagtccgggtccngaccgtntcagcgcagcggtctgananagtnttcactctcacatcagcagcctgcagcagaagagtgtggactagtttactactgttacagcaagtattaactagtagtctcgtagtacgtttggacccgggactaaggcgttaggaagtataaccgaaaacgttaaagttcgtaaggttcgacgaaccgtaccctaattcgtacgttccttactaacgtttccccg

SEQ ID NO: 301321 - DNA, 586 bp, Homo sapiens
  misc_feature: GZ8MTXP02GYY14.39.31.C09.1.454.CMB.2.raw
  modified_base (399)..(399): a, c, t, g, unknown or other
  misc_feature (399)..(399): n is a, c, g, or t
  modified_base (422)..(422): a, c, t, g, unknown or other
  misc_feature (422)..(422): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagttgtttacacaggtaccaaacaataagaattacttcgtcttggtaccagcaacgaaaccaggacagccctacctaagttgcctctaatttacgtggctactccgtaccccgggtagtccccggggtcctggacccgtattcgagtcggacaggcggtcctagagacgtagtactttcactctcaacctntcagtcacgcctgcgagctaganagtgtgacttagtttatactgtacagtacgtattagtttagttagtacgtccttagacggtttaccgtttacggggacccgggggtaacgtagacgttaggacgtataacgaaacgtacgtgacggtctacgaaccacgattcgtgttacctctactttccccg

SEQ ID NO: 301322 - DNA, 603 bp, Homo sapiens
  misc_feature: GZ8MTXP02FHGUM.39.31.C09.1.454.CMB.2.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttacacaggtccaacaataagaattacttcgcttggtaccagcaagaaaccaggacagcctcctaagttgctctatttactgggcatccgtacccgggaggtcccggggtccctaggacccgattcgagcggcaggcgggtcctgagacagtattcactctccaccatcagcagcctgcgaggctagaagagtgtaggcttaaggtttattacgtgtacagacgtaagttattattacggttactccccttagtaacggtttcggtttacggggacccgggggtaacctaacgggtacgtaggacgtaagtaaccgaaaaacggtaccgtggttacgggaccttacggaaccaacccgtagtccgttgttaccttacctactttccccg

SEQ ID NO: 301323 - DNA, 578 bp, Homo sapiens
  misc_feature: GZ8MTXP02JRKOY.39.31.C09.1.454.CMB.2.raw
  modified_base (299)..(299): a, c, t, g, unknown or other
  misc_feature (299)..(299): n is a, c, g, or t
  modified_base (361)..(361): a, c, t, g, unknown or other
  misc_feature (361)..(361): n is a, c, g, or t
  modified_base (396)..(396): a, c, t, g, unknown or other
  misc_feature (396)..(396): n is a, c, g, or t
  modified_base (402)..(402): a, c, t, g, unknown or other
  misc_feature (402)..(402): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagtgtttacacaggtccaaacaataagaattacttcgcttggtaccagcagaaaccaggacacgacctcctaagttcgctacaatttacgngggcatcgtacccggggagtcccggggtccctgacccgattcgagccggcaggcgggttccngagacgtagtctttacacttctacaccgatcgacncgagcngcgagcagagtgtgtgtactagttatagtcgtacgagtatagttattagtacgtactctacgtacgttacggttacgggaccgggtacagtacgtacgacgtacgtaaccgaaagtacggtcgtacgtcgacgtaaccgtaccgtacgttacgttcgtaccttacgtaccttcccg

SEQ ID NO: 301324 - DNA, 624 bp, Homo sapiens
  misc_feature: GZ8MTXP02JI4TA.39.31.C09.1.454.CMB.2.raw
  modified_base (362)..(362): a, c, t, g, unknown or other
  misc_feature (362)..(362): n is a, c, g, or t
  modified_base (470)..(470): a, c, t, g, unknown or other
  misc_feature (470)..(470): n is a, c, g, or t
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcgagtgaacgtctcctgcaaggcttcgtggttacacttttagctagttatggtgtcagcgtgggtgcgtacgacggcccctagggacaaggggctttgaggtggagtgggatggatcgagctacgttacaagtagaaaccaanaaagtagtgacaatattaaacttccgaggggtacaaggtacgtcaactactagtacgaccaacgaacgaacaacgactacccgaacgacgactacgtacgaccctaanaacgtacggaaacgtacggaacgtaaccgtagaagtactcgaacggaacgactaccggtactttagtaatttgtacgtagacgtagaacgtaactaaacttcctaccttaactaagttaacgttacggaacgttagtaacgggtaacgtttacg

SEQ ID NO: 301325 - DNA, 666 bp, Homo sapiens
  misc_feature: GZ8MTXP02F791H.39.31.C09.1.454.CMB.2.raw
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaaggaggccgtggggcctcagtgaacgtctcctgcaaggtcttcgtggttactacttttagctagttatggtgtcgagtcgtgggtgcgacgacggccccgtggacgagggctggaggtggagtgggagtggatgacgtctaactttaacaaagtacggaaaacaacgtaaaaggtatagaccaacgtaattaaacgtttacccgagggggaccaaggtacgtactaacgtacaacgtacgaaacccagaaacgaacaccgaactacccgaacgtacgaccgaactcgaccttaacgaagtacggaaacgtacggaacggtaacctaggaagtactacgtacgaaccgaaccgtacggtactttaacgttaagtttattggtacgaacgtaaggaacgtaacctaaaactttccctaacttaacgtaacttacgttaaacgacgtaagtacggtaagtttacg

SEQ ID NO: 301326 - DNA, 699 bp, Homo sapiens
  misc_feature: GZ8MTXP02FNBY5.39.31.C09.1.454.CMB.2.raw
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatggggatggatcagcgacttacaatggtacacaacaaaactactgaccacacgaaccctccgaaggggccaaggacgtccaacccgatcgaacccacaacgaccaaaccaactacccgaacgacgacccgaaccgggaccctaaacgacgtacgggtacccgtaggaacgggacgaccgttaggacgtacgtacgtacggaaccggaaccggacccggggtccgtagttaacgtttaccgtaggttacggacggtaagggtaacggtaaacggttaaccggggggttaaaatttaacgtttttacggtaaaccgtttaaccgggtttaacccccgtttcgttttacggaccgtttaccggtaccgggggtacccgtaaacccggggg

SEQ ID NO: 301327 - DNA, 706 bp, Homo sapiens
  misc_feature: GZ8MTXP02JEBAN.39.31.C09.1.454.CMB.2.raw
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcgagtgaacgtctcctgcaaggtcttcgtggttactacttttagctagttagtggtgtcgtagcgtagggtgcgacgacggccccgtaggaccgtaaggccgttggaggtggagtagggagtggatcgagctaacttacgaagtacggaaaactaacgtaaacgttatagactaacgttaacgttaaacgttcccggaggggactaaggtaacgtaccgtacgtactaacgtacggaaacccacgaacgaaccaactacgaccgacgacgtaccgacgtacacccgtagacggtaaacgtaacgtacgggaaacgtaccctagggaacgtacgtacggtacgaaaccggaccgttacggttacctttaaagtacgtttagtaccggtaggacgtaaacgggaaacttaaccgtttaaacttccccgttaaccttaaacgtacgttaaaccgtttacccggaagtaacggttacggtaacttttaacg

SEQ ID NO: 301328 - DNA, 698 bp, Homo sapiens
  misc_feature: GZ8MTXP02IR4LQ.39.31.C09.1.454.CMB.2.raw
  modified_base (306)..(306): a, c, t, g, unknown or other
  misc_feature (306)..(306): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctccctggctgtgtctcgtgggcgaggaggcccaccatcaactgcaacgtccagccagtagttgtttacacaggtaccaaacaataagtaattacttgtcttcggtaccagcaagaaaccaggaacacgcctctaagttcgctctatttacgnggactatcccgtacccgggaggttccccggggtccctcggtaacccgtacgttccgacggccggccgacgggtcgggttaccgtagacgactacgttactttcccaacttccctcaaccctagtccgacgtacaccggtccctcgacgtacgggtaacgtaggaaagtaggtaggtccgggtacgttaagtttttaactacgtacgttgaacggttacgttaagtttacgtttaagttacggttaaccgttaccgttacgttaacggtttaccggggttttacgggggtacccgggggtaaacccaaggggttcccgtagggtaagtaacgtaaccgaaacgtagttcggacgtctacgcctaccgtatacgttctaccttactccgttccc

SEQ ID NO: 301329 - DNA, 775 bp, Homo sapiens
  misc_feature: GZ8MTXP02H0C56.39.31.C09.1.454.CMB.2.raw
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaaggaggccgtggggcctcgagtgaacgtctccgtgacgaaggtcttcgtaggttactacttttagctagttagtggtgtcagcgtgggtgcgacgacggccccgtaggacgagggtctaggaggtggagtaggggagtggactacgagtactaacgttaacgaaagtaacggaaaactaacgtaaagtatacggacaacgttaattaaacgtttacccggaggggtacctaaaggtacgtactaagttacaaacgtaccggaaaccaacgaaccggaaccaacgtaaccgaacccgaaacggtacccgaacctacgtaaccgtaccctaaacgtaacggttacggaaaccgttaagggaaaccggtaacccgttaggaacgtaccgtacggtaaaccgtaaccggtaaaccgttaacccggttactttaaacgtttaacgtttaacggtacggttacggtaaacgtaaacggtaaaaccgttaaaccgttaaaacctttcccgttaaaccttaaaccgtaacgtttaaacgtaacggtaaaccgtaggtttaacggtttaacggtttaccg

SEQ ID NO: 301330 - DNA, 602 bp, Homo sapiens
  misc_feature: GZ8MTXP02JPEAI.39.31.C09.1.454.CMB.2.raw
  modified_base (336)..(336): a, c, t, g, unknown or other
  misc_feature (336)..(336): n is a, c, g, or t
  modified_base (350)..(350): a, c, t, g, unknown or other
  misc_feature (350)..(350): n is a, c, g, or t
  modified_base (356)..(356): a, c, t, g, unknown or other
  misc_feature (356)..(356): n is a, c, g, or t
  modified_base (392)..(392): a, c, t, g, unknown or other
  misc_feature (392)..(392): n is a, c, g, or t
  modified_base (409)..(409): a, c, t, g, unknown or other
  misc_feature (409)..(409): n is a, c, g, or t
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagctagttatggtgtcagtcgtggtgcgacacggcccctggacaggcttgagtggagtgggatggatcgagcacttanaaagtaggaaacanaagtangacactataacttcgaggcagatcatcatacgacanacgacacgactaccganacgacacgtcaccttaagacgtacggaaacgttggaacgtaacgtagaagtactaccgtacggaacgaccggtaacccggtactttaaacgtagttttacgtaggttacggacgtaaacggaaacgttactaaaacctttcccttaaccttaagtaacgtttaacgaccgtaacgagtacggtaacgtttacg

SEQ ID NO: 301331 - DNA, 668 bp, Homo sapiens
  misc_feature: GZ8MTXP02JXDAU.39.31.C09.1.454.CMB.2.raw
  modified_base (314)..(314): a, c, t, g, unknown or other
  misc_feature (314)..(314): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctccctggctgtgtctcgtgggcgagagggccaccatcaactgcaagtccagccagtagttcgtttaacactaggtaccaaacaaataagtaactttacttcgtacttcggtacagacagaaaccaggacacgcctactaagttcgctactacgtttacgnggcacgttccggaccgggtacggtccggggtccctaggacccgtagttcaggtccggcgacggtcgggtccctaggacgacgtaagttactttaccgacttccaccgaactactcagcacgccctagcgagcgtagaagtgttggtacggtacttaagtttaactacgtcgtaccgagttacgtaaggtttattaggttacgttaccgtaccgttaacggtacggtttaaccgggtttcgggggaaccccgggttaacctaggccggtaaggaacgttacgtaaaccgaaacgtacgtggtaccgacgtacgaaccttaactacgttccttacggtactcgtacgtttaccccg

SEQ ID NO: 301332 - DNA, 569 bp, Homo sapiens
  misc_feature: GZ8MTXP02JJ8JT.39.31.C09.1.454.CMB.2.raw
  modified_base (149)..(149): a, c, t, g, unknown or other
  misc_feature (149)..(149): n is a, c, g, or t
  modified_base (402)..(402): a, c, t, g, unknown or other
  misc_feature (402)..(402): n is a, c, g, or t
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcngcagcaacaggtgcccactcccaggttcaattggtgcagtctggagctgcggtgaagaggcctggggcctcagtgaacgtctcctgcaaggcttctggttacacttttagcagttatggtgtcagctgggtgcgacaggcccctggacaagggcttgagtggagtgggatggatcagcacttacaatggaaacacaaagtatgcaacgtataattccgagggtacagacgtcatcaatcgaaccacgagacanactccacgagcactgacctacagtcggaactggaacgacctaggacgatcgtacgacgacacggacctttaagtattacgttagtgacgtaacggaactaacctaaaactttcccttaaccttaacctaagttaacgtaacccgaacgtacttacgggaaagtttcg

SEQ ID NO: 301333 - DNA, 629 bp, Homo sapiens
  misc_feature: GZ8MTXP02IXKUG.39.31.C09.1.454.CMB.2.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctccctggctgtgtctctgggcgagagggccaccatcaactgcaagtccagccagagttgtttacacaggtccaaacaataagaattactcgcttcggtacagcaagaaaccaggacagcctactaagttcgctactatttacgtcgggcagtccgtaccccggggagtccccggggtccctggaccccgtattcgaggtccggcacgggtcgggtcctggagactagtactttccactcgtacaccaacgtccacgcagccctagcacggtactaggaaagcgttggtcgtacgtttaaggttttaatacgtcggtactaggaccttaaggtttaatttacttaagggtaccttacccgtatacggttaccgtttacgggggccggggtaaaccaaggtccgtaaggagttaacacgtaaacgtacgtgtacggacttacgaaccgtactattcgtgttccttacgactttcccg

SEQ ID NO: 301334 - DNA, 632 bp, Homo sapiens
  misc_feature: GZ8MTXP02FX7XY.39.31.C09.1.454.CMB.2.raw
  modified_base (371)..(371): a, c, t, g, unknown or other
  misc_feature (371)..(371): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatgacccagtcctccagacctccctggctgtgtctcgtgggcgaggacgggccaccatcaactgacaacgtccagccagtagttgtttaacacgacggtaccaaataaataagtaacttacttcgtcgttggaacccagacaaacgaaaccaggacacgccctacgtagtcgctactatttacgcggactacgtcccggtacccggggcggttccccggggtccctagacccgtntccgacggcgcgacgggtcggtccgagggaccagtactttccaccttcctaccaccatcacgcaccgccctcgagtcgtaagagagtggtcgtactaagtttatacctgtacctaaactaattaacttaaagtaactccttactacgtacttacggttcggacggtaacgggactaaggacgtaggaagtaacaacgaacgtacgtggacgtactacgaactaccgtctacgtacttcgtacctctacccctaccgtaacc

SEQ ID NO: 301335 - DNA, 623 bp, Homo sapiens
  misc_feature: GZ8MTXP02FND7N.39.31.C09.1.454.CMB.2.raw
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttacacttttagctagttatggtgtcagcgtgggtgcgacaggcccctggacaagggcttgagtggatgggatggatcgagctacttacaagtaggaaaacacaaagtatagacacaataactttaccgagggcagagtacatcatcgaaccacagaccacactacccgacgacgtaccaaccgttcgaccttaacaaagtacggtaaacgttacgggaaacggtaacccgttaggaacgtactacggttagaaccgtaaccgtaccggtaaccctttaagttatttacgttggttagacgaaagtacgtaaactaaaactttcccttaacctttaacgtaacttaacttaccgaacgtagtaggtaacgtttacg

SEQ ID NO: 301336 - DNA, 560 bp, Homo sapiens
  misc_feature: GZ8MTXP02GQE8V.39.31.C09.1.454.CMB.2.raw
  modified_base (356)..(356): a, c, t, g, unknown or other
  misc_feature (356)..(356): n is a, c, g, or t
  modified_base (365)..(366): a, c, t, g, unknown or other
  misc_feature (365)..(366): n is a, c, g, or t
  modified_base (380)..(380): a, c, t, g, unknown or other
  misc_feature (380)..(380): n is a, c, g, or t
  modified_base (390)..(390): a, c, t, g, unknown or other
  misc_feature (390)..(390): n is a, c, g, or t
  modified_base (392)..(392): a, c, t, g, unknown or other
  misc_feature (392)..(392): n is a, c, g, or t
  modified_base (394)..(394): a, c, t, g, unknown or other
  misc_feature (394)..(394): n is a, c, g, or t
  modified_base (396)..(396): a, c, t, g, unknown or other
  misc_feature (396)..(396): n is a, c, g, or t
  modified_base (404)..(404): a, c, t, g, unknown or other
  misc_feature (404)..(404): n is a, c, g, or t
tcagtcgcactagtcacgaccggtgctcgatttagacgtctcatcaaggaaggaagggggacccaaaaaccacacccctccttgggagaatcccctagatcacagctcctcaccatggactggacctggagcatccttttcttggtggcagcagcaacaggtgcccactcccaggttcaattggtgcagtctggagctgcggtgaaggaggcctgggggcctcagtgaacgtctcctgcaaggcttctggttactacttttagctagttatggtgtcagctgggtgcgacaggcccctggacaagggcttggagtggatgggatgggatcagcaacttacaaagtaggaaaaccanaaaaggtannacatataattacgnggagagagananananacacacanacacacacacgacacacacactacagtagaacgacgaacgacgacgagagtacgtacgacgacgacgtacttaattaattagttagtagtacgagaacgaactaaacttaccttactaactaactaacgtaacgtaacgtacgtacgtaacgtacg

SEQ ID NO: 301337 - DNA, 709 bp, Homo sapiens
  misc_feature: GZ8MTXP02IG23Y.39.31.C09.1.454.CMB.2.raw
tcagtcgcactagtcacgaccggtgctcgatttagacgtctcatcaaggaaggaaggggcagcaagatggtgttgcagacccaggtcttcatttctctgttgctctggatctctggtgcctacggggacatcgtgatgacccagtctccagacctccctggctgtgtctctgggcgagagggccaccatcaactgcaagtccagccagagttgtttacacaggtaccaaacaataagaattacttcgcttggtaccagacaagaaaccaggacacgcctacctaagttcgcctactatttacgtgggctactcgtacccggggaggttcccggggtccctgacccgattccgaggcggcgaggcggtctgagactagtattccactcctacacatccagtcacgccctgcgacggtctaggaaacgtagttggtcgggtactttagtttttaacgttacgttacgtaccgtaaggtaccgttaaggtttaaattttacggttaaggtttaaccgttccccgttaacgttaaccgggtttacgggtttttccgggggaacccgggggttaacctaaaacgggtccgtaaggggtaaacggtacgttaaaccggtaaaaacggtaaccgttcgggttaaccggggtccttacggaacccgtaccgttaaacttcgttacccggtttactttacctacccggtttacccccg

SEQ ID NO: 301338 - DNA, 617 bp, Homo sapiens
  misc_feature: GZ8MTXP02JI5X8.39.31.C09.1.454.CMB.2.raw
  modified_base (421)..(421): a, c, t, g, unknown or other
  misc_feature (421)..(421): n is a, c, g, or t
  modified_base (441)..(441): a, c, t, g, unknown or other
  misc_feature (441)..(441): n is a, c, g, or t
  modified_base (456)..(456): a, c, t, g, unknown or other
  misc_feature (456)..(456): n is a, c, g, or t
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactcccaggttcaattggtgcagtctggagcgtggcggtgaagaggccgtgggggcctcagtgaacgtctctgcaaggcttctggttactacttttagctagttatggtgtcagctgggtgcgacgaggtcccctggacgaagggctttgaggtggagtggggatgggatcgagctacttacaaagtaggaaacacgaaagtatgacatattaacgttccgaggggcaaggtagtaccagtacaatcgaaccctanaacgaccaacatccacgacnctacgtcgaccctanacgtaggaacgtaggaccggtaacgtagtaacgagttacgtacggaacgaaccgtacgggtacctttaagtaacgtttagtttacggagtaccggaaggaactaacgtaaaacttcctacgttaactagttaacttaacgacgtaacgtaggtagtttacg

SEQ ID NO: 301339 - DNA, 722 bp, Homo sapiens
  misc_feature: GZ8MTXP02IS5VH.39.31.C09.1.454.CMB.2.raw
  modified_base (707)..(707): a, c, t, g, unknown or other
  misc_feature (707)..(707): n is a, c, g, or t
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccacctcccaggttcaattggtgcagtctggagctggcggtgaggaggccgtggggcctcgagtgaacgtctctgcaaggtcttctggttactattttagctagttatggtgtcagcggtgggtcgcgacacggtccccgtaggaccggtaagggcgtttcgtagggtcggtaggttaggggagtgggtagtccgtaagtaccgtaacgttaaacgaacgtaaggtaaaaaccgtaacgtaaaacgtacgttacgactaaaccgttaaagttaaaccgtttaccggagggggtaactacggtaacggtttacctacgtacgtaaacgggtacaaaacccgacgaaacggtaaaccaacgtactaacccgtacgaaccgtacctacggtacaccctacgtagtaaacggacgtacggtaacgggaccctaggtaaccgtagtccgacggttaacgaccgtaccggttactttacggttactttaggcgtttacgacgtaagaactacgtaacctttctacgtaataacgttacgtaacgtaacgngttacgacggtttac

SEQ ID NO: 301340 - DNA, 662 bp, Homo sapiens
  misc_feature: GZ8MTXP02JFCY8.39.31.C09.1.454.CMB.2.raw
  modified_base (321)..(321): a, c, t, g, unknown or other
  misc_feature (321)..(321): n is a, c, g, or t
  modified_base (351)..(351): a, c, t, g, unknown or other
  misc_feature (351)..(351): n is a, c, g, or t
  modified_base (359)..(359): a, c, t, g, unknown or other
  misc_feature (359)..(359): n is a, c, g, or t
tcagtcgcactagtcacgaccggtgctcgatttagacgtctcatcaaggaaggaaggggcagcaagatggtgttgcagacccaggtcttcatttctctgttgctctggatctctggtgccgtacggggacatcgtgatgacccagtcctccagacctccctggctgtgtctcgtgggcgaggacgggcccaccatcaactgacaagtccagccagtagttgtttaacacgaggtaccaaacaaataaagtaactttactcgtcttacggtaaccagacaacgaaaccgaggacacgccctactagttcgctctatttacgnggcacgtccgaccggacggtcccgggtccncgaccgtntcgagcggcacggtcgggtcctaggaacgactagttacttaccactctaccacctagtccacgacctacgtccgtcgacgtacggtacgtaaggaacgtagtcggtcggttaacgtttagtttactacgtgtaccgtagtattagtttaatacgttagtaccttaccgtagtacggtttaccggttacggggacccgggtaacagtcggttaaaggacgtaacctaaacggaaaacgtacgttcgggtaccgcgtacgaacccgtaacgttgtacccgtttctaccttacctaccgttccccg

SEQ ID NO: 301341 - DNA, 724 bp, Homo sapiens
  misc_feature: GZ8MTXP02GMICH.39.31.C09.1.454.CMB.2.raw
tcagtcgcactagtcacgaccggtgctcgatttagacgtctcatcaaggaaggaaggggacccaaaaaccacacccctccttgggagaatcccctagatcacagctcctcaccatggactggacctggagcatccttttcttggtggcagcagcaacaggtgcccactccccaggttcaattggtgcagtctggagctgcggtgaaggaggccgtggggcctcagtgaacgtctcctgcaaggtcttcgtggttactacttttagctagttagtggtgtcgagtcgtgggtgacgacgacggtccccgtaggaacgaagggtcgttaggaggttcgggaggtggggtagtgggactacgacggtacctaaacgttaacgaaagtaacggaaaacctaaagtaaacgttatacgtacctaacgttaacttaaacgtttaccgaggggtacctaaagggtacgtactaagttacgatacgaaccaacgtaacgaacaacgtaacctaccgaaacgaccgacgtacctacgacctaacgtaacggtacggaaacgttaaggaacggtaaccgtagggtaaacgtacgtaccgtaacggaccgtaaccggttaacggttacctttaagtttaacgtttagtttacgggacggtacgaaacgtaacgtaaccttaaacgttcccttaacttaacgtaacgttacgtacgtacgtagtacgtagtttacg

SEQ ID NO: 301342 - DNA, 619 bp, Homo sapiens
  misc_feature: GZ8MTXP02GL0FR.39.31.C09.1.454.CMB.2.raw
  modified_base (278)..(278): a, c, t, g, unknown or other
  misc_feature (278)..(278): n is a, c, g, or t
  modified_base (315)..(315): a, c, t, g, unknown or other
  misc_feature (315)..(315): n is a, c, g, or t
  modified_base (422)..(422): a, c, t, g, unknown or other
  misc_feature (422)..(422): n is a, c, g, or t
tcagtcgcactagtcacgaccggtgctcgatttagacgtctcatcaaggaaggaagggggacccaaaaaccacacccctccttgggagaatcccctagatcacagctcctcaccatggactggacctggagcatccttttcttggtggcagcagcaacaggtgcccactcccaggttcaattggtgcagtctggagctggcggtagaaggaggcctgggggcctcagtgaacgtctcctgcaaggtcttactggttacacttttagctagttatggtntcagcgtgggtgcgacacggccctaggacaggcttgngtggatgggatggatcgagctactacaagtagaaactaacgaaacgtatgacaactaattaacgttacgaggggtaccaggaagtcaatccgaatacgaacccgaanacgaacaacacacccgacgacgacaactacgacctagtaagtacggaactaacggaacgtaaccgtagaaacgtactaccgacgaaccgaaccgtaccgtactttaagttactttagttacgacgacgtaaacgaacgtaacttaacttacccttaccttaactaacgtaactaacgtacgtagtaacggtagtacg

SEQ ID NO: 301343 - DNA, 576 bp, Homo sapiens
  misc_feature: GZ8MTXP01EX86S.13.64.F09.1.454.CMB.2.raw
  modified_base (280)..(280): a, c, t, g, unknown or other
  misc_feature (280)..(280): n is a, c, g, or t
  modified_base (324)..(324): a, c, t, g, unknown or other
  misc_feature (324)..(324): n is a, c, g, or t
  modified_base (347)..(347): a, c, t, g, unknown or other
  misc_feature (347)..(347): n is a, c, g, or t
tcagtcacgtactacacgaccggtgctcgatttagcgcgtatacaagggggagtcatggatctcctgtgcaagaaaaatggagcacctgtggttcttcctcctgctggtggcggctcccagatgggtcctggcccaagtgcagttggtggagtcgggcccagggctggtgaagccttcgacgaccctgtccctcacttgcactgtctcaggtggctccattaaaaccagcagttatcactgggggtgatccggcagccccggggaagagctggagtgganggggagatttatatactggcaatacttacgacaatccgtccctnaagagtcgagtcaccctgtccgngacacgccccgaataaccagttctccctagaaacgtgacctctgtcgaccgtcgcagacacggcctatttattattgtagtgagtatacgacttttggaatggctatgactcgatccgacttacgtcggggccctggaactccgtggtcctaccgttctccttcgacgtcccttccgaccgacgggcccacgtccggtcccttcccccgttggcccttaacccgttccc

SEQ ID NO: 301344 - DNA, 698 bp, Homo sapiens
  misc_feature: GZ8MTXP01DNRX9.13.64.F09.1.454.CMB.2.raw
  modified_base (342)..(342): a, c, t, g, unknown or other
  misc_feature (342)..(342): n is a, c, g, or t
  modified_base (457)..(457): a, c, t, g, unknown or other
  misc_feature (457)..(457): n is a, c, g, or t
tcagtcacgtactacacgaccggtgctcgatttagcgcgtatacaagggggagtcatggatctcctgtgcaagaaaatggagcacctgtggttcttcctcctgctggtggcggctcccagatgggtcctggcccaagtgcagttggtggagtcgggcccagggctggtgaagccttcgacgaccctgtccctcacttgcactgtctcaggtggctccattaaaaccagcagttatcacgtgggggtgatccggcacggcccccggggaaggagcgtggagtggagtggggaggtattattatacgtggactaatacttacgacaactcccgtccctacaagngtcgagtccacctgtccgtaggactaccgacccgaaactaacctacggttcctaccccgtaagaaacgtcgtaacctcgtgtcgaccgtcgacagacacggtctatttatattgngtgagtatacgtatttaggaatggtactagtctacgtacgagttccgacttacggtccggggttcccctagggtaacttcccggtcgggttaaccctaacccggttccttaccccgttcgtaaaccggtccccttaaccccgaacccgggttaaacccgggggtccccctacgggttttcccccgggtttccccctttcccccccggtttcgggaacccccttaacccccggtttcccccg

SEQ ID NO: 301345 - DNA, 604 bp, Homo sapiens
  misc_feature: GZ8MTXP01BYXL0.13.64.F09.1.454.CMB.2.raw
tcagtcacgtactacacgaccggtgctcgatttagcgcgtatacaagggggagtcatggatctcctgtgcaagaaaatggagcacctgtggttcttcctcctgctggtggcggctcccagatgggtcctggcccaagtgcagttggtggagtcgggcccagggctggtgaagccttcgacgaccctgtccctcacttgcactgtctcaggtgctccattaaaaccagcagttatcacgtgggggtggatccgggcacggccccccgggggaaggagcgtgggagtggagtggggaggatttatatactggcaatacttacgacaatccgtccctacaagagtcgagtccaccctgtccgtggacacgaccccgaataacagttcctccctaagaaacgtgacctctgtcgaccgtcgcagacacggcctatttattattgtgtgagtatacgtatttaggaatggactatgactcgatcgactacgtggggcccttggaacttccgtggtccaccgttctcccttcacgtccccttaccgacccgaaacgggccccctagttccccggttcccttcccccgttggtccccaaccccgttccccg

SEQ ID NO: 301346 - DNA, 527 bp, Homo sapiens
  misc_feature: GZ8MTXP01BA5MZ.13.64.F09.1.454.CMB.2.raw
  modified_base (267)..(267): a, c, t, g, unknown or other
  misc_feature (267)..(267): n is a, c, g, or t
  modified_base (320)..(320): a, c, t, g, unknown or other
  misc_feature (320)..(320): n is a, c, g, or t
  modified_base (347)..(347): a, c, t, g, unknown or other
  misc_feature (347)..(347): n is a, c, g, or t
  modified_base (498)..(498): a, c, t, g, unknown or other
  misc_feature (498)..(498): n is a, c, g, or t
tcagtcacgtactacacgaccggtgctcgatttagcgcgtatacaagggggagtcagtctcagtcaggacacagcatggacatgagggtccccgctcagctcctggggctcctgctactctggctccgaggtgccagatgtgacacccagctgacccagtctcctgttttcctgtctgcctctgtgggcacagagtcgacatcacttgccgggcaagtcagaatattaagacctattgaattggtatcagcaaacaccagggaaacncccccaaactcctgatcttcggttcatctcgtttgacaaagtggagtcccttnacggttcagtggcagtgatctgggacngacttcactctcaccagtcggctagtcttacaacgtgacgtactttgacaacgtactactgtacaacacgacctacacgtacactcactagtttggccgagggaccaaggtggaagtacgaagggaactggtggctcgcaccgattcgttnttcttcatccttcccgccatccttgtaac

SEQ ID NO: 301347 - DNA, 611 bp, Homo sapiens
  misc_feature: GZ8MTXP01CHUOO.13.64.F09.1.454.CMB.2.raw
  modified_base (534)..(534): a, c, t, g, unknown or other
  misc_feature (534)..(534): n is a, c, g, or t
  modified_base (599)..(599): a, c, t, g, unknown or other
  misc_feature (599)..(599): n is a, c, g, or t
tcagtcacgtactacacgaccggtgctcgatttagcgcgtatacaagggggagtcatggatctcctgtgcaagaaaatggagcacctgtggttcttcctcctgctggtggcggctcccagatgggtcctggcccaagtgcagttggtggagtcgggcccagggctggtgaagccttcgacgaccctgtccctcacttgcactgtctcaggtggctcattaaaaccagcagttatcacgtgggggtggatccggcacggcccccgggggaaggagcgtggagtggagtggggaggtattatatactggacaatacttacgacaactccgtcctacaagagtcgagtcacctgtccgtggacacgaccccgaataactattcctcctaagaaacgtcgacctcgtgtcgaccgtcgcagacacggcctatttattattgtgtagagtactacgtactttggaatggtactagtgtactcgtatccgacgtacgtcgggggtccctgggtaactccgtgggtcctaccggttctccncgaccgtcccttacccgccgaacgggcccctagtcccgggttccctcccccgttcggtaaccccnccccgtaacccc

SEQ ID NO: 301348 - DNA, 642 bp, Homo sapiens
  misc_feature: GZ8MTXP01DP65Y.13.64.F09.1.454.CMB.2.raw
tcagtcacgtactacacgaccggtgctcgatttagcgcgtatacaagggggagtcatggatctcctgtgcaagaaaatggagcacctgtggttcttcctcctgctggtggcggctcccagatgggtcctggcccaagtgcagttggtggagtcgggcccagggctggtgaagccttcgacgaccctgtccctcacttgcactgtctcaggtggctccattaaaaccagcagttatcacgtgggggtgatccggcacggcccccggggaaggagctagagtggagtgggagatttatatactggcaatacttacgacaatccgtccctacaagagtcgagtcaccctgtccgtggacacgaccccgaaataacagttctccctaagaaacgtgacctctgtcgaccgtcgacagacacggcctatttattattgtagtagagtatacgtaacttttggaattcgggactaagttcgaaaccttcggaaacttccgaacttaaccggtcgggggtcccctagggtaaacttcccgtggtaacccgtacccgttctcccttacgacgtccccttacccgaacccgaacggggcccctaacgtccggttccccttcccccgttcggccccttaaccccgttccccg

SEQ ID NO: 301349 - DNA, 597 bp, Homo sapiens
  misc_feature: GZ8MTXP01AXEWP.13.64.F09.1.454.CMB.2.raw
  modified_base (284)..(284): a, c, t, g, unknown or other
  misc_feature (284)..(284): n is a, c, g, or t
  modified_base (329)..(329): a, c, t, g, unknown or other
  misc_feature (329)..(329): n is a, c, g, or t
  modified_base (374)..(374): a, c, t, g, unknown or other
  misc_feature (374)..(374): n is a, c, g, or t
  modified_base (582)..(582): a, c, t, g, unknown or other
  misc_feature (582)..(582): n is a, c, g, or t
tcagtcacgtactacacgaccggtgctcgatttagcgcgtatacaagggggagtcatggatctcctgtgcaagaaaatggagcacctgtggttcttcctcctgctggtggcggctcccagatgggtcctggcccaagtgcagttggtggagtcgggcccagggctggtgaagccttcgacgaccctgtccctcacttgcactgtctcaggtggctccattaaaccagcagttatcacgtgggggtgatccggcacggcccccggggaaggagctggagtggagnggggagatttatatactggcaatacttacgacaactccgtccctnaagagtcgagtcacctgtccgtggacacgcccgaataccagttcnccctaagaaacgtgacctcgtgtcgaccgtcgcagaccacggcctagtttattattgttagtgtatagtacgtacttttgggaatgggactagtggtactcggactcgacgttaccgtgggggcccctagggtaacctccgtgggtcctaccggttctcccgttcacgtcccttccgacgacgggtccccagtccgtcccttccccgngccccttccgtcccc

SEQ ID NO: 301350 - DNA, 547 bp, Homo sapiens
  misc_feature: GZ8MTXP01A5Z8N.13.64.F09.1.454.CMB.2.raw
  modified_base (383)..(383): a, c, t, g, unknown or other
  misc_feature (383)..(383): n is a, c, g, or t
  modified_base (423)..(423): a, c, t, g, unknown or other
  misc_feature (423)..(423): n is a, c, g, or t
  modified_base (443)..(443): a, c, t, g, unknown or other
  misc_feature (443)..(443): n is a, c, g, or t
  modified_base (491)..(491): a, c, t, g, unknown or other
  misc_feature (491)..(491): n is a, c, g, or t
  modified_base (496)..(496): a, c, t, g, unknown or other
  misc_feature (496)..(496): n is a, c, g, or t
  modified_base (501)..(501): a, c, t, g, unknown or other
  misc_feature (501)..(501): n is a, c, g, or t
  modified_base (504)..(504): a, c, t, g, unknown or other
  misc_feature (504)..(504): n is a, c, g, or t
  modified_base (518)..(518): a, c, t, g, unknown or other
  misc_feature (518)..(518): n is a, c, g, or t
tcagtcacgtactacacgaccggtgctcgatttagcgcgtatacaagggggagtcatggatctcctgtgcaagaaaatggagcacctgtggttcttcctcctgctggtggcggctcccagatgggtcctggcccaagtgcagttggtggagtcgggcccagggctggtgaatccttcgacgaccctgtccctcacttgcactgtctcaggtggctccattaaaaccagcagttatcatgggggtgatcggcagccccggggaagagctggagtggatggggaggattatatactggcaaatactacgacaaatccgtccctcaagagtcgagtcaccctgtccgtggacacgcccgaaataaccagttctccctagaaaagtnaacctctgtcgaccgtcgcagactacgcaattatatgtgngagatagactttggaatggntatgactcgatcgactacgtggggccctggaactcctggtcaccgttntcccncgacnccnccgaccacgaaccncgtccgtcctcccgttccgtccgccctcc

SEQ ID NO: 301351 - DNA, 619 bp, Homo sapiens
  misc_feature: GZ8MTXP01DMIUA.13.64.F09.1.454.CMB.2.raw
  modified_base (337)..(337): a, c, t, g, unknown or other
  misc_feature (337)..(337): n is a, c, g, or t
  modified_base (380)..(380): a, c, t, g, unknown or other
  misc_feature (380)..(380): n is a, c, g, or t
  modified_base (397)..(397): a, c, t, g, unknown or other
  misc_feature (397)..(397): n is a, c, g, or t
  modified_base (434)..(434): a, c, t, g, unknown or other
  misc_feature (434)..(434): n is a, c, g, or t
tcagtcacgtactacacgaccggtgctcgatttagcgcgtatacaagggggagtcatggatctcctgtgcaagaaaaatggagcacctgtggttcttcctcctgctggtggcggctcccagatgggtcctggcccaagtgcagttggtggagtcgggcccagggctggtgaagccttcgacgaccctgtccctcacttgcactgtctcaggtggctcattaaaaccagcagttatcacgtgggggtggatccggcacggcccccgggggaagagcgtggagtggagtggggaggtatttatatatggcaatacttacgacaatccgtccctacaagngtcgagtccaccctgtccgtgacacgcccgaataccagttccnccctaagaagtgacctntgtcaccgtcgcagacacgctatttatattgtgtganataacgtacgttttaggaaatgggacttagtgtacgtacgtatccggtacgttacgtcgggggtcccctagggtaactcccgtggtcctacccgttctcccttcgaacgtcccttacccgaccgaacgggtcccctacgtcccgggttccccttcccccgttcggtcccaaccccgttaaccccg

SEQ ID NO: 301352 - DNA, 577 bp, Homo sapiens
  misc_feature: GZ8MTXP01A60SC.13.64.F09.1.454.CMB.2.raw
  modified_base (283)..(283): a, c, t, g, unknown or other
  misc_feature (283)..(283): n is a, c, g, or t
tcagtcacgtactacacgaccggtgctcgatttagcgcgtatacaagggggagtcatggatctcctgtgcaagaaaaatggagcacctgtggttcttcctcctgctggtggcggctcccagatgggtcctggcccaagtgcagttggtggagtcgggcccagggctggtgaagccttcgacgaccctgtccctcacttgcactgtctcaggtggctccattaaaaccagcagttatcactgggggtgatccggcacggcccccggggaagagctggagtgganggggaggatttatatactggcaatacttacgacaatccgccctcaagagtcgagtcacctgtccgtggacacgccccgaatacagttctccctagaaagtgacctctgtgaccgtcgcagacacggcctaatttattattgtgtagagatacgtacttttggaatggactatggactcgactcgacttacgcggggtcccctggtaactcccgtgggtcctaccgttctccttaccgcgcccttaccgaccgacggccctcgtcccgtccctccccgttcgtcccttcccgtcc

SEQ ID NO: 301353 - DNA, 607 bp, Homo sapiens
  misc_feature: GZ8MTXP01EIM4F.13.64.F09.1.454.CMB.2.raw
tcagtcacgtactacacgaccggtgctcgatttagcgcgtatacaagggggagtcatggatctcctgtgcaagaaaaatggagcacctgtggttcttcctcctgctggtggcggctcccagatgggtcctggcccaagtgcagttggtggagtcgggcccagggctggtgaagccttcgacgaccctgtccctcacttgcactgtctcaggtgctccaattaaaaccagcagttatcacgtgggggtggatccggcacggcccccgggggaaggagcgtgggagtggagtgggggaaggtatttattatactggcaatactacgacaactccgtccctacaagagtcgacgtccacctgtccgtagacacgacccgaataaccagttcctccctaagaaagtcgacctctgtcgaccgtcgcacgacacgcctatttattattgtgtagagtatacgtatttaggaatggactagtgtactcgacttcgaacgttacgtcgggggccctagggtaactccgtggtctaccgttctccttcacgcccttaccgacgttaacgggcccctagtcccggttaccctccccgttcgtcccttccctaaccc

SEQ ID NO: 301354 - DNA, 589 bp, Homo sapiens
  misc_feature: GZ8MTXP01DTJMZ.13.64.F09.1.454.CMB.2.raw
  modified_base (530)..(530): a, c, t, g, unknown or other
  misc_feature (530)..(530): n is a, c, g, or t
  modified_base (581)..(581): a, c, t, g, unknown or other
  misc_feature (581)..(581): n is a, c, g, or t
tcagtcacgtactacacgaccggtgctcgatttagcgcgtatacaagggggagtcatggatctcctgtgcaagaaaaatggagcacctgtggttcttcctcctgctggtggcggctcccagatgggtcctggcccaagtgcagttggtggagtcgggcccagggctggtgaagccttcgacgaccctgtccctcacttgcactgtctcaggtggctcaattaaaaccagcagttatcacgtgggggtgagtccggcgacggcccccgggggaaaggagcgtggagtggagtggggaggtatttatatacgtggacaattacttaacgacaatccgtccctacaagagtcgagtcacctgtccgtggacacgacccgaataccagttcctccctaagaaagtcgacctcgtgtcgaccgtcgcacgacacggctatttattagttgtagtgagtatacgtactttaggaattggacttatgtactcgatcgactcggtcggggccctggactccgtggtccacgttctccncgacgccttccgacaacgggtccctagtcccggttccctccccgcgtcccncccgtccc

SEQ ID NO: 301355 - DNA, 605 bp, Homo sapiens
  misc_feature: GZ8MTXP01DJZQJ.13.64.F09.1.454.CMB.2.raw
  modified_base (367)..(367): a, c, t, g, unknown or other
  misc_feature (367)..(367): n is a, c, g, or t
  modified_base (503)..(503): a, c, t, g, unknown or other
  misc_feature (503)..(503): n is a, c, g, or t
tcagtcacgtactacacgaccggtgctcgatttagcgcgtatacaaggggagtcatggatctcctgtgcaagaaaatggagcacctgtggttcttcctcctgctggtggcggctcccagatgggtcctggcccaagtgcagttggtggagtcgggcccagggctggtgaagccttcgacgaccctgtccctcacttgcactgtctcaggtgctccattaaaaccagcagttatcacgtgggggtgatccggcagcccccggggaagagctggagtggagtggggaggatttatatactggcaatacttaacgacaaatccgtccctcaagagtcgagtcacctgtccgtgacacgcccgaataaccngttctccctagaaagtgacctctgtcgaccgtcgcagacacggcctatttattattgagttgagtatacgtacttttggaaatggcttatgaactcgatcgactacgtcggggccctggaactccgtggtcaacgngttccttccgttacacggttaccccttcccgaaacccgaaaccgggggtcccctaagttccccgggttcccgttttcccccccgtgggccccggttcccccg

SEQ ID NO: 301356 - DNA, 673 bp, Homo sapiens
  misc_feature: GZ8MTXP01ATSQH.13.64.F09.1.454.CMB.2.raw
tcagtcacgtactacacgaccggtgctcgatttagcgcgtatacaagggggagtcatggatctcctgtgcaagaaaaatggagcacctgtggttcttcctcctgctggtggcggctcccagatgggtcctggcccaagtgcagttggtggagtcgggcccagggctggtgaagccttcgacgaccctgtccctcacttgcactgtctcaggtgctccattaaaccagcagttatcacgtgggggtgatccggcacggcccccgggggaaggagcgtggagtggagtggggagtatttatatactggacaatacttacgacaactcccgtccctacaagagtcgacgtccaccctgtccgtggacacgaccccgaactaaccagttcctacccgtaagaaacgtcgacctcgtgtcgaccgtcgcacgacacggacctatttattattgtgtagagtacttacgtacttttaggaattgggacttagtacggtaactcggtaactccggtaccgttaacgtcgggggtccccttagggtaaccttccgtcgggtaaccctacccggttccttcccgttaccgaaccggtccccttacccgacccgaaccgggtcccctacgttcccgggttccccctttcccccggccggtccccgttaaccccgttaaccccg

SEQ ID NO: 301357 - DNA, 731 bp, Homo sapiens
  misc_feature: GZ8MTXP01DHXIY.13.64.F09.1.454.CMB.2.raw
  modified_base (227)..(227): a, c, t, g, unknown or other
  misc_feature (227)..(227): n is a, c, g, or t
tcagtcacgtactacacgaccggtgctcgatttagcgcgtatacaagggggagtcatggatctcctgtgcaagaaaatggagcacctgtggttcttcctcctgctggtggtggctcccagatgggtcctggcccaagtgcagttggtggagtcgggcccagggctggtgaagccttcgacgaccctgtccctcacttgcactgtctcaggtgctacaattaaaaccngcagttatcacgtgggggtgacgtccggcacggccccggggaaggagcgtggagtggagtggggagtattatatacgtggacaatacttacgacaactcccgtccctagaagacgtcgacgtccacccgtgtccgtggaaccaccgaccccgaaataaccgtagttacctacccgtaaagaaacgtcgtaaccctcgttacggtcgacccgtcgacgtaacgacctaaccggtaccttaagttttaagtttagtttaggtgttaggtaacgtacgtttaacggtaacgtttttaggaaattcgggtacttagttcggtaccttacggtactccgtaaccgttacgggttaccgggccgtaacgggtaccttccggttaaccggtcccgtaacccgttcccttacccgttcgtaacccgtccccttacccgaacccggttacccggtcccctaccggttcccgttcccccgttaccccgacgtcccccgttaacccttaaccccg

SEQ ID NO: 301358 - DNA, 624 bp, Homo sapiens
  misc_feature: GZ8MTXP01C0Q00.13.64.F09.1.454.CMB.2.raw
  modified_base (345)..(345): a, c, t, g, unknown or other
  misc_feature (345)..(345): n is a, c, g, or t
  modified_base (385)..(385): a, c, t, g, unknown or other
  misc_feature (385)..(385): n is a, c, g, or t
  modified_base (391)..(391): a, c, t, g, unknown or other
  misc_feature (391)..(391): n is a, c, g, or t
  modified_base (541)..(541): a, c, t, g, unknown or other
  misc_feature (541)..(541): n is a, c, g, or t
tcagtcacgtactacacgaccggtgctcgatttagcgcgtatacaagggggagtcatggatctcctgtgcaagaaaatggagcacctgtggttcttcctcctgctggtggcggctcccagatgggtcctggcccaagtgcagttggtggagtcgggcccagggctggtgaagccttcgacgaccctgtccctcacttgcactgtctcaggtggctccaattaaaaccagctaagttatcgacgtgggggtggactccggcgacgggccccgggggaagagcgtggaggtggagtggggaggtatttattatagtggacaattactaacgacaactccgtccctanaagagtcgatccacctgtccgtagacacgaccgaataacngttccncctaagaaagtcgactcgtgtcgaccgtcgacagacacggacttatttatattgagtagatacgtaacgttacgtttggaaagtcggacttagtcgtaactcgatccgaactcggtacgggcctaggactccgtcggtctccgttctccncgtaccgtccttacccgccggaaaccgggtcccctagttcccggttacccctccccggttacgccccttaaccccgttaaccg

SEQ ID NO: 301359 - DNA, 571 bp, Homo sapiens
  misc_feature: GZ8MTXP01A8ZQ7.13.64.F09.1.454.CMB.2.raw
  modified_base (215)..(215): a, c, t, g, unknown or other
  misc_feature (215)..(215): n is a, c, g, or t
  modified_base (269)..(269): a, c, t, g, unknown or other
  misc_feature (269)..(269): n is a, c, g, or t
tcagtcacgtactacacgaccggtgctcgatttagcgcgtatacaagggggagtcagtctcagtcaggacacagcatggacatgagggtccccgctcagctcctggggctcctgctactctggctccgaggtgccagatgtgacacccagctgacccagtctcctgttttcctgtctgcctctgtgggcgacagagtcgacatcacttgccgggnaagtcagaatattaagaccttattgaattggtatcagacaaacacagggaaacnccccaaatcctgatcttcgtcatctcgtttgacaaagtgactccctcacggttcagtggcagtcggactcgtgggacagtacttcactctcaccatcggcagtcttacgaacgtgacgtactttcgactaacgtactactgtacaacacgacctacacgtacacctacgactacggtttacggaccgagggggacctaaaggggtcggtaaacgtacgaaaggggtaacctgggtacggcttcggacgtacctattccgttcgttccttctacttccttccccgcttactcgttaacgtaag

SEQ ID NO: 301360 - DNA, 595 bp, Homo sapiens
  misc_feature: GZ8MTXP01DXL1O.13.64.F09.1.454.CMB.2.raw
  modified_base (260)..(260): a, c, t, g, unknown or other
  misc_feature (260)..(260): n is a, c, g, or t
  modified_base (270)..(270): a, c, t, g, unknown or other
  misc_feature (270)..(270): n is a, c, g, or t
  modified_base (279)..(279): a, c, t, g, unknown or other
  misc_feature (279)..(279): n is a, c, g, or t
tcagtcacgtactacacgaccggtgctcgatttagcgcgtatacaagggggagtcagtctcagtcaggacacagcatggacatgagggtccccgctcagctcctggggctcctgctactctggctccgaggtgccagatgtgacacccagctgacccagtctcctgttttcctgtctgcctctgtgggcgacagagtcgacatcacttgccggcaagtcagaatataagactattgaattgatcagcaaacacaagaacnccccaaatcngatctcgtnatctcgttgctaaagtgatccttgacggttcagtgcagtcggatcgtagggactagacctttaaccacttctacaccctagtccgggctacggttcttacacgtgtacgtactttgctaaacgtactacttcgtactaacgaacgtaacctaacgtacgtaaccaccttaccgtaacgtacgggttttcggacccggtaacggggtaacccgaaaaggggttggaaacggttacggaaacgggtaacgtggttcggacgttcgacgacctattcgttcgttacttctactccgttcccgcttacttcgttgtaacg

SEQ ID NO: 301361 - DNA, 618 bp, Homo sapiens
  misc_feature: GZ8MTXP01BGDWT.13.64.F09.1.454.CMB.2.raw
  modified_base (291)..(291): a, c, t, g, unknown or other
  misc_feature (291)..(291): n is a, c, g, or t
  modified_base (340)..(340): a, c, t, g, unknown or other
  misc_feature (340)..(340): n is a, c, g, or t
  modified_base (544)..(544): a, c, t, g, unknown or other
  misc_feature (544)..(544): n is a, c, g, or t
  modified_base (601)..(601): a, c, t, g, unknown or other
  misc_feature (601)..(601): n is a, c, g, or t
tcagtcacgtactacacgaccggtgctcgatttagcgcgtatacaagggggagtcatggatctcctgtgcaagaaaaatggagcacctgtggttcttcctcctgctggtggcggctcccagatgggtcctggcccaagtgcagttggtggagtcgggcccagggctggtgaagccttcgacgaccctgtccctcacttgcactgtctcaggtggctccaattaaaaccagctagttatcacgtgggggtggatccggcacggcccccgggggaaggagcgtggagtggagnggggagtatttatatacgtggactaatacttacgacaactccgtcctanaagagtcgagtcacctgtccgtgacacgacccgaatacagttcctccctaagaacgtcgacctcgtgtcgaccgtcgacgacgaccacggtccttaattttacttagttggtgtagtaagtacgttacgttagttttaggaaattcgggacttaagtcgacttcgatccgaacgtcggtcggggccctaggactccgtggtccnccgttctcccttcgacgccccttacgaccgacggtccacgttccggtccctccccgngtccccttaacccgtcc

SEQ ID NO: 301362 - DNA, 592 bp, Homo sapiens
  misc_feature: GZ8MTXP01APFOI.13.64.F09.1.454.CMB.2.raw
  modified_base (225)..(225): a, c, t, g, unknown or other
  misc_feature (225)..(225): n is a, c, g, or t
  modified_base (327)..(327): a, c, t, g, unknown or other
  misc_feature (327)..(327): n is a, c, g, or t
  modified_base (331)..(331): a, c, t, g, unknown or other
  misc_feature (331)..(331): n is a, c, g, or t
tcagtcacgtactacacgaccggtgctcgatttagcgcgtatacaagggggagtcatggatctcctgtgcaagaaaatggagcacctgtggttcttcctcctgctggtggcggctcccagatgggtcctggcccaagtgcagttggtggagtcgggcccagggctggtgaagccttcgacgaccctgtccctcacttgcactgtctcaggtgctccattaaaccngcagtatcacgtgggggtgatccggcacggccccggggaagagcgtggagtggagtggggagtatttatatacgtggacaatactacgacatcccgtcctanaagngtcgagtcaccctgtccgtgacacgcccgaaactaacagttcctacccgtaagaaagtcgacctcgtgtcgaccgtcgacaagaccacggtcctaagtttattaagttgtagtgaagtatacgttacgttttaggaattggcttaagtgtactcgtaatcgacgtacggtcgggccctgggacttccgtggcctacgttcctccttcacgcccttccacgacggccctagtcccgtcctccccgttacgtccttccctccc

SEQ ID NO: 301363 - DNA, 764 bp, Homo sapiens
  misc_feature: GZ8MTXP01CRDIF.13.64.F09.1.454.CMB.2.raw
  modified_base (234)..(234): a, c, t, g, unknown or other
  misc_feature (234)..(234): n is a, c, g, or t
  modified_base (288)..(288): a, c, t, g, unknown or other
  misc_feature (288)..(288): n is a, c, g, or t
tcagtcacgtactacacgaccggtgctcgatttagcgcgtatacaagggggagtcatggatctcctgtgcaagaaaatggagcacctgtggttcttcctcctgctggtggcggctcccagatgggtcctggcccaagtgcagttggtggagtcgggcccagggctggtgaagccttcgacgaccctgtccctcacttgcactgtctcaggtggctcaattaaaccagcagttancacgtgggggtgacgtccggcgacggcccccggggaaggagcgtggagtggagnggggagtatttatatacgtggactaatacttaacgactaactcccgtacccctacgaaagacggtcgtacgtacccacccgttcggtcccggtaggaaccgaccgaaccccccggtaaaactaaccgtaggtttaccctaccccgttaaaggtaaacgttcgaacccttcgttacgggtacgacccggtcgacgaacgtacccgaacggtcctaagttttaattaagttggttagttaggaacgtagtttaacggtacgtttttagggaagttcgggtacttagttacgtacgtacgtacgttccgaccgttaacggtccgggggacccttagggaacctttcccggtgggtaaccctacccggttcctcccgttccgaacccggtccccttaacccgaacccgttaaccggggtcccctacggttccccggttccccttcccccggttacggccccttaacccccgttaaccccg

SEQ ID NO: 301364 - DNA, 628 bp, Homo sapiens
  misc_feature: GZ8MTXP01AUF58.13.64.F09.1.454.CMB.2.raw
  modified_base (351)..(351): a, c, t, g, unknown or other
  misc_feature (351)..(351): n is a, c, g, or t
tcagtcacgtactacacgaccggtgctcgatttagcgcgtatacaagggggagtcatggatctcctgtgcaagaaaaatggagcacctgtggttcttcctcctgctggtggcggctcccagatgggtcctggcccaagtgcagttggtggagtcgggcccagggctggtgaagccttcgacgaccctgtccctcacttgcactgtctcaggtggctaccaattaaaaccagctagttatcgacgtgggggtggacgtcccggcgacgggcccccgggggaaggagcgtggaggtggagtggggagtatttatatacgtggactaatacttacgacaactcccgtaccctanaagtacgtcgagtccacctgtccgtggacacgaccccgaataactagttcctccctaagaaacgtcgacctcgtgtcgaccgtcgacacgaccacgtcctatttattattgtagtagagtactacgttatttaggaatggactaagtgactcgtatcgactacggtcggggcctaggactccgtggtaacctccgttctccttcacgtcccttaccgaccgaccgggtccctacgttcccgtcccgttccccgttacggcccttaaccccgtaaccc

SEQ ID NO: 301365 - DNA, 587 bp, Homo sapiens
  misc_feature: GZ8MTXP01B5KBY.13.64.F09.1.454.CMB.2.raw
  modified_base (273)..(273): a, c, t, g, unknown or other
  misc_feature (273)..(273): n is a, c, g, or t
  modified_base (521)..(521): a, c, t, g, unknown or other
  misc_feature (521)..(521): n is a, c, g, or t
  modified_base (526)..(526): a, c, t, g, unknown or other
  misc_feature (526)..(526): n is a, c, g, or t
  modified_base (534)..(534): a, c, t, g, unknown or other
  misc_feature (534)..(534): n is a, c, g, or t
  modified_base (543)..(543): a, c, t, g, unknown or other
  misc_feature (543)..(543): n is a, c, g, or t
tcagtcacgtactacacgaccggtgctcgatttagcgcgtatacaagggggagtcatggatctcctgtgcaagaaaaatggagcacctgtggttcttcctcctgctggtggcggctcccagatgggtcctggcccaagtgcagttggtggagtcgggcccagggctggtgaagccttcgacgaccctgtccctcacttgcactgtctcaggtggctcaattaaaaccagcagttatcacgtgggggtgagtccggcacggccccggggaaggngcgtggagtggagtggggaggtatttatatacgtggactaatacttacgactaactccgtccctacgaagagtcgacgtccaccgtgtccgtagacaccgaccccgaaactactacgttcctaccctaagaaacgtcgacctctgtcgaccgtcgacacgacacgccttaatttattagttgtgtagatatacgtactttggaattggctagtgactgatcgactacggtcggggcctaggactccgngtccncgttctcncgactcccnccgacgacggcctacgtccgtcctccccgagcccttaaccctcc

SEQ ID NO: 301366 - DNA, 573 bp, Homo sapiens
  misc_feature: GZ8MTXP01AWS0T.13.64.F09.1.454.CMB.2.raw
  modified_base (279)..(279): a, c, t, g, unknown or other
  misc_feature (279)..(279): n is a, c, g, or t
  modified_base (378)..(378): a, c, t, g, unknown or other
  misc_feature (378)..(378): n is a, c, g, or t
  modified_base (396)..(396): a, c, t, g, unknown or other
  misc_feature (396)..(396): n is a, c, g, or t
tcagtcacgtactacacgaccggtgctcgatttagcgcgtatacaaggggagtcatggatctcctgtgcaagaaaatggagcacctgtggttcttcctcctgctggtggcggctcccagatgggtcctggcccaagtgcagttggtggagtcgggcccagggctggtgaagccttcgacgaccctgtccctcacttgcactgtctcaggtggctccattaaaaccagcagttatcactgggggtgatccggcagcccccggggaagagctggagtgganggggaggatttatatactggcaatactttacgacaaatccgtcccctacaagagtcgaagtcacccctgtccgtggacacgccccgaaataacagttcnccctagaaatgaccctgngtcgaccgtcgcagacacggcctatttattattgtgtgagatacgacttttaggaattgggcttaagtgaactcgaagttcgactacgtggggcccctgggaatccgtggtcaccgttctccgttcacgtccttaccgccacgggcccatccggtcctcccttcggcaaccctcccg

SEQ ID NO: 301367 - DNA, 717 bp, Homo sapiens
  misc_feature: GZ8MTXP01DQCRG.13.64.F09.1.454.CMB.2.raw
tcagtcacgtactacacgaccggtgctcgatttagcgcgtatacaagggggagtcatggatctcctgtgcaagaaaatggagcacctgtggttcttcctcctgctggtggcggctcccagatgggtcctggcccaagtgcagttggtggagtcgggcccagggctggtgaagccttcgacgaccctgtccctcacttgcactgtctcaggtggctccaattaaaaccagctagttatcacgtgggggtgacgtccggcgacggaccccggggaaggagcgtggagtggagtgggagtatttatatacgtggactaatactaacgactaactcccgtaccctacgaagtacgtacgagtccacccgtgtccgtaggaccacgaccccgaaactaactacgttcctacccgtaagaaacgtcgacctcgtgtacgaccgtcgacgacgacacggtactatttattagttgtagtagagtacttacgttactttaggaatggtactagtcgtacctacgtactccggtacttacggtaccgggggtcccttagggtaaccttcccggttcgggttaacccctaacccggtttcccttaccccgttccgtaaacccggtccccttaaccccggaaccggaaccccgggtcccctaacggtttcccccgggtttaccccttccccccggttacggtaacccccttaacccccgttaaccccg

SEQ ID NO: 301368 - DNA, 588 bp, Homo sapiens
  misc_feature: GZ8MTXP01E4AJF.13.64.F09.1.454.CMB.2.raw
  modified_base (397)..(397): a, c, t, g, unknown or other
  misc_feature (397)..(397): n is a, c, g, or t
tcagtcacgtactacacgaccggtgctcgatttagcgcgtatacaagggggagtcatggatctcctgtgcaagaaaatggagcacctgtggttcttcctcctgctggtggcggctcccagatgggtcctggcccaagtgcagttggtggagtcgggcccagggctggtgaagccttcgacgaccctgtccctcacttgcactgtctcaggtggctccattaaaaccagcagttatcactgggggtggatccggcaggcccccggggaaggagctggaggtggagtggggaggatttatatacgtggcaatacttacgactaaactccgtcccctcaagagtcgagtcaccctgtccgtggacacgcccgaatacagtctcctagaaacgtcgacctntgtgaccgtcgacacgacaccggtcctatttattattggttgtgagatacgacttttaggaatggctatgactcgatcgacgtacgtcggggcctggtaactccgtggtcctacccgttctcccttcgacgcccttccgacccgacgggcccacgtcccggtcccttcccccgcggtcccaacccctcccc

SEQ ID NO: 301369 - DNA, 643 bp, Homo sapiens
  misc_feature: GZ8MTXP01AYD0Q.13.64.F09.1.454.CMB.2.raw
tcagtcacgtactacacgaccggtgctcgatttagcgcgtatacaagggggagtcatggatctcctgtgcaagaaaatggagcacctgtggttcttcctcctgctggtggcggctcccagatgggtcctggcccaagtgcagttggtggagtcgggcccagggctggtgaagccttcgacgaccctgtccctcacttgcactgtctcaggtgctaccattaaaccagcagttatcgacgtgggggtgatccggcacggcccccggggaagagcgtggagtggagtgggaggtatttatatacgtggactaatacttacgactaactcccgtacctacaagacgtcgagtccacccgtgtccgtaggaccaccgaccccgtaaactaccgtagttccctacccgtaaagaacgtcgacctcgtcgtcgtaccgtcgacaacgaccgaacggccttaagtttattagttgtagtagagtattacgtacgtttggaactggcttagtgtactcgatcgacgtacgtggggtccctaggacttccgtggtcctcccgttactccttcgaccgtcccttacccgttaccgaccgggtcccctagttcccgggtccctttacccccgcgtaacccttccccgtaacccg

SEQ ID NO: 301370 - DNA, 590 bp, Homo sapiens
  misc_feature: GZ8MTXP01DKNDR.13.64.F09.1.454.CMB.2.raw
  modified_base (579)..(579): a, c, t, g, unknown or other
  misc_feature (579)..(579): n is a, c, g, or t
tcagtcacgtactacacgaccggtgctcgatttagcgcgtatacaagggggagtcatggatctcctgtgcaagaaaaatggagcacctgtggttcttcctcctgctggtggcggctcccagatgggtcctggcccaagtgcagttggtggagtcgggcccagggctggtgaagccttcgacgaccctgtccctcacttgcactgtctcaggtggctcattaaaaccagcagttatcacgtgggggtgatccggcacggcccccggggaaggagcgtggagtggagtggggagtatttatatactggcaatacttacgacaatcccgtccctacaagagtcgagtccacctgtccgtggacacgccccgaaataccagttcctccctaagaaagtcgacctcgtcgtcgaccgtcgacagaccacgcctaatttattattgtagtgagatacgtctttaggaatggtctaatgtactcgatccgactacgtcgggccctggaactccgtggtctaccgttctccttcgacgtcccttaccgaccgaacgggccccagtcccggtcctcccccgttgcccnccccgtaaccc

SEQ ID NO: 301371 - DNA, 740 bp, Homo sapiens
  misc_feature: GZ8MTXP01CBHSG.13.64.F09.1.454.CMB.2.raw
tcagtcacgtactacacgaccggtgctcgatttagcgcgtatacaagggggagtcatggatctcctgtgcaagaaaaatggagcacctgtggttcttcctcctgctggtggtggctcccagatgggtcctggcccaagtgcagttggtggagtcgggcccagggctggtgaagccttcgacgaccctgtccctcacttgcactgtctcgaggtggctaccaattaaaaccagcagttatcacgtgggggtggacgtccggcacggcccccgggggaaggagctggagtggagtggggagtatttattatactggactaatacttacgacaactccgtccctacaagtacgtcgagtcacccgtgtccgtgaccacgaccccgaaataacctagttccctacccgtaagaaacgtcgaacccttcgtcggtacgaccccggttcgaccgaacgacccgtaccggtacccttaattttaactttagtttgtagggttagtaaggttacgttaacgttacgttttagggtaaagttcgggtacttaagtcggtaaccgtacgtacgtaccgttaccggtacggttcccgggggtccttagggtaccctccggttccggtaacccttcccgttcccgtcccttaccgtaccgtccccttacccggttaacccgacccggtccccgtaccgttccccggttccccctttcccccgccgggtaacccccttcccctttaacccccg

SEQ ID NO: 301372 - DNA, 675 bp, Homo sapiens
  misc_feature: GZ8MTXP01DWY4V.13.64.F09.1.454.CMB.2.raw
tcagtcacgtactacacgaccggtgctcgatttagcgcgtatacaagggggagtcatggatctcctgtgcaagaaaaatggagcacctgtggttcttcctcctgctggtggcggctcccagatgggtcctggcccaagtgcagttggtggagtcgggcccagggctggtgaagccttcgacgaccctgtccctcacttgcactgtctcaggtggctccattaaaaccagcagttatcacgtgggggtgagtccggcgacggcccccggggaaggagcgtggagtggagtggggaggtatttattatacgtggcaatacttacgacaatccgtaccctacaagagtcgagtcacccgtgtccgtggacaccgcccgaactaactacgttctcccgtaagaaagtcgaacctcgtagtcgacccgtcgacgacgaccaccggtacctaattttagttagtttgtagttagaagtaacgttacgtacgtttttagggaaattcgggtactaagttcgtaacgttacgatcccggattaccgggtcggggtccctagggtaactccggtcggtcctacccgttctccccttagacccggtcccttacccgacccttaaacggggcccctacggttcccggttccccttcccccgcggtaaccccttccccgttaacccc

SEQ ID NO: 301373 - DNA, 755 bp, Homo sapiens
  misc_feature: GZ8MTXP01AXU6E.13.64.F09.1.454.CMB.2.raw
  modified_base (231)..(231): a, c, t, g, unknown or other
  misc_feature (231)..(231): n is a, c, g, or t
  modified_base (279)..(279): a, c, t, g, unknown or other
  misc_feature (279)..(279): n is a, c, g, or t
  modified_base (344)..(344): a, c, t, g, unknown or other
  misc_feature (344)..(344): n is a, c, g, or t
  modified_base (385)..(385): a, c, t, g, unknown or other
  misc_feature (385)..(385): n is a, c, g, or t
tcagtcacgtactacacgaccggtgctcgatttagcgcgtatacaagggggagtcatggatctcctgtgcaagaaaatggagcacctgtggttcttcctcctgctggtggtggctcccagatgggtcctggcccaagtgcagttggtggagtcgggcccagggctggtgaagccttcgacgaccctgtccctcacttgcactgtctcgaggtcggctaccaattaaaaccngctagttatcacgtgggggtgagtccggcacggccccgggggaaaggngcgtggagtggagtggggagtatttatagtacgtggactaatactaacgacaactccgtccctanaagtgtcgactcaccgtgtccgtgacacgacccgaatacgngttcctacccgtaagaaacgtcgacctgtcggtacgaccgtcgacgaacgaccgtacggtaccttatttttagtagtttggtaacggttagggtaattaaccgtaaccggtttacgttttagggaaagttcgggtactttaagtaccggtaaaccgttacggtaaaccgttccgtaaacccggttccgggggtacccggggtacccgttaagggaacctttcccgggtcccggtaacccgtaacccgttccgtacccttacggaaccccgtccccttacccggaaaccggttaccccgggcccttaaccggttcccccgtttccccccgttacccggacccggttaaccccaacccccggtttaaccccg

SEQ ID NO: 301374 - DNA, 500 bp, Homo sapiens
  misc_feature: GZ8MTXP02IKPK0.13.64.F09.1.454.CMB.2.raw
  modified_base (267)..(267): a, c, t, g, unknown or other
  misc_feature (267)..(267): n is a, c, g, or t
  modified_base (316)..(316): a, c, t, g, unknown or other
  misc_feature (316)..(316): n is a, c, g, or t
  modified_base (424)..(424): a, c, t, g, unknown or other
  misc_feature (424)..(424): n is a, c, g, or t
tcagtcacgtactacacgaccggtgctcgatttagcgcgtatacaagggggagtcagtctcagtcaggacacagcatggacatgagggtccccgctcagctcctggggctcctgctactctggctccgaggtgccagatgtgacacccagctgacccagtctcctgttttcctgtctgcctctgtgggcgacagagtcgacatcacttgccgggcaagtcagaatattaagactattgaattggtatcagcaaacaccagggaaacncccccaaatcctgatcttcggtcatctcgtttgcaaagtgagtcccttnacggttcagtgcagtggatcgtggacagacttcactctcacatcgcagtcttacaacgtgacgtactttgctaacgtactactgtacaacagacctacagtaccactnactagtttgacctagggacaaggtgaagtcaaggactgaggctcgcaccatctagtctcatcctccgcactctaga

SEQ ID NO: 301375 - DNA, 578 bp, Homo sapiens
  misc_feature: GZ8MTXP02FYHP5.13.64.F09.1.454.CMB.2.raw
  modified_base (436)..(436): a, c, t, g, unknown or other
  misc_feature (436)..(436): n is a, c, g, or t
tcagtcacgtactacacgaccggtgctcgatttagcgcgtatacaagggggagtcatggatctcctgtgcaagaaaatggagcacctgtggttcttcctcctgctggtggcggctcccagatgggtcctggcccaagtgcagttggtggagtcgggcccagggctggtgaagccttcgacgaccctgtccctcacttgcactgtctcaggtggctccattaaaaccagcagttatcactgggggtggatccggcaggcccccggggaaggagctggagtggagtggggaggtatttatatactggacaatacttacgacaatccgtccctacaagagtcgagtcaccctgtccgtggacacgaccccgaataaccagttcctccctagaaagtcgacctctgtgaccgtcgcagacacgcctatttattattgtgngagatacgtatttggaaatggacttatgactcgatcgactacgtcggggccctgggaactcgtcggtcacccgttctcctcacgtccctaccgaccgaacgggccctagtccggtcccttccccctacggcccacccttccc

SEQ ID NO: 301376 - DNA, 510 bp, Homo sapiens
  misc_feature: GZ8MTXP02FXDX7.13.64.F09.1.454.CMB.2.raw
tcagtcacgtactacacgaccggtgctcgatttagcgcgtatacaagggggagtcagtctcagtcaggacacagcatggacatgagggtccccgctcagctcctggggctcctgctactctggctccgaggtgccagatgtgacacccagctgacccagtctcctgttttcctgtctgcctctgtgggcgacagagtcgacatcacttgccgggcaagtcagaatattaagacctatttgaattggtatcagcaaacaccaaggaaacgcccccaaatcctgatcttcggttcatctcgtttgcaaaagtggagtcccttcacggttcagtggcagtggatcgtgggacagacttcactctcaccatcgcagtcttcaacgtgacgactttgcaaacgtactactgtacaacagacctacagtacacctcactagtttgccaggggaccaaggtgaagtacaagggaactggtgctgctaccatctgtcttcatcttcccgcatctagta

SEQ ID NO: 301377 - DNA, 521 bp, Homo sapiens
  misc_feature: GZ8MTXP02I4CEH.13.64.F09.1.454.CMB.2.raw
  modified_base (269)..(269): a, c, t, g, unknown or other
  misc_feature (269)..(269): n is a, c, g, or t
  modified_base (362)..(362): a, c, t, g, unknown or other
  misc_feature (362)..(362): n is a, c, g, or t
  modified_base (425)..(425): a, c, t, g, unknown or other
  misc_feature (425)..(425): n is a, c, g, or t
tcagtcacgtactacacgaccggtgctcgatttagcgcgtatacaagggggagtcagtctcagtcaggacacagcatggacatgagggtccccgctcagctcctggggctcctgctactctggctccgaggtgccagatgtgacacccagctgacccagtctcctgttttcctgtctgcctctgtgggcgacagagtcgacatcacttgccgggcaagtcagaatattaagacctattgaattggtatcagcaaacaccaagggaaacncccccaaatcctgatcttcggtcatctcgtttgcaaagtggatcctcaggttcagtgcagtggatcgtgggacagacttcactctcacatcgnagtcttcaacgtgacgtactttgctaaagtactactgtacaacagacctacagtaaccacctnacttagtttcggaccgaggggaccaagggtggaagtacgaagggactggtggctcgcaccgtatctgtcttcacttctcccgctactctagtaacg

SEQ ID NO: 301378 - DNA, 531 bp, Homo sapiens
  misc_feature: GZ8MTXP02IFZEH.13.64.F09.1.454.CMB.2.raw
  modified_base (271)..(271): a, c, t, g, unknown or other
  misc_feature (271)..(271): n is a, c, g, or t
  modified_base (305)..(305): a, c, t, g, unknown or other
  misc_feature (305)..(305): n is a, c, g, or t
  modified_base (321)..(321): a, c, t, g, unknown or other
  misc_feature (321)..(321): n is a, c, g, or t
  modified_base (365)..(365): a, c, t, g, unknown or other
  misc_feature (365)..(365): n is a, c, g, or t
  modified_base (500)..(500): a, c, t, g, unknown or other
  misc_feature (500)..(500): n is a, c, g, or t
tcagtcacgtactacacgaccggtgctcgatttagcgcgtatacaagggggagtcagtctcagtcaggacacagcatggacatgagggtccccgctcagctcctggggctcctgctactctggctccgaggtgccagatgtgacacccagctgaccccagtctcctgttttcctgtctgcctctgtgggcgacagagtcgacatcacttgccgggcaagtcagaatattaagaccttattgaattggtatcagcaaaacaccaaggaaacnccccccaaatcctgatctcggttcatctcgtttncaaagtggatcccttnacggttcagtggcagtggactgtgggacagacttcactctcacntcgctagtctacacgtgacgtacttgctaacgtactactgtacaaacacgacctaacagtacaacttcactagtttcggccgtaggggaccaagggtggaagtacgaagggaactggtgctcgacactactcgtntctaacacttcttcccgactctactagtaag

SEQ ID NO: 301379 - DNA, 547 bp, Homo sapiens
  misc_feature: GZ8MTXP02JM1AK.13.64.F09.1.454.CMB.2.raw
  modified_base (328)..(328): a, c, t, g, unknown or other
  misc_feature (328)..(328): n is a, c, g, or t
  modified_base (385)..(385): a, c, t, g, unknown or other
  misc_feature (385)..(385): n is a, c, g, or t
  modified_base (419)..(419): a, c, t, g, unknown or other
  misc_feature (419)..(419): n is a, c, g, or t
tcagtcacgtactacacgaccggtgctcgatttagcgcgtatacaagggggagtcatggatctcctgtgcaagaaaatggagcacctgtggttcttcctcctgctggtggcggctcccagatgggtcctggcccaagtgcagttggtggagtcgggcccagggctggtgaagccttcgacgaccctgtccctcacttgcactgtctcaggtggctccattaaaaccagcagttatcactgggggtgatccggcagccccggggaaggagctggagtggatggggaggatttatatactggcaatacttacgacaatccgtcctcaagngtcgagtcacctgtccgtgacacgccccgaataccagttctccctgaaagtgacctntgtgacgtcgcagacacggcctattattattgtntgagtatacgtacttttgaatggctatgactcgatcgactacgtggggccctggtactccgtggtcaccgtctcctcacgcctcccacgacggcccagtccggtccttcccccgtggcccaccctccc

SEQ ID NO: 301380 - DNA, 655 bp, Homo sapiens
  misc_feature: GZ8MTXP02HLLJK.13.64.F09.1.454.CMB.2.raw
  modified_base (226)..(226): a, c, t, g, unknown or other
  misc_feature (226)..(226): n is a, c, g, or t
  modified_base (331)..(331): a, c, t, g, unknown or other
  misc_feature (331)..(331): n is a, c, g, or t
tcagtcacgtactacacgaccggtgctcgatttagcgcgtatacaagggggagtcatggatctcctgtgcaagaaaaatggagcacctgtggttcttcctcctgctggtggcggctcccagatgggtcctggcccaagtgcagttggtggagtcgggcccagggctggtgaagccttcgacgaccctgtccctcacttgcactgtctcaggtgctccattaaaccngcagttatcactgggggtgatccggcacggccccggggaagagctggagtggagtggggagatttatatactggcaaatacttacgacaatcccgtccctcaagngtcgagtcacctgtccgtgacacgacccgaataaccagttcctaccctagaaagtcgacctctgtcgacccgtcgcagacacggcctatttattattgtgtgagtatacgtacgttttggaaattggtacttagttagtactcggatccgtaactaacgtcgggggtaccctagggtaaacttcccgtacggttacctacccggttcctccccttaccaaccggtcccccttaccccgaaacccgaaaccgggggtccccctaacggttaccccgggttccccctttccccccgtccgggtccccctaaccccctttacccccg

SEQ ID NO: 301381 - DNA, 625 bp, Homo sapiens
  misc_feature: GZ8MTXP02FHM6X.13.64.F09.1.454.CMB.2.raw
  modified_base (430)..(430): a, c, t, g, unknown or other
  misc_feature (430)..(430): n is a, c, g, or t
tcagtcacgtactacacgaccggtgctcgatttagcgcgtatacaagggggagtcatggatctcctgtgcaagaaaatggagcacctgtggttcttcctcctgctggtggcggctcccagatgggtcctggcccaagtgcagttggtggagtcgggcccagggctggtgaagccttcgacgaccctgtccctcacttgcactgtctcaggtggctccattaaaaccagcagttatcactgggggtggatccggcagcccccggggaaggagctggagtggatggggaggatttattatactggcaatacttacgacaatccgtccctcaagagtcgagtcaccctgtccgtggacacgccccgaatacccagttcctccctagaaagtcgacctctgtgaccgtcgcagacacgccatttattattgtgngagatacgacttttggaatggctagtgacttcgatccgactacgtcgggggccctaggaactccgtacggtcctacccggttccttcccgtccgaacggtcccccttacccgaaccccgaaaacgggggccccctaacgttccccggggttcccctttcccccccgttacgggccccctacccccgtttaccccc

SEQ ID NO: 301382 - DNA, 690 bp, Homo sapiens
  misc_feature: GZ8MTXP02ITF0M.13.64.F09.1.454.CMB.2.raw
tcagtcacgtactacacgaccggtgctcgatttagcgcgtatacaagggggagtcatggatctcctgtgcaagaaaatggagcacctgtggttcttcctcctgctggtggcggctcccagatgggtcctggcccaagtgcagttggtggagtcgggcccagggctggtgaagccttcgacgaccctgtccctcacttgcactgtctcaggtggctccattaaaccagcagttatcacgtgggggtgatccggcacggcccccggggaaggagcgtgggagtggagtggggagtatttattatacgtggcaatacttacgacaactccgtccctacaagagtcgagtccacctgtccgtgacacgccccgaactaaccagttcctccctagaaacgtcgaccttcgtcgtacgacccgtcgactaagaccgacggcccttaattttaagttatttgtagtgaagtagttaaccgtagttttgggaaattcgggtacttaagttcgtaaccgttcgaaagttcccggtaaccgttaccgggtccgggggtacccccttagggggtaaaccttcccggttcgggttaccctaccccggttccttaccctacgaccgtcccccgtaccaacccgaaacggggtcccctaacggttcccggttccccttacccccgcgacccctaccccttcccg

SEQ ID NO: 301383 - DNA, 580 bp, Homo sapiens
  misc_feature: GZ8MTXP02JMWD5.13.64.F09.1.454.CMB.2.raw
  modified_base (225)..(225): a, c, t, g, unknown or other
  misc_feature (225)..(225): n is a, c, g, or t
  modified_base (337)..(337): a, c, t, g, unknown or other
  misc_feature (337)..(337): n is a, c, g, or t
  modified_base (440)..(440): a, c, t, g, unknown or other
  misc_feature (440)..(440): n is a, c, g, or t
  modified_base (522)..(522): a, c, t, g, unknown or other
  misc_feature (522)..(522): n is a, c, g, or t
tcagtcacgtactacacgaccggtgctcgatttagcgcgtatacaagggggagtcatggatctcctgtgcaagaaaatggagcacctgtggttcttcctcctgctggtggcggctcccagatgggtcctggcccaagtgcagttggtggagtcgggcccagggctggtgaagccttcgacgaccctgtccctcacttgcactgtctcaggtgctccattaaaccngcagttatcacgtgggggtgatccggcacggcccccggggaaggagcgtggagtggagtggggagtatttatatacgtggacaaattacttacgactaactcccgtccctanaagagtcgagtccacctgtccgtgacacgaccccgaataaccagttcctccctagaaacgtcgacctctgtcgaccgtcgcagaccacgcctatttatattgngtgagtatacgtagttttggaaatggactagtgactcgaatcgactacgtgggccctaggtactccgtagtccaccgttccncctcacgccctaccgacgaacggccctagttcccgtcctccccgtgcccacccgtccc

SEQ ID NO: 301384 - DNA, 590 bp, Homo sapiens
  misc_feature: GZ8MTXP02HIHXS.13.64.F09.1.454.CMB.2.raw
tcagtcacgtactacacgaccggtgctcgatttagcgcgtatacaagggggagtcatggatctcctgtgcaagaaaaatggagcacctgtggttcttcctcctgctggtggcggctcccagatgggtcctggcccaagtgcagttggtggagtcgggcccagggctggtgaagccttcgacgaccctgtccctcacttgcactgtctcaggtggctccattaaaaccagcagttatcacgtgggggtggatccggcaggcccccggggaaggagctggagtggagtggggagatttatatactggcaatacttacgacaatccgtccctacaagagtcgagtcaccctgtccgtgacacgccccgaaataaccagttctccctagaaacgtcgacctctgtcgaccgtcgcacgacacggctatttattattgtagtgagtatacgtacttttggaaatggctagtgactagatcgactacgtcgggccctaggatccgtggtccacccgtctcctcacgtccctaccacccgaaacgggcccctaacgtccggttcccttcccccgtacggtcccaaccccgttccccg

SEQ ID NO: 301385 - DNA, 560 bp, Homo sapiens
  misc_feature: GZ8MTXP02F1JY4.13.64.F09.1.454.CMB.2.raw
tcagtcacgtactacacgaccggtgctcgatttagcgcgtatacaagggggagtcatggatctcctgtgcaagaaaatggagcacctgtggttcttcctcctgctggtggcggctcccagatgggtcctggcccaagtgcagttggtggagtcgggcccagggctggtgaagccttcgacgaccctgtccctcacttgcactgtctcaggtggctccattaaaaccagcagttatcactgggggtgatccggcagcccccggggaaggagctggagtggatggggaggatttatatactggcaatacttacgacaatccgtccctacaagagtcgagtcaccctgtccgtggacacgccccgaataaccatttctccctgaaagtgacctctgtgaccgtcgcagacacggccctatttattattgtgtgagatacgtactttggaaatggctatgactcgatcgactacgtggggtccctggaactccgtggtcaccgtctcctcacgcctccaccgaacgggccccaagtccggtccttccccctggcccaccctccc

SEQ ID NO: 301386 - DNA, 506 bp, Homo sapiens
  misc_feature: GZ8MTXP02IX0SC.13.64.F09.1.454.CMB.2.raw
  modified_base (257)..(257): a, c, t, g, unknown or other
  misc_feature (257)..(257): n is a, c, g, or t
  modified_base (265)..(265): a, c, t, g, unknown or other
  misc_feature (265)..(265): n is a, c, g, or t
  modified_base (276)..(276): a, c, t, g, unknown or other
  misc_feature (276)..(276): n is a, c, g, or t
  modified_base (411)..(411): a, c, t, g, unknown or other
  misc_feature (411)..(411): n is a, c, g, or t
tcagtcacgtactacacgaccggtgctcgatttagcgcgtatacaagggggagtcagtctcagtcaggacacagcatggacatgagggtccccgctcagctcctggggctcctgctactctggctccgaggtgccagatgtgacacccagctgacccagtctcctgttttcctgtctgcctctgtgggcgacagagtcgacatcacttgccgggcaagtcagaatattaagacctattgaattggtatcagcaaacncaggaaanccccaaatccngatctcggtcatctcgtttgcaaagtggagtcccttcacggttcagtgcagtgatctgggacagacttcactctcaccatcgcagtcttacaacgtgacgactttgactaacgtactactgtcaacacgacctanacgtacacctcactagtttcgccgtagggacaggtaggaagtcgaaggactgtggctgcactatctgtactcacttcctaccgcactctagtaac

SEQ ID NO: 301387 - DNA, 530 bp, Homo sapiens
  misc_feature: GZ8MTXP02JQK32.13.64.F09.1.454.CMB.2.raw
  modified_base (250)..(250): a, c, t, g, unknown or other
  misc_feature (250)..(250): n is a, c, g, or t
  modified_base (259)..(259): a, c, t, g, unknown or other
  misc_feature (259)..(259): n is a, c, g, or t
  modified_base (269)..(269): a, c, t, g, unknown or other
  misc_feature (269)..(269): n is a, c, g, or t
  modified_base (365)..(365): a, c, t, g, unknown or other
  misc_feature (365)..(365): n is a, c, g, or t
  modified_base (524)..(524): a, c, t, g, unknown or other
  misc_feature (524)..(524): n is a, c, g, or t
tcagtcacgtactacacgaccggtgctcgatttagcgcgtatacaagggggagtcagtctcagtcaggacacagcatggacatgagggtccccgctcagctcctggggctcctgctactctggctccgaggtgccagatgtgacacccagctgacccagtctcctgtttcctgtctgcctctgtggcgacagagtcgacatcacttgccgggcaagtcagaatataagactattgattgtatcagcaacncaggaaacnccccaatccngatctcgtcatctcgttgacaagtgacgtcctcacggttcagtgcagtgactcgtggacagtacttcactctacaccatcgctagtctacaacgtnacgtactttgactaacgtactactagtacaaacacgtaacccttacaacgttaccacctcaacgttaggtttcggaccgaaggggaccaagggtgaaacgtcgaagggaactggtggctcgaccacgtatcgtagtcttcgattcccgtccactatccngtaacg

SEQ ID NO: 301388 - DNA, 591 bp, Homo sapiens
  misc_feature: GZ8MTXP02F7FBO.13.64.F09.1.454.CMB.2.raw
  modified_base (435)..(435): a, c, t, g, unknown or other
  misc_feature (435)..(435): n is a, c, g, or t
  modified_base (576)..(576): a, c, t, g, unknown or other
  misc_feature (576)..(576): n is a, c, g, or t
tcagtcacgtactacacgaccggtgctcgatttagcgcgtatacaagggggagtcatggatctcctgtgcaagaaaatggagcacctgtggttcttcctcctgctggtggcggctcccagatgggtcctggcccaagtgcagttggtggagtcgggcccagggctggtgaagccttcgacgaccctgtccctcacttgcactgtctcaggtggctccattaaaccagcagttatcacgtgggggtgatccggcacggcccccggggaaggagcgtggagtggagtggggaggatttatatactggacaatacttacgacaactccgtccctcaagagtcgagtccaccctgtccgtgacacgccccgaataaccagttcctcctagaagtcgacctctgtcgaccgtcgacgagacacggtcctatttatattgngttgagattacgtacgttttggaatggacttaagtgaactcggataccgactacgtcggggccctaggaacttccgtggtcctaccgtctcctcacgtcctacccaacgtaaccggcccacgtccggtacccttcccccgnggaccctaccctccc

SEQ ID NO: 301389 - DNA, 652 bp, Homo sapiens
  misc_feature: GZ8MTXP02HW7MD.13.64.F09.1.454.CMB.2.raw
tcagtcacgtactacacgaccggtgctcgatttagcgcgtatacaagggggagtcatggatctcctgtgcaagaaaaatggagcacctgtggttcttcctcctgctggtggcggctcccagatgggtcctggcccaagtgcagttggtggagtcgggcccagggctggtgaagccttcgacgaccctgtccctcacttgcactgtctcaggtgctccaattaaaaccagcagttatcacgtggggtggatccggcgacggcccccggggaaggagcgtggagtggagtggggagtatttatatacgtggacaatacttacgaacaactcccgtaccctacaagtacgtcgagtcacccgttcgtccgtacggactaccgacccgaaacgtaaccctacgttcctccctaaggaacgtcgtaacctctagccgtaccgtcgacagaccgtacgtcctaagtttacttagttgttgtagtatactacgttactttaggaattggacttaagttgaacttcgaagttccgaacgtaccggtcggggtccctagggtaacttccgtacggttcctaccggttcctaccctcgtaccgcctacccgaaccgacggccctacgttccggttcccctcccgtacgtccctacccctccg

SEQ ID NO: 301390 - DNA, 581 bp, Homo sapiens
  misc_feature: GZ8MTXP02F2NQP.13.64.F09.1.454.CMB.2.raw
tcagtcacgtactacacgaccggtgctcgatttagcgcgtatacaagggggagtcatggatctcctgtgcaagaaaatggagcacctgtggttcttcctcctgctggtggcggctcccagatgggtcctggcccaagtgcagttggtggagtcgggcccagggctggtgaagccttcgacgaccctgtccctcacttgcactgtctcaggtggctccattaaaaccagcagttatcacgtgggggtgatccggcacggcccccggggaaggagctggagtggagtggggaggatttatatactggacaatacttacgacaactccgtccctacaagagtcgagtccaccctgtccgtggacacgaccccgaataaccagttcctccctagaaacgtgacctctgtcgaccgtcgcagacacgcctatttattattgtgtgagatacgtactttgaatggctagtgactcgatcgactacgtcggggccctggaactccgtaggtcctaccgtctcctcacgccctaccaaccgaacggccctacgtcccggtcccttcccccgtaggccctacccctcccg

SEQ ID NO: 301391 - DNA, 665 bp, Homo sapiens
  misc_feature: GZ8MTXP02H6H09.13.64.F09.1.454.CMB.2.raw
  modified_base (234)..(234): a, c, t, g, unknown or other
  misc_feature (234)..(234): n is a, c, g, or t
tcagtcacgtactacacgaccggtgctcgatttagcgcgtatacaagggggagtcatggatctcctgtgcaagaaaatggagcacctgtggttcttcctcctgctggtggtggctcccagatgggtcctggccaagtgcagttggtggagtcgggcccagggctggtgaagccttcgacgaccctgtccctcacttgcactgtctcaggtggctccattaaaaccagcagttancacgtgggggtgacgtccggcacggacccccggggaaggagcgtggagtggagtggggagtatttatatacgtggactaactacgttacgaactaactcccgtaccctacgaagacgtcgacgtccaacccgtgtacccgtagaccgacgaccccgaaactaaccctagttaccctacccttaggaaacgtcgacccttactcgtacgacccgtcgacagacccgtaggccttaatttactagtgtagtagagtactacgtatttaggatggtacttagtcgacgtatacgtacacgtacggtccgggacttaggaacttccggtacggtacctacccgttctaccctacgacccgttacccacccgaacgaaccggtccccgtacgttacccggttccccttcccgccggtacccctacccccgtacccg

SEQ ID NO: 301392 - DNA, 559 bp, Homo sapiens
  misc_feature: GZ8MTXP02HRIXX.13.64.F09.1.454.CMB.2.raw
  modified_base (215)..(215): a, c, t, g, unknown or other
  misc_feature (215)..(215): n is a, c, g, or t
  modified_base (278)..(278): a, c, t, g, unknown or other
  misc_feature (278)..(278): n is a, c, g, or t
  modified_base (316)..(316): a, c, t, g, unknown or other
  misc_feature (316)..(316): n is a, c, g, or t
  modified_base (443)..(443): a, c, t, g, unknown or other
  misc_feature (443)..(443): n is a, c, g, or t
  modified_base (455)..(455): a, c, t, g, unknown or other
  misc_feature (455)..(455): n is a, c, g, or t
  modified_base (507)..(507): a, c, t, g, unknown or other
  misc_feature (507)..(507): n is a, c, g, or t
tcagtcacgtactacacgaccggtgctcgatttagcgcgtatacaagggggagtcagtctcagtcaggacacagcatggacatgagggtccccgctcagctcctggggctcctgctactctggctccgaggtgccagatgtgacacccagctgacccagtctcctgtttcctgtctgcctctgtgggcgacagagtcgacatcacttggccgggnaagtcagaatattaagactattgaattggtatcagcaaacaccaggaaacgcccccaaatccngactcttcggttcatctcgttgcaaagtggactccttnacggttcagtggcagtggactcgtggggacaggacttccgacttccgtcacattccgggactacggtacctttacaaaagtgtaacgtactttgacctaaacgtactactagtcaaacagacctaanacgtaccacctnacgtacgtttcgaccgaggggtaccaaggtggaagtacgaagggaacttggnggctgcaccagtctgtacttcgactccttcccgactacgttacctagtaacg

SEQ ID NO: 301393 - DNA, 673 bp, Homo sapiens
  misc_feature: GZ8MTXP02HZH0P.13.64.F09.1.454.CMB.2.raw
  modified_base (226)..(226): a, c, t, g, unknown or other
  misc_feature (226)..(226): n is a, c, g, or t
  modified_base (269)..(269): a, c, t, g, unknown or other
  misc_feature (269)..(269): n is a, c, g, or t
tcagtcacgtactacacgaccggtgctcgatttagcgcgtatacaagggggagtcatggatctcctgtgcaagaaaatggagcacctgtggttcttcctcctgctggtggtggctcccagatgggtcctggcccaagtgcagttggtggagtcgggcccagggctggtgaagccttcgacgaccctgtccctcacttgcactgtctcaggtgctccattaaaaccngcagttatcacgtgggggtgatccggcacggccccggggaagngctggagtggagtggggagatttatatacgtggacaatacttacgactaactcccgtaccctacgaagacgtcgacgtctaccccgtgtccgtaggaccacgaccccgaataacccagttcctccctagaacgtcgacctctgtcgaccgtcgcacgacacgacctatttacttattgttagtgagtaagttacgtacgttttaggaattggcttagttacgaccgttacggacgtaccgtacgtaacggtccgggtaccgttagtaaccgttcccgttacggttaccctaccggtttccctacccgtacctaaccggtccccctacccggaacccgtaccgggaaccccgtacgttccccggttcccccttcccccgtccggtaccctacccccgtaaccccg

SEQ ID NO: 301394 - DNA, 639 bp, Homo sapiens
  misc_feature: GZ8MTXP02J1OGJ.13.64.F09.1.454.CMB.2.raw
tcagtcacgtactacacgaccggtgctcgatttagcgcgtatacaagggggagtcatggatctcctgtgcaagaaaatggagcacctgtggttcttcctcctgctggtggcggctcccagatgggtcctggcccaagtgcagttggtggagtcgggcccagggctggtgaagccttcgacgaccctgtccctcacttgcactgtctcaggtggctccaattaaaaccagcagttatcacgtgggggtgatccggcacggcccccggggaagagcgtggagtggagtggggaggtatttatatacgtggacaatactacgacaactcccgtcctagaagagtcgagtccacccgtgtccgtggacacgacccgaataaccagttcctaccctagaaagtcgacctcgtgtcgaccgtcgacacgacacggctatttatattgtgtgagtatacgtactttaggaacttggactagtagtactacgagtacgaccgttaacgtcgggggtacccctttaggggaaacctttccgtcgggttaccctacccggttcctacccgttacgaccgtcccacccgaaccgtaaaccgggccctaacgttcccggtcccttcccccgtcggaccctacccttccccg

SEQ ID NO: 301395 - DNA, 703 bp, Homo sapiens
  misc_feature: GZ8MTXP02J1NW3.13.64.F09.1.454.CMB.2.raw
tcagtcacgtactacacgaccggtgctcgatttagcgcgtatacaagggggagtcatggatctcctgtgcaagaaaatggagcacctgtggttcttcctcctgctggtggcggctcccagatgggtcctggcccaagtgcagttggtggagtcgggcccagggctggtgaagccttcgacgaccctgtccctcacttgcactgtctcaggtggctccaattaaaacccagctagttatcacgtgggggtgatccggcacggccccggggaaggagcgtggaggtggagtggggagtatttatatacgtggacatacgttacgactaactcccgtcctacgaagacgtcgagtccacccgtggtcccgtaggaccacgccccgaaactaccagttcctcctagaaacgtcgtacctctcgtcgaccgtcgacacgaccacggtcctatttacttattgtgtgaagtacttaacgttactttaggaattggcttaagtctacgtcgtacgtccgtacgttaccgggtcggggtccctagggtaacctcccgttcgggtaccctaccggttccctcccggttaccaccggtaccctacccccgtaaacccgggtaaacccggggtccccgtaacccggttaccccggggtttccccctttcccccccgggttacggtacccccctaaccccccgtttaacccccgg

SEQ ID NO: 301396 - DNA, 699 bp, Homo sapiens
  misc_feature: GZ8MTXP02HD15D.13.64.F09.1.454.CMB.2.raw
  modified_base (225)..(225): a, c, t, g, unknown or other
  misc_feature (225)..(225): n is a, c, g, or t
  modified_base (336)..(336): a, c, t, g, unknown or other
  misc_feature (336)..(336): n is a, c, g, or t
tcagtcacgtactacacgaccggtgctcgatttagcgcgtatacaagggggagtcatggatctcctgtgcaagaaaatggagcacctgtggttcttcctcctgctggtggtggctcccagatgggtcctggcccaagtgcagttggtggagtcgggcccagggctggtgaagccttcgacgaccctgtccctcacttgcactgtctcaggtgctccattaaaccngcagttatcacgtgggggtgatccggcacggccccggggaaggacgcgtggagtggagtaggggagtatttagtatacgtggactaatacttacgacaatcccgtacctanaagagtcgagtccacctgtccgtgacacgccccgaaatacctgtcctcctagaaacgtcgaccctgtcgtacgaccgtcgacacgaccgaccggtaccttaatttacgttatttggtagttaggaactaagttaacgttacgttttagggaaattcgggtaccttaagttcgtaacccgttacgtaacgtaccgtaacgttacgggtaccgggtaccgtaggtaaaccgttcccgtacgttacccgtacccgttccttccccgacgtacccgtacccctacccgtaacccggaaccgggtccccttaacgggttccccgttaccccctttaccccggcccgtaccccctaaccccgttacccg

SEQ ID NO: 301397 - DNA, 712 bp, Homo sapiens
  misc_feature: GZ8MTXP02FUV9H.13.64.F09.1.454.CMB.2.raw
  modified_base (227)..(227): a, c, t, g, unknown or other
  misc_feature (227)..(227): n is a, c, g, or t
  modified_base (254)..(254): a, c, t, g, unknown or other
  misc_feature (254)..(254): n is a, c, g, or t
tcagtcacgtactacacgaccggtgctcgatttagcgcgtatacaagggggagtcatggatctcctgtgcaagaaaatggagcacctgtggttcttcctcctgctggtggcggctcccagatgggtcctggcccaagtgcagttggtggagtcgggcccagggctggtgaagccttcgacgaccctgtccctcacttgcactgtctcaggtgctccaattaaaaccngcagttatcacgtgggggtgatccggnacggccccggggaagagcgtggagtggagtgggagatttatatacgtggacaatacttacgaacaactccgtaccctacaagacgtcgagtccaccgtgtccgtgaccacgacccgtaaactaccgtagttccctcccgtaagaaacgttgacccttgtggtacacccgtcgacagaaccgacggtaccttaaattttagttatttggttagtgtaagtaacttaccgttacgtttttagggaaaacgttggtaactttaagtcgtaaccgttaccggaatacccgtacgtacggtcggggtaccccttagggaaaccttcccggtcggtaacctaccccggttcttccccgtactaccgtaccccttacccaacccggtaaaacgggccccctaaattcccccggggttaaccctttacccccccggtcggtaccccctaacccccgtttacccccg

SEQ ID NO: 301398 - DNA, 625 bp, Homo sapiens
  misc_feature: GZ8MTXP02FZ6C4.13.64.F09.1.454.CMB.2.raw
tcagtcacgtactacacgaccggtgctcgatttagcgcgtatacaagggggaggtcagtctcagtcaggacacagcatggacatgagggtccccgctcagctcctggggctcctgctactctggctccgaggtgccagatgtgacacccagctgacccagtctcctgttttcctgtctgcctctggtgggcgacagagtcgacatcacttgccgggacaagtcagaatattaagaccttatttgaatttggatcagacaaacaccgaagggaaacaccccccaaatcctgacttcttcggtacatcttcgtttagactaaaaggtcggtaccgttacccctttcgtaccgggtttcaggtcggctaggtggtactcgtaggggacaaggttaccttcaaccttctaccaccctaagtcccggataacgtttctactaacgtcgacgtactttacgactaacgttacgtactagtacaacacgacctaacaacgtaccacctacacgtagtttacggaccgagggaccgtaagggtacggaagtacgaaagggtacgtcggtaggcgtcgactacacgttcttcgttacctaacgtacctccgttacccgcctaactcgtagtacg

SEQ ID NO: 301399 - DNA, 735 bp, Homo sapiens
  misc_feature: GZ8MTXP02GHAVZ.13.64.F09.1.454.CMB.2.raw
tcagtcacgtactacacgaccggtgctcgatttagcgcgtatacaagggggagtcatggatctcctgtgcaagaaaatggagcacctgtggttcttcctcctgctggtggcggctcccagatgggtcctggcccaagtgcagttggtggagtcgggcccagggctggtgaagccttcgacgaccctgtccctcacttgcactgtctcaggtggctccattaaaaccagcagttatcacgtgggggtgagtccggcacggccccggggaaggagcgtggagtggatggggaggtatttattatactggacaaatacttacgactaatccgtcctacaagagtcgagtcaccttgtccgtgacacgacccgaataaccagttctccctagaaactgacctctgtcgtaccgtcgacgacgaaccacggtacctaagtttaattattgtacgttagaacgtaacgttaacgtacctttttagggaaaattgggtacttaaagttcgaaacgttaccggtactaaccggtaacctaacgggttccggggacccccttaaggggaaaccttcccggttacgggttacccctaacccggttcccgttaacccctaccgtaaccggtcccccttaacccgaaacccggtaaaacccgggggcccccttaaacccgttccccggggtttaaccccctttcccccccggaacgggttcccccctaacccccgtttaacccccgg

SEQ ID NO: 301400 - DNA, 534 bp, Homo sapiens
  misc_feature: GZ8MTXP02IER04.13.64.F09.1.454.CMB.2.raw
  modified_base (271)..(271): a, c, t, g, unknown or other
  misc_feature (271)..(271): n is a, c, g, or t
  modified_base (281)..(281): a, c, t, g, unknown or other
  misc_feature (281)..(281): n is a, c, g, or t
  modified_base (317)..(317): a, c, t, g, unknown or other
  misc_feature (317)..(317): n is a, c, g, or t
  modified_base (334)..(334): a, c, t, g, unknown or other
  misc_feature (334)..(334): n is a, c, g, or t
  modified_base (357)..(357): a, c, t, g, unknown or other
  misc_feature (357)..(357): n is a, c, g, or t
  modified_base (499)..(499): a, c, t, g, unknown or other
  misc_feature (499)..(499): n is a, c, g, or t
  modified_base (508)..(508): a, c, t, g, unknown or other
  misc_feature (508)..(508): n is a, c, g, or t
tcagtcacgtactacacgaccggtgctcgatttagcgcgtatacaagggggagtcagtctcagtcaggacacagcatggacatgagggtccccgctcagctccctggggctcctgctactctggctccgaggtgccagatgtgacacccagctgaccccagtctcctgttttcctgtctgcctctgtgggcgacagagtcgacatcacttggccgggacaagtcagaatattaagaccttattgaattggtatcagcaaacacaggaaacnccccaaatcngatcttcgtcatctgttgacaaagtggactcccttnacggttcagtgcagtgntcgtggcagacttcactctcacngtcgctagtcttcaacgtgacctattgactaacgtactactgtacaaactcgaacctataactacctacgttcacttagggtttacgccgaagggacctagggtaggaagtcgaaagggtactggtaggctggacacgtacncttagtctntacgtcttcccgctactcgtagtacg

SEQ ID NO: 301401 - DNA, 670 bp, Homo sapiens
  misc_feature: GZ8MTXP02I9AIM.13.64.F09.1.454.CMB.2.raw
  modified_base (336)..(336): a, c, t, g, unknown or other
  misc_feature (336)..(336): n is a, c, g, or t
tcagtcacgtactacacgaccggtgctcgatttagcgcgtatacaagggggagtcatggatctcctgtgcaagaaaatggagcacctgtggttcttcctcctgctggtggtggctcccagatgggtcctggcccaagtgcagttggtggagtcgggcccagggctggtgaagccttcgacgaccctgtccctcacttgcactgtctcaggtggctccaattaaaaccagcagttatcacgtggggtgagtccggcgacggaccccggggaaggagcgtggaggtggagtggggagtatttatatactggacaatacttacgacaactccgtcctanaagagtacgagtcctacccgtgtccggtagacctacggaccccgtaaactaacccagttacctcccgtagaaacgtcgacctcgtcgtacgaccgtcacgacgaacgcggtaccttatttaattagttcgtagtagaacgtacgttaaccgttagtttagggaaacttgggtaaccttagtcggaaaccttcggtaacgtaccggtaacttacggggtcgggtaccgtaggtacctccggtacgtacccgtaccttcctaccgtcaccgtcccctaaccgaccgtaccggaaccctacgtccgtaccccttccccgacgtaccctaccctaccg

SEQ ID NO: 301402 - DNA, 654 bp, Homo sapiens
  misc_feature: GZ8MTXP02G7BNV.13.64.F09.1.454.CMB.2.raw
  modified_base (227)..(227): a, c, t, g, unknown or other
  misc_feature (227)..(227): n is a, c, g, or t
tcagtcacgtactacacgaccggtgctcgatttagcgcgtatacaagggggagtcatggatctcctgtgcaagaaaatggagcacctgtggttcttcctcctgctggtggcggctcccagatgggtcctggcccaagtgcagttggtggagtcgggcccagggctggtgaagccttcgacgaccctgtccctcacttgcactgtctcaggtgctccaattaaaaccngcagttatcacgttgggggtgacgtccggcgacggccccggggaaggagcgtgggagtggagtggggagtatttatatacgtggactaagtacttacgactaacgtccgtacctacgaagagtcgaacgtccacccgtcgtccgtggaacctaccgacccgtaaactaacccgtagttcctaccgtagaaacgttcgaccttgtcgtcgacccgtgaccaggaccacggaccttatttaagttattcgtagtagaagtactaagtttctttaggaaattggtacttagtacgtactacgactcgtaccgtagtcgggacctggaacttctaggtaccacgttcctcgttcgacgtccctaccgaacccggtaaacggccctaacggttcccgttaccttcccccgtcggacccctaccccttacccg

SEQ ID NO: 301403 - DNA, 752 bp, Homo sapiens
  misc_feature: GZ8MTXP02FQ6BX.13.64.F09.1.454.CMB.2.raw
  modified_base (681)..(681): a, c, t, g, unknown or other
  misc_feature (681)..(681): n is a, c, g, or t
tcagtcacgtactacacgaccggtgctcgatttagcgcgtatacaagggggagtcatggatctcctgtgcaagaaaatggagcacctgtggttcttcctcctgctggtggcggctcccagatgggtcctggcccaagtgcagttggtggagtcgggcccagggctggtgaagccttcgacgaccctgtccctcacttgcactgtctcgaggtggctaccaattaaaaccagactagttatcgacggtgggggtgacgtccggcgaccgggaccccggggaaggcggcgtgggaggtggagtggggtagtatttattagtacgtggactaaattacttaacgaactaactcccgtaccctagaaagtcgtacgtacgtccaaccccgttcggtcccggtaggaaccaccggtacccccgtaaaactaaccccgtacgttacccttacccgtaagtaaacggttcgacccttcgttacggtaccgtacccgttacgaccaacgaaccgtaccggttacccttattttaagtttagtttgtagtaggtaacgtaacgttaccgttaaaggttttagggtaaagttcgggtaacttagtacgtaacctacggtaacttaccggtaacgttaccggtcgggggtaccctagtaacgtcccgtcgtaccgtaccgtcctccgtaacncgtcccctacacccggtaacggcccgttacgtcccggtcccttacccccgtcgtaccccaccctaaccccg

SEQ ID NO: 301404 - DNA, 619 bp, Homo sapiens
  misc_feature: GZ8MTXP02HZUOD.13.64.F09.1.454.CMB.2.raw
  modified_base (558)..(558): a, c, t, g, unknown or other
  misc_feature (558)..(558): n is a, c, g, or t
tcagtcacgtactacacgaccggtgctcgatttagcgcgtatacaagggggagtcatggatctcctgtgcaagaaaaatggagcacctgtggttcttcctcctgctggtggcggctcccagatgggtcctggcccaagtgcagttggtggagtcgggcccagggctggtgaagccttcgacgaccctgtccctcacttgcactgtctcaggtggctccaattaaaaccagcagttatcacgtgggggtgagtccggcacggccccggggaaggagcgtggagtggagtggggaggtatttaatatacgtggacaattactacgaactactcccgtaccctacaagtacggtcgacgtcacccgtaggtccgtaggacacgaccccgaaataaccctagttccttaccctaaggaaacgttcgtaaccttctcgtacgacccgtcgacacggaccacggtacctatttagtattgtgtagacgtattacgtactttaggaattggctatgacttgatcgactaggtcggccttaggactcgtggtccacgttcaccgtnacgtccctaccgaaccgacggtaaccctgttcccggtccctcccgtcgacctaccccgtcc

SEQ ID NO: 301405 - DNA, 602 bp, Homo sapiens
  misc_feature: GZ8MTXP02FO9R8.13.64.F09.1.454.CMB.2.raw
  modified_base (225)..(225): a, c, t, g, unknown or other
  misc_feature (225)..(225): n is a, c, g, or t
  modified_base (281)..(281): a, c, t, g, unknown or other
  misc_feature (281)..(281): n is a, c, g, or t
  modified_base (361)..(361): a, c, t, g, unknown or other
  misc_feature (361)..(361): n is a, c, g, or t
  modified_base (371)..(371): a, c, t, g, unknown or other
  misc_feature (371)..(371): n is a, c, g, or t
  modified_base (377)..(377): a, c, t, g, unknown or other
  misc_feature (377)..(377): n is a, c, g, or t
  modified_base (413)..(413): a, c, t, g, unknown or other
  misc_feature (413)..(413): n is a, c, g, or t
  modified_base (422)..(422): a, c, t, g, unknown or other
  misc_feature (422)..(422): n is a, c, g, or t
tcagtcacgtactacacgaccggtgctcgatttagcgcgtatacaagggggagtcatggatctcctgtgcaagaaatggagcacctgtggttcttcctcctgctggtgcggctcccagatgggtcctggcccaagtgcagttgtggagtcgggcccagggctggtgaagccttcgacgacccctgtcccctcacttgcactgtctcagtggctccattaaacccngcagttatcactggggtgatccgcagcccccggggaggagctggagtggatggggnggatttattatactggcatacttcgcaatccgtccctcaagagtcgagtcaccctgtccgtggacacgccccgatacccngttctccctnaaagtnacctctgtgaccgtcgcagaccacggtcccaatttnttattgttntgagatacgactttaggtaatggtactatgactacgatccgtacgtaaccgtcggggtccctaggtaactccgtcgtccgtacccgtccttccctaccacgtaccctccccaacccgaaccgggaaccccgtacgttcccggttcccttaccccccgttccgtacccgaccccctccccg

SEQ ID NO: 301406 - DNA, 698 bp, Homo sapiens
  misc_feature: GZ8MTXP02G4NTZ.13.64.F09.1.454.CMB.2.raw
  modified_base (230)..(230): a, c, t, g, unknown or other
  misc_feature (230)..(230): n is a, c, g, or t
  modified_base (616)..(616): a, c, t, g, unknown or other
  misc_feature (616)..(616): n is a, c, g, or t
tcagtcacgtactacacgaccggtgctcgatttagcgcgtatacaagggggagtcatggatctcctgtgcaagaaaatggagcacctgtggttcttcctcctgctggtggcggctcccagatgggtcctggcccaagtgcagttggtggagtcgggcccagggctggtgaagccttcgacgaccctgtccctcacttgcactgtctcgaggtgcctaccaattaaaaccngctagttatcacggtgggggtgacgtccggcgaccgggaccccggggaggagcgtggaggtggagtggggagtatttatatacgtggacaatacttacgactaacgttcccgtcctaacgaagcgtacgacgtccacccgttcgtccgtaggaacaccgtaccccgaaactaacctacggttacctacccgtaaggtaaacgtcgaaccgttcgtacgggttaccgaccgtcggacaacgggacccgaccggtaccctttaagttttattaagttggttgtaggaagtatttaaccggtagttttaggaaactcgggttataggtgtaacgtacgtacgtaccgtacgtaccgggtcgggtaccgtggtaactcgtacggtacccnccgttactcccgactcgtaccccaccgaccgacgggtcccctcgttcccggttccctccccggtccgtcccaccccttaccg

SEQ ID NO: 301407 - DNA, 662 bp, Homo sapiens
  misc_feature: GZ8MTXP02F2OXY.13.64.F09.1.454.CMB.2.raw
  modified_base (473)..(473): a, c, t, g, unknown or other
  misc_feature (473)..(473): n is a, c, g, or t
  modified_base (478)..(478): a, c, t, g, unknown or other
  misc_feature (478)..(478): n is a, c, g, or t
tcagtcacgtactacacgaccggtgctcgatttagcgcgtatacaagggggagtcatggatctcctgtgcaagaaaatggagcacctgtggttcttcctcctgctggtggtggctcccagatgggtcctggcccaagtgcagttggtggagtcgggcccagggctggtgaagccttcgacgaccctgtccctcacttgcactgtctcaggtggctccattaaaccagcagttatcacgtgggggtgactccggcacggcccccggggaaggagcgtgggagtggagtggggaggtatttagtatacgtggctaaatacgttacgaactactcccggtccctacaagtacgtacgaacgtccaacccgtgtccgtggaacctacgaccccgaaacttaacccaggttcctacccctaggaaacgtcgaaccctctgtacgacccgtcggacagacctacggtcctatttaactnttagngtagatatcgtatttaggaactggactagcgtactacgtagtaccgaagttccgggtacggggtccctaaggtacttccccggtggtacccaccgtttccctcccgttacgacccgtccctacccgaaccgaacccgtccgacgttcccgttaccccctccccgtcgacccttacccgtacccg

SEQ ID NO: 301408 - DNA, 687 bp, Homo sapiens
  misc_feature: GZ8MTXP02G92AE.13.64.F09.1.454.CMB.2.raw
  modified_base (225)..(225): a, c, t, g, unknown or other
  misc_feature (225)..(225): n is a, c, g, or t
  modified_base (338)..(338): a, c, t, g, unknown or other
  misc_feature (338)..(338): n is a, c, g, or t
tcagtcacgtactacacgaccggtgctcgatttagcgcgtatacaagggggagtcatggatctcctgtgcaagaaaaatggagcacctgtggttcttcctcctgctggtggcggctcccagatgggtcctggcccaagtgcagttggtggagtcgggcccagggctggtgaagccttcgacgaccctgtccctcacttgcactgtctcaggtgctcattaaaccngctagttatcacgtgggggtgactccggcacggccccggggaaggagcgtggagtggagtggggagtatttatatacgtgacaatacttacgaactaacgtcccgtaccctanaaggtacgtacgacgtcaccccgttcggtaccgtagaaccgacgaccccgtaaacgtaacctacgttcctacccgtagtaaaacgtcgtaacccttcgtcggttaccgaccgttacgacctaacggaaccgtaccggtacccttaatttagttatttgtgtagagtaacgtacgtacgttttaggaattgggacttagtgtactacgtaactaccgtaacgtaccggtcggggtaccccttaggaacgttccgtacggtacctacccgtctacccgtcaaccgtcctacccgaaccgaacggcccgtacgttcccggtcccttccccgacggtcccctaccctaccccg

SEQ ID NO: 301409 - DNA, 689 bp, Homo sapiens
  misc_feature: GZ8MTXP02GVGEA.13.64.F09.1.454.CMB.2.raw
  modified_base (225)..(225): a, c, t, g, unknown or other
  misc_feature (225)..(225): n is a, c, g, or t
  modified_base (462)..(462): a, c, t, g, unknown or other
  misc_feature (462)..(462): n is a, c, g, or t
  modified_base (665)..(665): a, c, t, g, unknown or other
  misc_feature (665)..(665): n is a, c, g, or t
tcagtcacgtactacacgaccggtgctcgatttagcgcgtatacaagggggagtcatggatctcctgtgcaagaaaatggagcacctgtggttcttcctcctgctggtggcggctcccagatgggtcctggcccaagtgcagttggtggagtcgggcccagggctggtgaagccttcgacgaccctgtccctcacttgcactgtctcaggtgctccattaaaccngcagttatcacgtgggggtgactccggcacggccccggggaagagcgtggagtggagtggggaggtatttagtatactggactaaatacgttacgactaaactcccgtccctacgaagtacgtccgaagtccaacccgttgtcccgttagggacctacggacccccgaaataacccgtagttcctaccctagaaacgttcgtaaccctgtcgtacgacccggtcgaccagggaaccncggaccttaatttagtatttgtgtagtaagtattaccgtagttttaggaaattggacttaagttggaactttcggaactcgtactacggtcgggtacccctaggtaactcccgtggtaccctacccggttctcccgtacgaaccggtccctaccgaaaccgtaccgggtccccgtaacttcccggttcccctttacccccggnggtaaccccctcccgtttaccccg

SEQ ID NO: 301410 - DNA, 704 bp, Homo sapiens
  misc_feature: GZ8MTXP02GM8Y3.13.64.F09.1.454.CMB.2.raw
  modified_base (229)..(229): a, c, t, g, unknown or other
  misc_feature (229)..(229): n is a, c, g, or t
  modified_base (349)..(349): a, c, t, g, unknown or other
  misc_feature (349)..(349): n is a, c, g, or t
tcagtcacgtactacacgaccggtgctcgatttagcgcgtatacaagggggagtcatggatctcctgtgcaagaaaaatggagcacctgtggttcttcctcctgctggtggcggctcccagatgggtcctggcccaagtgcagttggtggagtcgggcccagggctggtgaagccttcgacgaccctgtccctcacttgcactgtctcaggtggctccaattaaaaccngcagttatcacgtgggggtggatccggcgacggaccccggggaggacgcgtggagtggagtaggggaggtatttaagttatacgtggacaataacgttaacgactaacgtccgtaccctnaaacgtagtcgacgtcctaccgttcgtaccggtgtacgaccgaccccgtaaataacccgtacgttacctacccgtaagtaaacgtccgtacctcgtgtacgacccgtcgaccagacctacccggtacttacgtttaattatttcgtgtacgtaaatacgttacgtacttttagggaaattcgggactttaggtcgaacttccgtagtaaccgtcgtaacggtcggggtacctaggtaacgtccttaagggtccctaaccgttccttaccctcggaactccctaaaccgacccggaaacggtccccgtacgttcccggtacccctcccccggtcggtccccctttaaacccgcccg

SEQ ID NO: 301411 - DNA, 669 bp, Homo sapiens
  misc_feature: GZ8MTXP02H4MA6.13.64.F09.1.454.CMB.2.raw
  modified_base (233)..(233): a, c, t, g, unknown or other
  misc_feature (233)..(233): n is a, c, g, or t
  modified_base (284)..(284): a, c, t, g, unknown or other
  misc_feature (284)..(284): n is a, c, g, or t
tcagtcacgtactacacgaccggtgctcgatttagcgcgtatacaagggggagtcatggatctcctgtgcaaagaaaaatggagcacctgtggttcttcctcctgctggtggcggctcccagatgggtcctggcccaagtgcagttggtggagtcgggcccagggctggtagaagccttcgacgaccctgtccctcacttgcactgtctcgaggtgctacctaattaaaaccngactagttactcgacggtggggtgacgtccggcgacgggccccggggaagngcgtaggagtggagtgggagtattatatagtgactaatacgtacgacactcccgtaccctacgaagtgtaccgagtcctacccgtcgtccgtggaaccaccggtaccccgaaaactaaccctagtttaccctaccgtagtaaaacgtcgaccttcgtggtacgacccgtcgacaacgtaccgacgaccttatttaattagttgtagtgtatacgtacgttagtttacgaagtggtactagtcgtacgttagactaccgtacgtacggtcgggaccgttgaacgtcgtacgtctaccgtcctccgtacaccgtccctacccgaccggaacccggccctaacgttccccgtttcccgtaccccggtccgtacccctaccccgtcccg

SEQ ID NO: 301412 - DNA, 680 bp, Homo sapiens
  misc_feature: GZ8MTXP02HJFVP.13.64.F09.1.454.CMB.2.raw
  modified_base (257)..(257): a, c, t, g, unknown or other
  misc_feature (257)..(257): n is a, c, g, or t
  modified_base (272)..(272): a, c, t, g, unknown or other
  misc_feature (272)..(272): n is a, c, g, or t
tcagtcacgtactacacgaccggtgctcgatttagcgcgtatacaaggggggagtcagtctcagtcaggacacagcatggacatgagggtccccgctcagctcctggggctcctgctactctggctccgaggtgccagatgtgacacccagctgacccagtctccttgttttcctgtctgcctctggtgggcacagagtcgacatcacttggccgggacaagtcaagaatattaagacctatttgaattggatcagnaaacaccagggaacnccccaaatcctgatcttcggttcatcttcgtttgactaaaaggtcggtaacgttcccctttacgaccggtttcaaggttcggactaggtaggaacttcgtaggggactaggacttccaactctccaaccagttccggactacgtcttacgaacgtgaccgtacgtttgactaaacgttactactgtacaaatacgaacctacacgtaacaccgttactaacgttacgggttttacggaccggtaaacgggggaccgtaaaacggggttacgggtaaacggttacgaaaacgggggtaacgttacggggtacgggtccgttacggaccttaaaccgtacgttcgttacggttacccgttcttaacgtttcccttacccgtaccgtacgtttaccgttacgggttaaacg

SEQ ID NO: 301413 - DNA, 615 bp, Homo sapiens
  misc_feature: GZ8MTXP01ENE33.52.69.G03.1.454.CMB.2.raw
  modified_base (393)..(393): a, c, t, g, unknown or other
  misc_feature (393)..(393): n is a, c, g, or t
tcagcgcagtacgacacgaccggtgctcgatttagtcgctgcgtaaaggagaaaggggctgagctgggttttccttgttgctgttttagaaggtgtccagtgtgaggtgcacctggtggagtccggggagacttggtccaggccgggggtccctgacaatttcctgtgcaggctccgggttcagtttcagtgattcctggatgagctgggtccgccaggctccgaggggagggggcgtggacgtgggtggccagtaataaacccggatggaagtattaggctactttgggtattctgtgacgggcggtcacatctccagggacaacaccgcgaaactccttctatctaacaaatgagcagccttagaggcgaggactcccgctgtctattacngtcgcgacccgtccgggggcagggaaacgtctttgccctcgtggggcccggggaacccggtcaccgtctccctcacgccctcaccaagggcccagtccggggtccttcccccgtgggcccgccctcgcctaccgacggacgccacctccgacgaacgcacgacgccggcccgtcggcgttcgccgtcggtcgaacggactacttacctaacttaacgtaacg

SEQ ID NO: 301414 - DNA, 618 bp, Homo sapiens
  misc_feature: GZ8MTXP01BPU77.52.69.G03.1.454.CMB.2.raw
  modified_base (563)..(563): a, c, t, g, unknown or other
  misc_feature (563)..(563): n is a, c, g, or t
tcagcgcagtacgacacgaccggtgctcgatttagtcgctgcgtaaaggagaaaggggggctgagctgggttttccttgttgctgttttagaaggtgtccagtgtgaggtgcacctggtggagtccgggggagacttggtccaggccggggggtccctgacaatttcctgtgcaggctccgggttcagtttcagtgattcctggatgagctgggtccgccaggctccgaggggaggggctggacgtgggtggccagtataaacccggatggaagtattaggctacgttttggggtattctggtggacgggccggttcaccatctccgagggacaaccaccgcgaaactccttctatctaacaaatgagcagccttagaggcgaggactccccggctgtctattactgtcgccgacccgtccgggggacagggaaacgtcttttgcctcgtcggggccgggaacccggtcaccgtctcctcacgcctccgaccaacgggcccagtccgggggtccttcccccgtggccgccctgacctccgaggcgccacctccgagcgcacgngccggcctcggggcttcgcctgggtcaagggtcctacgttccctaattaacggcg

SEQ ID NO: 301415 - DNA, 621 bp, Homo sapiens
  misc_feature: GZ8MTXP01C2OJE.52.69.G03.1.454.CMB.2.raw
  modified_base (332)..(332): a, c, t, g, unknown or other
  misc_feature (332)..(332): n is a, c, g, or t
  modified_base (396)..(396): a, c, t, g, unknown or other
  misc_feature (396)..(396): n is a, c, g, or t
  modified_base (558)..(558): a, c, t, g, unknown or other
  misc_feature (558)..(558): n is a, c, g, or t
tcagcgcagtacgacacgaccggtgctcgatttagtcgctgcgtaaaggagaaaggggggctgagctgggtttccttgttgctgttttagaaggtgtccagtgtgaggtgcacctggtggagtccggggagacttggtccagccggggggtccctgacaatttcctgtgcaggctccgggttcagtttcagtgattcctggatgagctgggtccgccaggcctccgaggggagggggctggacgtgggtggccagtaataaacccggatggaagtattaggctacgtttggggtattctggtgacgggccggtcaccatctcagggacaacncgcgaactcttctatctaacaaatgagcagccttagaggcgaggactccccgctgtctattacngtgccgacccgtcgggggacaaggaaacgcttttgccctccgtgggggcccgggaaccggtcacccgtctctcacgccctccaccgaacgggcccagtccggggtcccttccccgtggcccgtccctcgcctccgaggcgtccaccgtccgagaacgtcacncggccgccccgtggggccttcgcccgttgggacaacggtaccttacttcctaagttcgtaacg

SEQ ID NO: 301416 - DNA, 612 bp, Homo sapiens
  misc_feature: GZ8MTXP01EIJ9O.52.69.G03.1.454.CMB.2.raw
  modified_base (271)..(271): a, c, t, g, unknown or other
  misc_feature (271)..(271): n is a, c, g, or t
  modified_base (533)..(533): a, c, t, g, unknown or other
  misc_feature (533)..(533): n is a, c, g, or t
tcagcgcagtacgacacgaccggtgctcgatttagtcgctgcgtaaaggagaaagggggggctgagctgggttttccttgttgctgttttagaaggtgtccagtgtgaggtgcacctggtggagtccgggggagacttggtccaggccggggggtccctgacaatttcctgtgcaggctccgggttcagtttcagtgattcctggatgagctgggtccgccaggctccgaggggagggggctggacgtgggtggccagtaataaacccggntggaagtattaggctactttggggtattctgtggacgggcggtcacatctcagggacaacaccgcgaaactccttctatctaacaaatgagcagccttagaggcgaggactccccgctgtctattactgtgcgacccgtcggggcaggaacgtctttgccctcgtcggggccgggaccggtcaccgtctcctcacgccctccaccgaacgggccctacgttccggggtccttccccgtggcccgcccctgcctccgaggacncccacctccgagaacgccaacgcggccggcccgtgggccttgccctgggtaccaaggtactacttcctaagttcgaacg

SEQ ID NO: 301417 - DNA, 483 bp, Homo sapiens
  misc_feature: GZ8MTXP01BOAAQ.52.69.G03.1.454.CMB.2.raw
  modified_base (255)..(255): a, c, t, g, unknown or other
  misc_feature (255)..(255): n is a, c, g, or t
  modified_base (272)..(272): a, c, t, g, unknown or other
  misc_feature (272)..(272): n is a, c, g, or t
  modified_base (342)..(342): a, c, t, g, unknown or other
  misc_feature (342)..(342): n is a, c, g, or t
  modified_base (436)..(436): a, c, t, g, unknown or other
  misc_feature (436)..(436): n is a, c, g, or t
  modified_base (454)..(454): a, c, t, g, unknown or other
  misc_feature (454)..(454): n is a, c, g, or t
  modified_base (459)..(459): a, c, t, g, unknown or other
  misc_feature (459)..(459): n is a, c, g, or t
  modified_base (469)..(469): a, c, t, g, unknown or other
  misc_feature (469)..(469): n is a, c, g, or t
  modified_base (478)..(478): a, c, t, g, unknown or other
  misc_feature (478)..(478): n is a, c, g, or t
  modified_base (483)..(483): a, c, t, g, unknown or other
  misc_feature (483)..(483): n is a, c, g, or t
tcagcgcagtacgacacgaccggtgctcgatttagtcgctgcgtaaaggagaaaggggggggtcagtcccagtcaggacacagcatggacatgagggtccccgctcagctcctggggctcctgctgctctggctcccaggtgccagatgtgacatccagttgacccagtctccatccttcctgtctgcatctgtggggacagagtcaccatcacttgccggacagtgaggacatctacactagattagctggtancagcaaggaaccggganacgcccctaaatcctgatccatactgcatccactttgcatgctggggcccattcaggttcgcgcaagtgntctggggacagtaacttcactctacacaatcagcagcctgacagactgaacactacccgataaatttatactgtacaacacgtcaccgttaccntcactcggcaaggcacgnagganattagactgngctgcactnttctn

SEQ ID NO: 301418 - DNA, 544 bp, Homo sapiens
  misc_feature: GZ8MTXP01ECDYG.52.69.G03.1.454.CMB.2.raw
  modified_base (258)..(258): a, c, t, g, unknown or other
  misc_feature (258)..(258): n is a, c, g, or t
  modified_base (361)..(361): a, c, t, g, unknown or other
  misc_feature (361)..(361): n is a, c, g, or t
  modified_base (393)..(393): a, c, t, g, unknown or other
  misc_feature (393)..(393): n is a, c, g, or t
  modified_base (519)..(519): a, c, t, g, unknown or other
  misc_feature (519)..(519): n is a, c, g, or t
tcagcgcagtacgacacgaccggtgctcgatttagtcgctgcgtaaaggagaaaggggggggtcagtcccagtcaggacacagcatggacatgagggtccccgctcagctcctggggctcctgctgctctggctcccaggtgccagatgtgacatccagttgacccagtctccatccttcctgtctgcatctggtgggggacagagtcaccatcacttgccggacagtgaggacatctacactagattagcctggtancagacaaaggaaccggggagacgacccctaaactcctagactccatactgcatccactttgcatcgcgtcggggtccctagttcgaggttcggcgcaagtggntcgtgggacagaacttcactctacacaatcancagcctagcagactacgaacgactcgaacttaatttaattactagtacaaacaccgtcaacccgttaccgatccaccttcggaaccgaaggacacggcgtaggaagttaacgttaaacgacttggnggtaactgaccacctaattcgttcg

SEQ ID NO: 301419 - DNA, 567 bp, Homo sapiens
  misc_feature: GZ8MTXP01D3G9S.52.69.G03.1.454.CMB.2.raw
tcagcgcagtacgacacgaccggtgctcgatttagtcgctgcgtaaaggagaaaggggggggtcagtcccagtcaggacacagcatggacatgagggtccccgctcagctcctggggctcctgctgctctggctcccaggtgccagatgtgacatccagttgacccagtctccatccttcctgtctgcatctgtggggacagagtcacatcacttgccggacagtgaggacatctacactagattagcctggtatcagcaaaggaaccgggagacgcccctaaaactcctgactccatactgcactcctactttgcattcgcgtcggggtccctagttcgaggttcggcgcaaaggtgaatcgtaggggacagtaacttcactctacacatcagcacgcctgacagactacgaacgtacctacgtacttaaatttattactacgttacaaacgtaccttaccgtaacccgtttacccactacctaccgttccggaaccgtaacgggacgacggcgtaggaacgttaacgttaaacgacgtggtggtctcgacacctaagttcgttcg

SEQ ID NO: 301420 - DNA, 755 bp, Homo sapiens
  misc_feature: GZ8MTXP01BDBKA.52.69.G03.1.454.CMB.2.raw
  modified_base (259)..(259): a, c, t, g, unknown or other
  misc_feature (259)..(259): n is a, c, g, or t
tcagcgcagtacgacacgaccggtgctcgatttagtcgctgcgtaaaggagaaagggggggtcagtcccagtcaggacacagcatggacatgagggtccccgctcagctcctggggctcctgctgctctggctcccaggtgccagatgtgacatccagttgacccagtctccatccttcctgtctgcatcgtggtgggggacagagtcaccatcacttcgccgacagtggagactatctacactagattagcctggtancagacaaacggaaccgggagaccgaccccctaaatccctagtactaccaattacgtcgactaacttccctaacttttgcctagttcgtccggttcgggggtcccctaagtttccggtacggggtttccgggcggacgtaagggttacgggaacgttcggtaaggggaacctaaaggtaaactttcccgaacttacccttaccaaacttaaactacgaaacggcctaacgggccccttagaccgaacgtaaccgtaggaaaccggtacccgttaccccgtaaagtttaaacgtttttaacgttaaccttacggttaaacccaaacctaaacccgttaccccgtaaaccccggttttaaccccgaacctttacccgtacccggtttacccgggaacccgggtaaacgggttaccgaccgggttaccgtaaggggtaacttaaacggttaaacgttaccgtaaggtcggtctacgacccacgtaacgttcgtttaaccg

SEQ ID NO: 301421 - DNA, 569 bp, Homo sapiens
  misc_feature: GZ8MTXP01CO2NW.52.69.G03.1.454.CMB.2.raw
  modified_base (265)..(265): a, c, t, g, unknown or other
  misc_feature (265)..(265): n is a, c, g, or t
  modified_base (329)..(329): a, c, t, g, unknown or other
  misc_feature (329)..(329): n is a, c, g, or t
  modified_base (540)..(540): a, c, t, g, unknown or other
  misc_feature (540)..(540): n is a, c, g, or t
tcagcgcagtacgacacgaccggtgctcgatttagtcgctgcgtaaaggagaaagggggggtcagtcccagtcaggacacagcatggacatgagggtccccgctcagctcctggggctcctgctgctctggctcccaggtgccagatgtgacatccagttgacccagtctccattccttcctgtctgcatcgtggtgggggacagagtcaccatctacgttcgccggacagtgaggacatctacactagtattacgcctaggtancaagacaaaggaaccgggagacgacccctaaactcctagactccatactgacactcctactttnctatcgcgtcggggaccctattacgtacggggttcggacggcgtaagggtcggtaatccgtaggggacctaaggtaacttcactctacaacaatcagacacgctgacagtcaagaacgactccgattaatttatactagaccaactacgtactaccggttacctactactaccgtcgaaccgaaggacgacgcgtagggattacgttaacntaaggtcgctcgacactaacttcgttccg

SEQ ID NO: 301422 - DNA, 634 bp, Homo sapiens
  misc_feature: GZ8MTXP01CGNNI.52.69.G03.1.454.CMB.2.raw
  modified_base (256)..(256): a, c, t, g, unknown or other
  misc_feature (256)..(256): n is a, c, g, or t
  modified_base (275)..(275): a, c, t, g, unknown or other
  misc_feature (275)..(275): n is a, c, g, or t
  modified_base (365)..(365): a, c, t, g, unknown or other
  misc_feature (365)..(365): n is a, c, g, or t
tcagcgcagtacgacacgaccggtgctcgatttagtcgctgcgtaaaggagaaaggggggggtcagtcccagtcaggacacagcatggacatgagggtccccgctcagctcctggggctcctgctgctctggctcccaggtgccagatgtgacatccagttgacccagtctccatccttcctgtctgcatcgtggtggggacagagtcacatcacttgccggacagtgaggacatctacactagattagctggtancagacaaggaaccgggganacgacccctaaactcccagactccaatactgactactcctactttgctagtgcgtcggggtaccctagttcgaggttcgcggcaaggtgntcgtagggactagaacttcactctacaacatcagcagcctagcagaactgaaacgtacctaccgtaactttaaagttttaacttaacctacggtaaacctaaaccgtaaccgttacccgtaaacccgtttacccgtaacttcccgtaaccccgttccgggaaacccgaaaggggttacccaaacgggttccgtaaagggtaacgttaaacgtttaaacgaaccgttggtacgggaaccttggacccttaacccgttcgttccgttaacg

SEQ ID NO: 301423 - DNA, 531 bp, Homo sapiens
  misc_feature: GZ8MTXP01AXTO6.52.69.G03.1.454.CMB.2.raw
  modified_base (256)..(256): a, c, t, g, unknown or other
  misc_feature (256)..(256): n is a, c, g, or t
  modified_base (274)..(274): a, c, t, g, unknown or other
  misc_feature (274)..(274): n is a, c, g, or t
  modified_base (376)..(376): a, c, t, g, unknown or other
  misc_feature (376)..(376): n is a, c, g, or t
tcagcgcagtacgacacgaccggtgctcgatttagtcgctgcgtaaaggagaaagggggggtcagtcccagtcaggacacagcatggacatgagggtccccgctcagctcctggggctcctgctgctctggctcccaggtgccagatgtgacatccagttgacccagtctccatccttcctgtctgcatctggtggggacagagtcaccatcacttgccggacagtgaggacatctacactagattagcctggtancagcaaggaaccgggganacgcccctaaatcctgactccatactgcatccactttgctatgctggggtcccattcgaggttcggcgcaagtgaatcgtagggacagaattcactctacanaatcagcagcctgacagactagaacactaccgactaatttacttactcgtacaacgtacgtccaaccgttaccataccaccgttcggaaccgaaagggcctacggcgtaggtaacgttaacgttaaacgactggtcgctcgcactaacttccttg

SEQ ID NO: 301424 - DNA, 655 bp, Homo sapiens
  misc_feature: GZ8MTXP01CFREE.52.69.G03.1.454.CMB.2.raw
  modified_base (362)..(362): a, c, t, g, unknown or other
  misc_feature (362)..(362): n is a, c, g, or t
  modified_base (376)..(376): a, c, t, g, unknown or other
  misc_feature (376)..(376): n is a, c, g, or t
  modified_base (389)..(389): a, c, t, g, unknown or other
  misc_feature (389)..(389): n is a, c, g, or t
  modified_base (551)..(551): a, c, t, g, unknown or other
  misc_feature (551)..(551): n is a, c, g, or t
  modified_base (575)..(575): a, c, t, g, unknown or other
  misc_feature (575)..(575): n is a, c, g, or t
  modified_base (589)..(589): a, c, t, g, unknown or other
  misc_feature (589)..(589): n is a, c, g, or t
tcagcgcagtacgacacgaccggtgctcgatttagtcgctgcgtaaaggagaaagggggggctgagctgggttttccttgttgctgttttagaaggtgtccagtgtgaggtgcacctggtggagtccgggggagacttggtccaggccggggggtccctgacaatttcctgtgcaggctccgggttcagtttcagtgattcctggatgagctgggtccgccaggctccgagggggaggggcgtggacgtgggtaggccaaggtaactaaacccgggatagggaagttagttaggctacgttttgggtattcgtggtggacgggtccgtcaccatctccgaggacaacaccgcgaactccttnatctaacaaatgancagtccttaaggnggcgaggacctcccgctgtctattacgtgtcgccgacccggtcgggggacaaggaaccgttcgtttcgcccgttccggtcgggggacccggggtaacccggtcctaccgtcgtcctcgacgtcccaccaccgaacggccctagtccggggtcccttccccgnggccctcccgtgcctcgacgggcnccaccgccgaagcncacgcggttcccgcccgtggcgttcggccgttgggacaacggtcctcttacgtaacgttcgtaacg

SEQ ID NO: 301425 - DNA, 625 bp, Homo sapiens
  misc_feature: GZ8MTXP01CDFAR.52.69.G03.1.454.CMB.2.raw
  modified_base (407)..(407): a, c, t, g, unknown or other
  misc_feature (407)..(407): n is a, c, g, or t
  modified_base (526)..(526): a, c, t, g, unknown or other
  misc_feature (526)..(526): n is a, c, g, or t
  modified_base (561)..(561): a, c, t, g, unknown or other
  misc_feature (561)..(561): n is a, c, g, or t
tcagcgcagtacgacacgaccggtgctcgatttagtcgctgcgtaaaggagaaagggggggctgagctgggttttccttgttgctgttttagaaggtgtccagtgtgaggtgcacctggtggagtccgggggagacttggtccagccgggggggtccctgacaatttcctgtgcaggctccgggttcagtttcagtgattcctggatgagcgtgggtcccgccaggcctccgaggggaggggctgggacgtgggtggccagtactaaacccggatagggaagtattaggctacgttttggggtattcgtggtggacgggccgtcacatctcgaggacacgacgcgaactccttcatctaacaaatgacgcagtcttaggagcgaggactccccgactgtctattacngtcgccgacccgtccggggactaggaacgtctttgccctccggtgggggcccgggaccgtcacccgtctacctcgacgccctaccgaccgacgggcccacgttcggtcccttccccggngccctacccctgcccttacgacgggcaccctaccnccgagaacgccttacggcgccggaccgtggcttcgcctggacaacggtctacgttctaagcgtg

SEQ ID NO: 301426 - DNA, 728 bp, Homo sapiens
  misc_feature: GZ8MTXP01BY6TQ.52.69.G03.1.454.CMB.2.raw
  modified_base (143)..(143): a, c, t, g, unknown or other
  misc_feature (143)..(143): n is a, c, g, or t
  modified_base (249)..(249): a, c, t, g, unknown or other
  misc_feature (249)..(249): n is a, c, g, or t
  modified_base (261)..(261): a, c, t, g, unknown or other
  misc_feature (261)..(261): n is a, c, g, or t
  modified_base (299)..(299): a, c, t, g, unknown or other
  misc_feature (299)..(299): n is a, c, g, or t
tcagcgcagtacgacacgaccggtgctcgatttagtcgctgcgtaaaggagaaagggggggggtcagtcccagtcaggacacagcatggacatgagggtccccgctcagctcctggggctcctgctgctctggctcccaggtnccagatgtgacatccagttgacccagtctccatccttcctgtctgcatcgtggtgggggacagagtccaccatcattcgacccggacagtgaagacatctacatanattagctaggancagacaaaggaacgggagaacgacccctaaatctagancccatacctgaccatacctacctttagctagtcgtcggtaccggggttaccctaagtttccggaggtttccgggcggtacgtaaaggtagggtaacgttaccggagggggttaaaccaggtaaacttacctaaacttcctaacgaacccaaattcaacggtcaacggccctttaggacctaaggaaccttaagtaaacggaacgttaacccgtaccgttaaattttaaacgtttaacgttaacgttaaccgtaaaccaaaccgttacccgtaaacccggttaacccgtaaccttaccgttaacccgttacccgggtaacggtaaaccgggaaacggaacggttaccgtacgggtaaacggttaaagtttaaaacgaaaccgtaacgggttaggtaacggtcgtaccacccgtaacgttccgttttcccg

SEQ ID NO: 301427 - DNA, 529 bp, Homo sapiens
  misc_feature: GZ8MTXP02IJJRP.52.69.G03.1.454.CMB.2.raw
  modified_base (269)..(269): a, c, t, g, unknown or other
  misc_feature (269)..(269): n is a, c, g, or t
tcagcgcagtacgacacgaccggtgctcgatttagtcgctgcgtaaaggagaaaggggggtcagtcccagtcaggacacagcatggacatgagggtccccgctcagctcctggggctcctgctgctctggctcccaggtgccagatgtgacatccagttgacccagtctccatccttcctgtctgcatctgtggggacagagtcaccatcacttgccggacagtgaggacatctacactagattagctgtatcagcaagaaccgggganacgacccctaaactcctgatccatactgcatccactttgcatcgcgtcggggtcccattcgaggttcggcggtcaggttggatcgtgggacagaattcactctcacaatcagcagctgcagacagaagactacgactaatttattactactactaacaacgtacctacccgtaacccgtactacctaccgttaccgaccgaacggacgacggacgacggagaacgtaaacgaacgtaagtgacgtcacactactacttcg

SEQ ID NO: 301428 - DNA, 508 bp, Homo sapiens
  misc_feature: GZ8MTXP02GOSUI.52.69.G03.1.454.CMB.2.raw
  modified_base (275)..(275): a, c, t, g, unknown or other
  misc_feature (275)..(275): n is a, c, g, or t
  modified_base (347)..(347): a, c, t, g, unknown or other
  misc_feature (347)..(347): n is a, c, g, or t
tcagcgcagtacgacacgaccggtgctcgatttagtcgctgcgtaaaggagaaagggggggtcagtcccagtcaggacacagcatggacatgagggtccccgctcagctcctggggctcctgctgctctggctcccaggtgccagatgtgacatccagttgacccagtctccatccttcctgtctgcatctgtgggggacagagtcaccatcacttgccggaccagtgaggacatctacactagattagcctggtatcagcaaggaaccgggganagcccctaaactcctgatccatactgcatccactttgcatgctggggtcccattcaggttcgcgcagttggntctgggacagaattcactctacacaatcagcagcctgcagactagaagacctcgactaatttatactgtaccaaactacgtcctaccgtaccgatcctaccgttcggaccaagggaccacggctaggaacacttaaacgactgtcggctcgcactatcttc

SEQ ID NO: 301429 - DNA, 505 bp, Homo sapiens
  misc_feature: GZ8MTXP02JL1L6.52.69.G03.1.454.CMB.2.raw
  modified_base (347)..(347): a, c, t, g, unknown or other
  misc_feature (347)..(347): n is a, c, g, or t
tcagcgcagtacgacacgaccggtgctcgatttagtcgctgcgtaaaggagaaaggggggtcagtcccagtcaggacacagcatggacatgagggtccccgctcagctcctggggctcctgctgctctggctcccaggtgccagatgtgacatccagttgacccagtctccatccttcctgtctgcatctgtgggggacagagtcaccatcacttgccggaccagtgaggacatctacactagattagcctggtatcagcaagaaccgggagacgcccctaaactcctgactccatactgcatccactttgctatgctggggtcccattcaggttcgcggcaggtgntcgtgggacagaattcactctacacaatcagcagcctgcagactgaagactccgataatttatactgtacaactacgtacaccgtaccgatcacctcggacaacggacacggcgtaggacgtaacgttaaacgactgtcggactacgcacctatctcg

SEQ ID NO: 301430 - DNA, 481 bp, Homo sapiens
  misc_feature: GZ8MTXP02JS9KF.52.69.G03.1.454.CMB.2.raw
  modified_base (273)..(273): a, c, t, g, unknown or other
  misc_feature (273)..(273): n is a, c, g, or t
  modified_base (344)..(344): a, c, t, g, unknown or other
  misc_feature (344)..(344): n is a, c, g, or t
  modified_base (450)..(450): a, c, t, g, unknown or other
  misc_feature (450)..(450): n is a, c, g, or t
  modified_base (454)..(454): a, c, t, g, unknown or other
  misc_feature (454)..(454): n is a, c, g, or t
  modified_base (466)..(466): a, c, t, g, unknown or other
  misc_feature (466)..(466): n is a, c, g, or t
  modified_base (469)..(469): a, c, t, g, unknown or other
  misc_feature (469)..(469): n is a, c, g, or t
tcagcgcagtacgacacgaccggtgctcgatttagtcgctgcgtaaaggagaaaggggggtcagtcccagtcaggacacagcatggacatgagggtccccgctcagctcctggggctcctgctgctctggctcccaggtgccagatgtgacatccagttgacccagtctccatccttcctgtctgcatctgtgggggacagagtcaccatcacttgccggaccagtgaggacatctacactagattagcctggtatcagcaagaaccgggganacgcccctaaactcctgatccatactgcatccatttgcatgctggggtccattcaggttcggcgcagtggntctgggacagaattcactctcacaatcagcagcctgcagactgaagactccgacaatttatactgtacaacacgtcaaccgtaccatcactcgacaaggcacggcngganataaacgactgngcncacacactctcg

SEQ ID NO: 301431 - DNA, 522 bp, Homo sapiens
  misc_feature: GZ8MTXP02HM0CB.52.69.G03.1.454.CMB.2.raw
  modified_base (272)..(272): a, c, t, g, unknown or other
  misc_feature (272)..(272): n is a, c, g, or t
tcagcgcagtacgacacgaccggtgctcgatttagtcgctgcgtaaaggagaaagggggggtcagtcccagtcaggacacagcatggacatgagggtccccgctcagctcctggggctcctgctgctctggctcccaggtgccagatgtgacatccagttgacccagtctccatccttcctgtctgcatctggtggggacagagtcaccatcacttgccggacagtgaggacatctacactagatagcctggtatcagcaaggaaccggganacgacccctaaactcctagactccatactgcatccactttgcatgcgtcggggtccattcgaggttcgcggcaggtgacgtcgtagggactagtaacttcacttcacacaaatcagcagcctgacaagactagaacgacctaccgataaattttatactagtacaaactacgtacaccgttacgataccacttcgacaagggcacggctagaactacgtaaacgagtgcgactcgactaccgattctacg

SEQ ID NO: 301432 - DNA, 665 bp, Homo sapiens
  misc_feature: GZ8MTXP02G95VO.52.69.G03.1.454.CMB.2.raw
  modified_base (276)..(276): a, c, t, g, unknown or other
  misc_feature (276)..(276): n is a, c, g, or t
  modified_base (403)..(403): a, c, t, g, unknown or other
  misc_feature (403)..(403): n is a, c, g, or t
tcagcgcagtacgacacgaccggtgctcgatttagtcgctgcgtaaaggagaaagggggggtcagtcccagtcaggacacagcatggacatgagggtccccgctcagctcctggggctcctgctgctctggctcccaggtgccagatgtgacatccagttgacccagtctccatccttcctgtctgcatctggtgggggacagagtcacatcattgccggacagtgaggacatctacactagattagcctggtatacagacgaaggaaccgggganaccgacccctaaactcctagactccatacagacctactccacgtttgctatcgcgtcggggtaccacgtttcgacgggttcggcggcgtaggtggctcggtagggaacctagtaattccactcctanaactaaatccgagcacgctacggacaacgatacgaacgtaccctaccggtaactttaaacttttattaaccgttacgtaaaccaaacgttaaacccgtacccgtaaaccccggtttaaccctaccgttaccctaaccccggttaaccggaaccggtaaaacgggggaccgaaccggtaccggttaaggaaaccgtaaaacgtttaaaacccggaacgttggttacggacgttaccggaacctaaaccctcggtttacttccg

SEQ ID NO: 301433 - DNA, 586 bp, Homo sapiens
  misc_feature: GZ8MTXP02F2OEQ.52.69.G03.1.454.CMB.2.raw
  modified_base (352)..(352): a, c, t, g, unknown or other
  misc_feature (352)..(352): n is a, c, g, or t
tcagcgcagtacgacacgaccggtgctcgatttagtcgctgcgtaaaggagaaagggggggtcagtcccagtcaggacacagcatggacatgagggtccccgctcagctcctggggctcctgctgctctggctcccaggtgccagatgtgacatccagttgacccagtctccatccttcctgtctgcatctgtgggggacagagtcaccatcacttgccggacagtgaggacatctacactagattagcctggtatcagacaaggaaccggggagacgaccccctaaaactcctgatccatactgcatccatttgcatgcgtggggtcccattcgaggttcggcgcagtggntcgtggacagaattcactctacacaatcagcagcctgcaagactagaacgacctaccgactaatttaacttactacgtacaaacctaaccgtacctaacccgttaacccgactccgtacccgttcggacccgtaaacggggaccaacgggaccgttaagggaacgtaaaacgttaaaaccggtaaaccgtaaggttacggaccttacggaccctaacccgtactccgtttaccg

SEQ ID NO: 301434 - DNA, 710 bp, Homo sapiens
  misc_feature: GZ8MTXP02ICZ22.52.69.G03.1.454.CMB.2.raw
  modified_base (278)..(278): a, c, t, g, unknown or other
  misc_feature (278)..(278): n is a, c, g, or t
tcagcgcagtacgacacgaccggtgctcgatttagtcgctgcgtaaaggagaaagggggggtcagtcccagtcaggacacagcatggacatgagggtccccgctcagctcctggggctcctgctgctctggctcccaggtgccagatgtgacatccagttgacccagtctccatccttcctgtctgcatctggtgggggacagagtcaccatcacttgccggacagtgaggacatctaacactagattagcctggtatcagacgaaggaaccgggganacgacccctaaacgtcctgactccatactgctactccctatttgacctagtcggtccgttcggggtcccctagtttccggacggggtttcggacgggtcgtagggtcgggtagttccggtaggggaaccaaggttaactttcccaatttacccaccctaaacaaacgttacacggacaacgtcccgtgacgaacgacgtacgaacgtaccttcccgtaacttaaattttattaacctcggttaaccaaaccgtaaccgttacccgtaacccggtttaccccgtaacttaccccgtaacccggtttaccggaacccggaaaaccggggttaccgaaaccgggttaccgtaagggggtaaactaaaaccgttaaacccggtaaagttccgggttacggaaccttcggaaccctaccctaagttccgtttaaccg

SEQ ID NO: 301435 - DNA, 504 bp, Homo sapiens
  misc_feature: GZ8MTXP02GLJNC.52.69.G03.1.454.CMB.2.raw
  modified_base (272)..(272): a, c, t, g, unknown or other
  misc_feature (272)..(272): n is a, c, g, or t
  modified_base (347)..(347): a, c, t, g, unknown or other
  misc_feature (347)..(347): n is a, c, g, or t
tcagcgcagtacgacacgaccggtgctcgatttagtcgctgcgtaaaggagaaagggggggtcagtcccagtcaggacacagcatggacatgagggtccccgctcagctcctggggctcctgctgctctggctcccaggtgccagatgtgacatccagttgacccagtctccatccttcctgtctgcatctgtggggacagagtcaccatcacttgccggacagtgaggacatctacactagattagcctggtatcagcaagaaccgggganacgcccctaaactcctgatccatactgcatccactttgcatgctggggtccattcgaggttcgcggtcaggtggntcgtggggacagaattcactctacacaaatcagcagctgcagactagaacgactccgataatttatactgtacaacacgtcaccgtaccatctactcggactaggactacgctacggacgaacttaaacgactgacggtctacgctaccactctacg

SEQ ID NO: 301436 - DNA, 524 bp, Homo sapiens
  misc_feature: GZ8MTXP02I1PMQ.52.69.G03.1.454.CMB.2.raw
  modified_base (352)..(352): a, c, t, g, unknown or other
  misc_feature (352)..(352): n is a, c, g, or t
  modified_base (356)..(356): a, c, t, g, unknown or other
  misc_feature (356)..(356): n is a, c, g, or t
tcagcgcagtacgacacgaccggtgctcgatttagtcgctgcgtaaaggagaaaggggggtcagtcccagtcaggacacagcatggacatgagggtccccgctcagctcctggggctcctgctgctctggctcccaggtgccagatgtgacatccagttgacccagtctccatccttcctgtctgcatctgtgggggacagagtcaccatcacttgccggaccagtgaggacatctacactagattagcctggtatcagcaaggaaccggggagacgaccccctaaaactcctgatccatactgcatccactttgctatgctggggtcccattcgaggttcgcggcagtggntcgngggacagattcactctacacaatcagcagcctgcagactagaacgtactccgataaatttatactgtacaacaacgtccaaccgttaccgataccaccgttcggaccaagggcaacggctaggaacgaacttaaacggaactggtacggctcgaccacctatcgttcg

SEQ ID NO: 301437 - DNA, 513 bp, Homo sapiens
  misc_feature: GZ8MTXP02IHRSO.52.69.G03.1.454.CMB.2.raw
  modified_base (274)..(274): a, c, t, g, unknown or other
  misc_feature (274)..(274): n is a, c, g, or t
  modified_base (348)..(348): a, c, t, g, unknown or other
  misc_feature (348)..(348): n is a, c, g, or t
tcagcgcagtacgacacgaccggtgctcgatttagtcgctgcgtaaaggagaaagggggggtcagtcccagtcaggacacagcatggacatgagggtccccgctcagctcctggggctcctgctgctctggctcccaggtgccagatgtgacatccagttgacccagtctccatccttcctgtctgcatctgtgggggacagagtcaccatcacttgccggaccagtgaggacatctacactagattagcctggtatcagcaagaaccgggganagcccctaaatccctgatccatactgcatccactttgcatgctggggtcccagttcaggttcggcggcaggtgngtctggggacagaattcactctacacatcagcagcctgcagactagaagactccgactaatttactactgtacaacaacgtccaccgttaccatcaaccgttcgaccaaggcacggctaggacgaactttaacgaacgtgtacggactacggacacctatcttcg

SEQ ID NO: 301438 - DNA, 505 bp, Homo sapiens
  misc_feature: GZ8MTXP02HR27B.52.69.G03.1.454.CMB.2.raw
  modified_base (351)..(351): a, c, t, g, unknown or other
  misc_feature (351)..(351): n is a, c, g, or t
  modified_base (376)..(376): a, c, t, g, unknown or other
  misc_feature (376)..(376): n is a, c, g, or t
tcagcgcagtacgacacgaccggtgctcgatttagtcgctgcgtaaaggagaaagggggggtcagtcccagtcaggacacagcatggacatgagggtccccgctcagctcctggggctcctgctgctctggctcccaggtgccagatgtgacatccagttgacccagtctccatccttcctgtctgcatctggtggggacagagtcaccatcacttgccggacagtgaggacatctacactagattagcctggtatcagcaaagaaccgggagacgcccctaaactcctgatccatactgcatcctactttgcatgctggggtcccagttcgaggttcggcggcaggtggntcgtagggacagtaacttcacttcncaacaatcagcagctgcagactgaagactcgactaattttatactgtaccaaacacgtacaccgtaccatcaccgttcgaccaaggacacgctaggacgtacttaaacgatgtggctcgacaccatctc

SEQ ID NO: 301439 - DNA, 502 bp, Homo sapiens
  misc_feature: GZ8MTXP02JXSNF.52.69.G03.1.454.CMB.2.raw
  modified_base (466)..(466): a, c, t, g, unknown or other
  misc_feature (466)..(466): n is a, c, g, or t
  modified_base (473)..(473): a, c, t, g, unknown or other
  misc_feature (473)..(473): n is a, c, g, or t
  modified_base (485)..(485): a, c, t, g, unknown or other
  misc_feature (485)..(485): n is a, c, g, or t
  modified_base (489)..(489): a, c, t, g, unknown or other
  misc_feature (489)..(489): n is a, c, g, or t
  modified_base (498)..(498): a, c, t, g, unknown or other
  misc_feature (498)..(498): n is a, c, g, or t
tcagcgcagtacgacacgaccggtgctcgatttagtcgctgcgtaaaggagaaagggggggtcagtcccagtcaggacacagcatggacatgagggtccccgctcagctcctggggctcctgctgctctggctcccaggtgccagatgtgacatccagttgacccagtctccatccttcctgtctgcatctgtgggggacagagtcaccatcacttgccggaccagtgaggacatctacactagattagcctggtatcagcaaggaaccggggagacgcccctaaaactcctgatccatactgcatccactttgcatgcgtgggtccatcgaggttcggcggcagtggatcgtagggacagtaattcactctacacaaatcaagcagcctgaccaagacctagaaacgactccgactaatttactactagtacaaacacgtcaccgttaccatcactcgacaggcncgcaganactaacgactgngtcncgacacacnctcg

SEQ ID NO: 301440 - DNA, 558 bp, Homo sapiens
  misc_feature: GZ8MTXP02HMCHF.52.69.G03.1.454.CMB.2.raw
  modified_base (273)..(273): a, c, t, g, unknown or other
  misc_feature (273)..(273): n is a, c, g, or t
tcagcgcagtacgacacgaccggtgctcgatttagtcgctgcgtaaaggagaaagggggggtcagtcccagtcaggacacagcatggacatgagggtccccgctcagctcctggggctcctgctgctctggctcccaggtgccagatgtgacatccagttgacccagtctccatccttcctgtctgcatctgtgggggacagagtcaccatcacttgccggacagtgaggacatctacactagattagcctggtatcagcaaggaaccggganacgcccctaaactcctgactccatactgcatcccatttgctatgcgtcggggtcccattcgaggttcggcggcaggtgatcgtagggacagattcactctcacatcagcagcctgcagactagaactacctccgactaaattttactactagtacaaaccacgtaccaacccgttaccgatccctaccgttccggaaccgaaacggggacctacgggaccgttagggaaacgtaacgttaaaacgaaccgtggttcgaccgtacgacctacctacgtttacttcg

SEQ ID NO: 301441 - DNA, 585 bp, Homo sapiens
  misc_feature: GZ8MTXP02IGOB5.52.69.G03.1.454.CMB.2.raw
  modified_base (277)..(277): a, c, t, g, unknown or other
  misc_feature (277)..(277): n is a, c, g, or t
  modified_base (353)..(353): a, c, t, g, unknown or other
  misc_feature (353)..(353): n is a, c, g, or t
  modified_base (359)..(359): a, c, t, g, unknown or other
  misc_feature (359)..(359): n is a, c, g, or t
tcagcgcagtacgacacgaccggtgctcgatttagtcgctgcgtaaaggagaaagggggggtcagtcccagtcaggacacagcatggacatgagggtccccgctcagctcctggggctcctgctgctctggctcccaggtgccagatgtgacatccagttgacccagtctccatccttcctgtctgcatctggtgggggacagagtcaccatcacttgccggacagtgaggacatctaacactagattagcctggtatcagcaaaggaaccgggganacgacccctaaactcctagactccatactgcatcctatttgcatcgacgtggggtcccattcgagggttcggcggnaggtgntcgtagggacagaattcactcactacaatcagcagcctggactaagacgtagaacgacctaccgataaacttttattacctagttaccaaacgtaacgtacctaacccgttaacccgactaccgtaacccgtttacggacccgaaaggggtaccaacggtacgtaacggaacgtaaacgttaaaacgaccgtaaggtacggcttacggacctacccattacgttcg

SEQ ID NO: 301442 - DNA, 712 bp, Homo sapiens
  misc_feature: GZ8MTXP02HYPWG.52.69.G03.1.454.CMB.2.raw
  modified_base (183)..(183): a, c, t, g, unknown or other
  misc_feature (183)..(183): n is a, c, g, or t
tcagcgcagtacgacacgaccggtgctcgatttagtcgctgcgtaaaggagaaagggggggtcagtcccagtcaggacacagcatggacatgagggtccccgctcagctcctggggctcctgctgctctggctcccaggtgccagatgtgacatccagttgacccagtctccatccttccgtntgcatctggtggggacgagagtcacactcacttgccggaccagtgagacatctacactagatagtcctggtatacagacgaaggaaccgggagacgaccccctaaactcctgactccatactgcactcctactttagcatcgcgtacggggtccctattccgaggttccggcgacgtagtggtactcggtaggacgtagtactttacgactacttacccaagaaactcgaagcgacgtcccgtagaccaagaaccctaggaaccgtaaccgtccccgttaaattaaactttttattaaacggtaccgtttaacccgaaaacccttaaccggttcccgttaaaacccccggtttaccccgaatttacccccgttaacccgggttaccccgggaaccggaaaaacggggttccccgaaaccggggtacctttaagggggaaaaccttaaacggttttaaaaaaccccgggtcggttacgggtaaccggtcctaacggaccctaaccgtttactttacggtttccgttaacc

SEQ ID NO: 301443 - DNA, 599 bp, Homo sapiens
  misc_feature: GZ8MTXP02HP9T3.52.69.G03.1.454.CMB.2.raw
  modified_base (378)..(378): a, c, t, g, unknown or other
  misc_feature (378)..(378): n is a, c, g, or t
tcagcgcagtacgacacgaccggtgctcgatttagtcgctgcgtaaaggagaaagggggggtcagtcccagtcaggacacagcatggacatgagggtccccgctcagctcctggggctcctgctgctctggctcccaggtgccagatgtgacatccagttgacccagtctccatccttcctgtctgcatctgtgggggacagagtcaccatcacttgccggacagtgaggacatctacactagattagcctggtatcagcaaaggaaccggggagacgacccctaaactcctgactccatactgcatccatttgcatgcgtcggggtcccagttcgaggttcggcggcaggtggatcgtgggactagtaattcactcncaacaatcaagcagccctgcaagactagaacgacctccgtataaactttttatacttagtaacaaaccgtaacgtacctaacccggtttacccacttacccgtaccgtttaccgggaaccgaaacggggtaccgaccgggtacgtacggtaaacgtaaacgtttaaaaccgaacgttaagggtacgggaccttacggacctaacctacgtttacgtttccg

SEQ ID NO: 301444 - DNA, 763 bp, Homo sapiens
  misc_feature: GZ8MTXP02ISK5Y.52.69.G03.1.454.CMB.2.raw
  modified_base (98)..(98): a, c, t, g, unknown or other
  misc_feature (98)..(98): n is a, c, g, or t
  modified_base (133)..(133): a, c, t, g, unknown or other
  misc_feature (133)..(133): n is a, c, g, or t
  modified_base (365)..(365): a, c, t, g, unknown or other
  misc_feature (365)..(365): n is a, c, g, or t
tcagcgcagtacgacacgaccggtgctcgatttagtcgctgcgtaaggagaaaggggggctgagctgggttttccttgttgctgttttagaaggtgtnccagtgtgaggtgcacctggtggagtccggggganacttggtccagccggggggtccctgacaatttcctgtgcaggctccgggttcagtttcagtgattcctggatgagctgggtccgccaggctaccgaggggaggggcgtggactggggtcgccagtaataaacccggatggaagttattaggctacgtttgggtattctggtgacggggccggttcaccactctccagggaccaacaccgcgaaactccttctatctaaaacncacgagactacgcgtacgaggcgacgaccgtccgtctcgttctacttacggtcgtcggacccgtacccggggtaccgggacgggtaaacgtaacggttcgtttacccgttcccgtcccggggttccgggggacccgggggtacccgggccgttacccgacccgttcctaccgacccgtacccgtaccccgaaacccggaacccggaccggttcccgtcgtaccccgcttccccggtccggtcccccgtcccggtccggtcccgtaccggaccggtaccgaccgacccgtacccggaaccgaccggaccgccggaccgggacccggtacccggtccgggtccggtccggtaccggttacggtaccggtaaccggtaccgtaaccggttaaccgtaaccg

SEQ ID NO: 301445 - DNA, 594 bp, Homo sapiens
  misc_feature: GZ8MTXP02JF2PH.52.69.G03.1.454.CMB.2.raw
  modified_base (369)..(369): a, c, t, g, unknown or other
  misc_feature (369)..(369): n is a, c, g, or t
tcagcgcagtacgacacgaccggtgctcgatttagtcgctgcgtaaaggagaaagggggggtcagtcccagtcagtacacagcatggacatgagggtccccgctcagctcctggggctcctgctgctctggctcccaggtgccagatgtgacatccagttgacccagtctccatccttcctgtctgcatctggtgggggacagagtcaccatcacttgccggaccagtgaggacatctacactagattagcctggtatcagcaaaggaaccggggagacgcccctaaactccgtagactcccatactgccactccactttgctatcgcgtcggggtcccagttccgaggttcggcgctaggtggatcgnggggacagtattcactctacacatcagcagcctgacacgactagaacgtactaccgtacttaatttactactagtaaccaactaacgtacctaacccgttaccactacctaccgttaccggaccgtaaacggggaccgaccgggtacgtacgggtaaacgtaaacgtttaaaacggaacgttcggtaacggtccgttacggaccgaaccgttacgtctttaccgg

SEQ ID NO: 301446 - DNA, 581 bp, Homo sapiens
  misc_feature: GZ8MTXP02I88H8.52.69.G03.1.454.CMB.2.raw
  modified_base (275)..(275): a, c, t, g, unknown or other
  misc_feature (275)..(275): n is a, c, g, or t
tcagcgcagtacgacacgaccggtgctcgatttagtcgctgcgtaaaggagaaagggggggtcagtcccagtcaggacacagcatggacatgagggtccccgctcagctcctggggctcctgctgctctggctcccaggtgccagatgtgacatccagttgacccagtctccatccttcctgtctgcatctgtgggggacagagtcaccatcacttgccggaccagtgaggacatctacactagattagcctggtatcagcaaggaaccgggganacgcccctaaactcctgatccatactgcatccactttgctatgctcggggtcccagttcgaggttcggcggcaggtggatcgtggggacagtaacttcaactctacaactaatcagcagcctgacagactagaacgacctaccgtactaattttactacttagtaccaaacctaacgtaccgtaacccgttacccgacttaccctaccgttaccggaccgaaacgggaccgaccgggtacgttacgggaactaaaacgttaaacgtaaacgtgtaacggtcgtacgaccaccgtacttacgtttcg

SEQ ID NO: 301447 - DNA, 674 bp, Homo sapiens
  misc_feature: GZ8MTXP02I25VW.52.69.G03.1.454.CMB.2.raw
  modified_base (365)..(365): a, c, t, g, unknown or other
  misc_feature (365)..(365): n is a, c, g, or t
tcagcgcagtacgacacgaccggtgctcgatttagtcgctgcgtaaaggagaaaggggggctgagctgggttttccttgttgctgttttagaaggtgtccagtgtgaggtgcacctggtggagtccgggggagacttggtccagccgggggggtccctgacaatttcctgtgcaggctccgggttcagtttcagtgattcctggatgagctgggtccgccaggctccgaggggagggggctggactgggtggccagtataaacccggatggaagtattaggctacgtttggggtattcgtgtggacgggccggttcaccatctccgagggacaacaccgcgaactccttctatctaacaaatgancagccttagaggcgaggactcccgctgtctattactgtcgccgacccgtccgggggacaacgggaaacgtacttttcgccctccggtcgggggacccggggaaccccgggtccaacccggttcctcccgtccgacgcccctcccgaacccgaacggggcccccacgttcccgggtccctttcccccgtgggcccgtcccctcgcctcccgaggacgcccaccgtccgagacgccacgacggccggcccgtcggggcctcggcccgtcgggtacaaacgggtaccttaccgtttaccgacgttaacggcg

SEQ ID NO: 301448 - DNA, 541 bp, Homo sapiens
  misc_feature: GZ8MTXP02IZ2ZU.52.69.G03.1.454.CMB.2.raw
  modified_base (277)..(277): a, c, t, g, unknown or other
  misc_feature (277)..(277): n is a, c, g, or t
tcagcgcagtacgacacgaccggtgctcgatttagtcgctgcgtaaaggagaaagggggggtcagtcccagtcaggacacagcatggacatgagggtccccgctcagctcctggggctcctgctgctctggctcccaggtgccagatgtgacatccagttgacccagtctccatccttcctgtctgcatctggtgggggacagagtcaccatcacttgccggacagtgaggacatctaacactagattagcctggtatcagcaaaggaaccgggganacgacccctaaatcctgactccatactgcatccatttgcatgcgtggggtcccattcgaggttcggcggcagttggatcgtaggggaccagtaattcactctacaacaatcagcacgcctggcagactagaacgactccgataatttattaactgtaacaaactacgttaccaccgtttaccatccgaaccgttccggaacaacgggacacggctaggacgtaaacttaaacgaactgtacggactacgacacacgttcgtacg

SEQ ID NO: 301449 - DNA, 514 bp, Homo sapiens
  misc_feature: GZ8MTXP02FU3VF.52.69.G03.1.454.CMB.2.raw
  modified_base (345)..(345): a, c, t, g, unknown or other
  misc_feature (345)..(345): n is a, c, g, or t
tcagcgcagtacgacacgaccggtgctcgatttagtcgctgcgtaaaggagaaagggggtcagtcccagtcaggacacagcatggacatgagggtccccgctcagctcctggggctcctgctgctctggctcccaggtgccagatgtgacatccagttgacccagtctccatccttcctgtctgcatctgtgggggacagagtcaccatcacttgccggaccagtgaggacatctacactagattagcctggtatcagacaaggaaccggggagacgacccctaaactcctgatccatactgcatccactttgcatgctgggtccattcaggttcgcgcagtggntctgggacagaattcactctacacaatcagcagcctgacagactagaacgactccgactaatttattactacgtacaactaacgtacaccgttaccactcaccgttcggacaacgggaccacggactaggacgtaacttaaacgacgtgtacgactcgacaccatcgtg

SEQ ID NO: 301450 - DNA, 680 bp, Homo sapiens
  misc_feature: GZ8MTXP02IE3L1.52.69.G03.1.454.CMB.2.raw
tcagcgcagtacgacacgaccggtgctcgatttagtcgctgcgtaaaggagaaagggggggtcagtcccagtcaggacacagcatggacatgagggtccccgctcagctcctggggctcctgctgctctggctcccaggtgccagatgtgacatccagttgacccagtctccatccttcctgtctgcatctggtgggggacagagtcaccatcacttgccggacagtgaggacatctacactagattagcctggatcagacaaggaaccggggagacgacccctaaactcctgactccatactgctactcctactttgactagtcgcgtcggggtcccagttccgtacggggttcggcggactaggtggtacgtcgttagggggacctaaggtaaactttccgaaacttcctacctaacaaacttcaacgcaaccggtcctacgacgtaagaccgtagaaacgacccgtaccgtaccttaaatttttaacttaccttaggttaaccaaaccgtaaaccgttaccctaaaccccggtttacccgtaacttacccgaacccgtttaccgggaccgaaaacggggaccgaaccgggtaccggtagggtaaacgtaacgtttaaaacggaaccgtttaaggtacggcgttacggacccgtaacccgtaatttaccggtttaccg

SEQ ID NO: 301451 - DNA, 571 bp, Homo sapiens
  misc_feature: GZ8MTXP02JL0OT.52.69.G03.1.454.CMB.2.raw
  modified_base (257)..(257): a, c, t, g, unknown or other
  misc_feature (257)..(257): n is a, c, g, or t
  modified_base (276)..(276): a, c, t, g, unknown or other
  misc_feature (276)..(276): n is a, c, g, or t
  modified_base (398)..(398): a, c, t, g, unknown or other
  misc_feature (398)..(398): n is a, c, g, or t
  modified_base (403)..(403): a, c, t, g, unknown or other
  misc_feature (403)..(403): n is a, c, g, or t
  modified_base (411)..(411): a, c, t, g, unknown or other
  misc_feature (411)..(411): n is a, c, g, or t
  modified_base (427)..(427): a, c, t, g, unknown or other
  misc_feature (427)..(427): n is a, c, g, or t
tcagcgcagtacgacacgaccggtgctcgatttagtcgctgcgtaaaggagaaaggggggggtcagtcccagtcaggacacagcatggacatgagggtccccgctcagctcctggggctcctgctgctctggctcccaggtgccagatgtgacatccagttgacccagtctccatccttcctgtctgcatctggtgggggacaggagtcaccatcacttgccgacagtgagacatctacactagattagcctagtancagacaaaggaaccggganaccgacccctaaactcctagactccatactgcaacttcctaactttgactagtcgtacgtcggggtccctaagttcgagggttccggcggtcagttcgatcgaggacagtattcactcacanaactnagcagccngacagacagaactacnctaataatttatactagtaacaaactacgtacctaaccgttaccataccgtacgtcggaaccgaacggacgacggacgttaaggaacgtaaacttaaaaccgaacgttggccggtaaccgtacgaacctacctacgtcgttacg

SEQ ID NO: 301452 - DNA, 541 bp, Homo sapiens
  misc_feature: GZ8MTXP02J1765.52.69.G03.1.454.CMB.2.raw
tcagcgcagtacgacacgaccggtgctcgatttagtcgctgcgtaaaggagaaagggggggtcagtcccagtcaggacacagcatggacatgagggtccccgctcagctcctggggctcctgctgctctggctcccaggtgccagatgtgacatccagttgacccagtctccatccttcctgtctgcatctggtggggacagagtcaccatcacttgccggacagtgaggacatctacactagattagcctggtatcagcaaggaaccggggagacgacccctaaactcctgactccatactgcatcctatttgcatcgcgtcggggtcccagttcgaggttcggcggcaggtgatcgtagggacagtaattcactctacaacatcagcagcctgcagactagaacgactccgactaatttatactacgtacaaacgtaacgtaccaacccgttacccgactaccgacccgttcggaccgaaacgggcaacggctaggacgaacttaaacgaactggtacggctacgacacctactcttcg

SEQ ID NO: 301453 - DNA, 596 bp, Homo sapiens
  misc_feature: GZ8MTXP02GD4BP.52.69.G03.1.454.CMB.2.raw
  modified_base (426)..(426): a, c, t, g, unknown or other
  misc_feature (426)..(426): n is a, c, g, or t
tcagcgcagtacgacacgaccggtgctcgatttagtcgctgcgtaaaggagaaagggggggtcagtcccagtcaggacacagcatggacatgagggtccccgctcagctcctggggctcctgctgctctggctcccaggtgccagatgtgacatccagttgacccagtctccatccttcctgtctgcatctggtgggggacagagtcaccatcacttgccgacagtgagacatctacactagattagcctggtatcagcgaaaggaaccggggagacgacccctaaactcctagactccaatactgactactcctactttgctatcgcgtcggggtccccagtttccgacgggttcggcggtacgtaggtggagtcgtggggaaactaagtaacttcaactctacaactaaatccaagcacgtccncgacgagacacgaacgtacctacctaacttaaatttacttactacgtaaccaaacctaaccgttacctaacccgttaccactaccgtaccgtaccggaaccgaacgggaccgacggacgtaacggaacgtaaactaaacgacgtcgtacgtactacacctactactctcg

SEQ ID NO: 301454 - DNA, 635 bp, Homo sapiens
  misc_feature: GZ8MTXP02GV6I3.52.69.G03.1.454.CMB.2.raw
  modified_base (368)..(368): a, c, t, g, unknown or other
  misc_feature (368)..(368): n is a, c, g, or t
tcagcgcagtacgacacgaccggtgctcgatttagtcgctgcgtaaaggagaaagggggggtcagtcccagtcaggacacagcatggacatgagggtccccgctcagctcctggggctcctgctgctctggctcccaggtgccagatgtgacatccagttgacccagtctccatccttcctgtctgcatctggtggggacagagtcaccatcacttgccgacagtgaggacatctacactagattagcctggtatcagcgaaaggaaccggggagacgacccctaaacgtcctagacttaccatactgactaactcctactttgctatcgtcgtcggggtcccagttcgaggttcggcggcaggtggntcgtgggacagtaactcactctacacaaatcagacacgcctgacagaactacgaaacgtaccgtaccgtacttaaacttttacttaactacggtaaccgtaaaaccctaccgttaaccgtaaccccgtttaaccccgacttacccgtacccgttaccggaaccgaaacggggaccgtaacggacgtaacgggtaacgtaaaacgttaaaaccggtaacgtaaggttaccggtacgttacggacctaaacccgttacgttcgtttacg

SEQ ID NO: 301455 - DNA, 587 bp, Homo sapiens
  misc_feature: GZ8MTXP02GXV26.52.69.G03.1.454.CMB.2.raw
  modified_base (279)..(279): a, c, t, g, unknown or other
  misc_feature (279)..(279): n is a, c, g, or t
  modified_base (495)..(495): a, c, t, g, unknown or other
  misc_feature (495)..(495): n is a, c, g, or t
tcagcgcagtacgacacgaccggtgctcgatttagtcgctgcgtaaaggagaaaggggggggtcagtcccagtcaggacacagcatggacatgagggtccccgctcagctcctggggctcctgctgctctggctcccaggtgccagatgtgacatccagttgacccagtctccatccttcctgtctgcatctggtgggggacagagtcaccatcacttgccggaccagtgaggacatcacactagattagcctggtactcaagcaaaggaaccgggganacgacccctaaactcctgacttcccaattacctgactacttccctactttgctagtgccgtcggggtccccaagtttcgacggtttcggcggtcaggtgatcgtggggaaccagtaattcactcctacaactaaatcaagccagccctgacagacgtgaaacacctccgtaataactttatactacgaacaactaaacgtcctacccgttaacccntacctaccgtacgaccgaaacgggacacgggactaggggactaaaacgttaaacgaacgttgtaacggtctacggaccacctactctttacg

SEQ ID NO: 301456 - DNA, 557 bp, Homo sapiens
  misc_feature: GZ8MTXP02FF5LO.52.69.G03.1.454.CMB.2.raw
  modified_base (276)..(276): a, c, t, g, unknown or other
  misc_feature (276)..(276): n is a, c, g, or t
tcagcgcagtacgacacgaccggtgctcgatttagtcgctgcgtaaaggagaaagggggggtcagtcccagtcaggacacagcatggacatgagggtccccgctcagctcctggggctcctgctgctctggctcccaggtgccagatgtgacatccagttgacccagtctccatccttcctgtctgcatctggtggggacagagtcaccatcacttgccggaccagtgaggacatctacactagattagcctggtatcagcaaaggaaccgggganacgcccctaaatcctagactccatactgcatccacttgcatgctcggggtccagttcgaggttcggcggcaggtcggatcgtagggacagaattcactctacacaactcagtcacgcctgacagactagaagacctccgataatttatactagtacaaacaacgtactaaccgttaccgactccaccgttccggaaccgtaaacgggaccaaccgggtcgtaacggaacgtaaacttaaaacggaaacgtggtacggactacggacccaccacttccttcg

SEQ ID NO: 301457 - DNA, 841 bp, Homo sapiens
  misc_feature: GZ8MTXP02HIHB7.52.69.G03.1.454.CMB.2.raw
  modified_base (275)..(275): a, c, t, g, unknown or other
  misc_feature (275)..(275): n is a, c, g, or t
tcagcgcagtacgacacgaccggtgctcgatttagtcgctgcgtaaaggagaaaggggggctgagctgggttttccttgttgctgttttagaaggtgtccagtgtgaggtgcacctggtggagtccgggggagacttggtccagccgggggggtccctgacaatttcctgtgcaggctccgggttcagtttcagtgattcctggatgagctgggtccgccaggctccgaggggagggggctgggactggggtcgccaaggtaactaaaacccggntaggaaagtattaggctacgtttgggtattcgtggtcggacgggccggttacacctatcgtaccgagggaaccaacgaccgacgtaaaccttccttactaatactaaacaaatcggagaccagtaccttaaggacggtacggaacgggtacctcccccggtcgttacgttaccttaagtttacgtcggttacggccccggtaacccccgggttacggggggacctaaaacggggtaaaaccgttacgtttttccgggacccgttcccggggttcggggggaacccccgggggttaaaccccggggtccgtaacccggttcccgttaccccgtccgaaccgggtacccccttaacccgaaaccccggtaaaccggggccccctaaacggttccccgggtttacccccttttccccccggtcgggaccccggtccccttcgccccgttaccgaaacggggcctacccgtaacccgtaccgaacggaacgaccgaccgacgggtccggccccgtggggcctacggtccgtaacggtacgaaacggtactaccgtttcccaagtacgacg

SEQ ID NO: 301458 - DNA, 644 bp, Homo sapiens
  misc_feature: GZ8MTXP02I40HP.52.69.G03.1.454.CMB.2.raw
tcagcgcagtacgacacgaccggtgctcgatttagtcgctgcgtaaaggagaaaggggggctgagctgggttttccttgttgctgttttagaaggtgtccagtgtgaggtgcacctggtggagtccgggggagacttggtccagccggggggtccctgacaatttcctgtgcaggctccgggttcagtttcagtgattcctggatgagctgggtccgccaggctccgaggggaggggctggacgtgggtggccagtataaaccggatggaagtattaggctacgtttgggtattcgtgtgacggtccgttcaccatctccaggacaacaccgcgaactccttcatctaacaaatgagcagccttagacggcgaggactcccgctgtctattactgtcgcgacccgtcgggggacacggaaacgtctttcgccctccgtcgggggcccggggaacccggtcacccgtctacctcgacgcctccgaccgaacgggccctagtcccgggtccctttccccgcgggcccgtcccgtcgcctccgacggacgcccaccgtaccggacgacggacaaccgacggccggtcccgttcggggacctcggccgtggtaccgaaggtaccttacgttaccctagttaaccgtcg

SEQ ID NO: 301459 - DNA, 605 bp, Homo sapiens
  misc_feature: GZ8MTXP02IVCSJ.52.69.G03.1.454.CMB.2.raw
tcagcgcagtacgacacgaccggtgctcgatttagtcgctgcgtaaaggagaaagggggggtcagtcccagtcaggacacagcatggacatgagggtccccgctcagctcctggggctcctgctgctctggctcccaggtgccagatgtgacatccagttgacccagtctccatccttcctgtctgcatcgtgtgggggacagagtcaccatcacttgccgaccagtgaggacatctacactagattagcctggtatcagacaaggaaccggggagacgcccctaaactccagactccatactgacatcctactttgctagtcgcgtaggggtcccctagttccgaggttcgcggtcaggtggatcgagggacagtaacttcaactctacactaatcaagcaagcctagacgtacgaactacgaacgacctaccgtataaacttttataccttagtaaccaaacgtaccgtacccgtaaccgttaacccgtataccgtaccgttaccggaccgaaacgggtaccgacggtacgtaacggacgtaaaacgtttaaaccgaaacgttcggtacggtacttaccggactaaccctacgttccttaccg

SEQ ID NO: 301460 - DNA, 610 bp, Homo sapiens
  misc_feature: GZ8MTXP02G50OC.52.69.G03.1.454.CMB.2.raw
  modified_base (272)..(272): a, c, t, g, unknown or other
  misc_feature (272)..(272): n is a, c, g, or t
tcagcgcagtacgacacgaccggtgctcgatttagtcgctgcgtaaaggagaaagggggggtcagtcccagtcaggacacagcatggacatgagggtccccgctcagctcctggggctcctgctgctctggctcccaggtgccagatgtgacatccagttgacccagtctccatccttcctgtctgcatctgtggggacagagtcacatcacttgccgacagtgaggacatctacactagattagcctggtatcagacaaggaaccgggganacgacccctaaacgtcctgactccatactgcatcctactttgcatgcgtcgggtccagttcgaggttcgcggtcagtgatcgtaggacctagacttacactctacactaaatcaagcagccctgacacgtacctagaacgactccgtaactaacttttataaccttgtaaacctaaccgtaacgttacccgtaaccgtttaacccgactaccgtacccgttacccggaaccgaaacgggccgaacggttccgaagggtaaacgttaaacgtttaaaaccgaacggttaacggttcggttaacccgtaccggtaacctaccgtaacgttaccgtttacg

SEQ ID NO: 301461 - DNA, 615 bp, Homo sapiens
  misc_feature: GZ8MTXP02IP6F3.52.69.G03.1.454.CMB.2.raw
  modified_base (276)..(276): a, c, t, g, unknown or other
  misc_feature (276)..(276): n is a, c, g, or t
tcagcgcagtacgacacgaccggtgctcgatttagtcgctgcgtaaaggagaaagggggggtcagtcccagtcaggacacagcatggacatgagggtccccgctcagctcctggggctcctgctgctctggctcccaggtgccagatgtgacatccagttgacccagtctccatccttcctgtctgcatctggtgggggacagagtcaccatcacttgccgaccagtgaggacatctacactagattagcctggtatcagacaaggaaccgggganacgacccctaaactcctagactccatactgactactcctactttgactagtcgccgtcggggtccctagtttccgaggttccggcggtctaggtgacgtcgtaggggactaagtaacttcgacttctacacaaatcagcagcctgacaagactagaacgacctaccgtaacttaaattttacttacttacgtaacctaaaccgtaaccgtacctaacccgttaaccgacttacccgtaccgttaccggaaccgaaacgggtaccaccggtacgtacgggaacgtaaacgttaaaacgtagttaacggtacgacgtacgactaccgtaactcgtttaccg

SEQ ID NO: 301462 - DNA, 791 bp, Homo sapiens
  misc_feature: GZ8MTXP02F4R8X.52.69.G03.1.454.CMB.2.raw
tcagcgcagtacgacacgaccggtgctcgatttagtcgctgcgtaaaggagaaagggggggtcagtcccagtcaggacacagcatggacatgagggtcccccgctcagctcctggggctcctgctgctctggctcccaggtgccagatgtgacatccagttgacccagtctccatccttcctgtctgcatctggtggggacagagtcaccatcacttgccggacagtgaggacatctacactagattagcctggtatcagacaaggaaccggggagacgaccccctaaactcctagatccatactgactactcctactttcgctatcgtcgtcggggtccctagttcgagggttccggacgggtacaggttcgggattccggtagggggaactaacggtaatttccaacttacctaccgaaacctaaactacgaacggaccaacgtccccgtagtaccgtaaacgtaaccgttacggaaacggtaccccgttacccggtaaactttaaacctttttaaacgtttaccctttaacgggtaaaccctaaaaccccgttaaacccggttacccccgttaaaacccccgggtttaacccccggaaacctttacccccgtaaacccccggttttaacccgggtaacccccgggaaaaaccgggggtacccggaaaccggggtaccggttaaacggggtaaaccgttaaaacggtttaaaacccggtaaaccggttaacggggttaccggggacctttaccggaccccgttaaacccctagtttacccgtttcccgg

SEQ ID NO: 301463 - DNA, 555 bp, Homo sapiens
  misc_feature: GZ8MTXP02H7X9N.52.69.G03.1.454.CMB.2.raw
  modified_base (277)..(277): a, c, t, g, unknown or other
  misc_feature (277)..(277): n is a, c, g, or t
  modified_base (431)..(431): a, c, t, g, unknown or other
  misc_feature (431)..(431): n is a, c, g, or t
  modified_base (435)..(435): a, c, t, g, unknown or other
  misc_feature (435)..(435): n is a, c, g, or t
tcagcgcagtacgacacgaccggtgctcgatttagtcgctgcgtaaaggagaaagggggggtcagtcccagtcaggacacagcatggacatgagggtccccgctcagctcctggggctcctgctgctctggctcccaggtgccagatgtgacatccagttgacccagtctccatccttcctgtctgcatctggtgggggacagagtcaccatcacttgccggaccagtgaggacatctaacactagattagcctggtatcagcaaagaaccgggganacgcccctaaatcctgatccatactgcatccatttgcatgctcggggtccattcgaggttcggcggcaaggtgacgtcgtggggaactagtaactttcacgttcctacacaaactcagcagcctagcagacctagaacgactccgataaatttntacngttacaactaacgtctaaccgttaccatacacgttcgaccgaaggacacggcgtcggaacgtaaacgttaaacgtaaaccgtggtaccggtactacggtacctacgtacttcgtttaccg

SEQ ID NO: 301464 - DNA, 571 bp, Homo sapiens
  misc_feature: GZ8MTXP02HRWZ2.52.69.G03.1.454.CMB.2.raw
  modified_base (274)..(274): a, c, t, g, unknown or other
  misc_feature (274)..(274): n is a, c, g, or t
  modified_base (292)..(292): a, c, t, g, unknown or other
  misc_feature (292)..(292): n is a, c, g, or t
  modified_base (344)..(344): a, c, t, g, unknown or other
  misc_feature (344)..(344): n is a, c, g, or t
  modified_base (350)..(350): a, c, t, g, unknown or other
  misc_feature (350)..(350): n is a, c, g, or t
  modified_base (370)..(370): a, c, t, g, unknown or other
  misc_feature (370)..(370): n is a, c, g, or t
  modified_base (377)..(377): a, c, t, g, unknown or other
  misc_feature (377)..(377): n is a, c, g, or t
  modified_base (382)..(382): a, c, t, g, unknown or other
  misc_feature (382)..(382): n is a, c, g, or t
  modified_base (386)..(386): a, c, t, g, unknown or other
  misc_feature (386)..(386): n is a, c, g, or t
  modified_base (389)..(389): a, c, t, g, unknown or other
  misc_feature (389)..(389): n is a, c, g, or t
tcagcgcagtacgacacgaccggtgctcgatttagtcgctgcgtaaaggagaaagggggggtcagtcccagtcaggacacagcatggacatgagggtccccgctcagctcctggggctcctgctgctctggctcccaggtgccagatgtgacatccagttgacccagtctccatccttctgtctgcatctggtgggggacagagtcaccatcacttgccggacagtgaggacatctacactagattagcctggatcagacaaaggaccgggganacgacccctaaactcgtnaatccaatacctgcatccactttgcatgctggggtccagtcaggttcgcggnaggtgngtcgtgggacagtaaacttnaacttcncaaanaacncancacgctacgacacgacgacgaacgactactacttaactttaattactacgtactaaacgtaaccgtaccgtaccgtaccgtacgtaccgtaccgtaccggtaccgaacggaacgtacggtacgtacggtaacgtaacgtaaacgtaacgtaacgtacgtacgtacgacactacgttactacg

SEQ ID NO: 301465 - DNA, 560 bp, Homo sapiens
  misc_feature: GZ8MTXP02FK9EN.52.69.G03.1.454.CMB.2.raw
  modified_base (350)..(350): a, c, t, g, unknown or other
  misc_feature (350)..(350): n is a, c, g, or t
  modified_base (383)..(383): a, c, t, g, unknown or other
  misc_feature (383)..(383): n is a, c, g, or t
tcagcgcagtacgacacgaccggtgctcgatttagtcgctgcgtaaaggagaaaggggggggtcagtcccagtcaggacacagcatggacatgagggtccccgctcagctcctggggctcctgctgctctggctcccaggtgccagatgtgacatccagttgacccagtctccatccttcctgtctgcatctgtgggggacagagtcaccatcacttgccggacagtgaggacatctacactagattagcctggtatcagacaaggaaccggggagacgacccctaaactcctgatccatactgcatccatttgcatgctcggggtccaattcaggttcggcgcagtggntcgtgggacagaattcactctacactaaatcancagccctgacaagactagaaacgactaccgacttaaatttattactagtaacaaactaaaccgtaccaacccgtttacccgattccgaacccttacggacccgaaaggggacaacgggacttagggaactaaaagttaaaacgaaacgtgtacggtctacgacacctatacctttcg

SEQ ID NO: 301466 - DNA, 827 bp, Homo sapiens
  misc_feature: GZ8MTXP02IELWX.52.69.G03.1.454.CMB.2.raw
tcagcgcagtacgacacgaccggtgctcgatttagtcgctgcgtaaaggagaaaggggggtcagtcccagtcaggacacagcatggacatgagggtccccgctcagctcctggggctcctgctgctctggctcccaggtgccagatgtgacatccagttgacccagtctccatccttcctgtctgcatctggtgggggacagagtcaccatcacttgccggacagtgaggacatctaacactagattagcctggtatcagcgaaaggaaccggggagagaccccctaaatcctagacttccatactgctactccctatttgctagtcgccgttggggtacccctattcccgtaggggtttcggccggggtcctaaggttcgggagttcccggtagggggtaacctaaggtaaactttcccgaaacttcccgttaaacccaacccaaattacccgaacgggtaccctaaacgggccccctttagggaaccaacgggttaacccgtaaggtaaacgggaaacccctttaccccccgggttaaatttaaaacgttttttacgtttaaaaccccttcgggtttaaaccccgaaaaacccccttaaaacccggggtttaacccttaaaccccccggttttaaaacccccgggtactttaaaccccggtaaccccccggtttttaaccggggtaaaccccggtaaaacgggggtaacccgtaaaaccggggacccgtttaagggggaaaactaaaacggtttttaaaacccggaaagttcggggtttacggaaacccttccggaacctaaacccggttactttacgtttcccg

SEQ ID NO: 301467 - DNA, 665 bp, Homo sapiens
  misc_feature: GZ8MTXP02FJF31.52.69.G03.1.454.CMB.2.raw
  modified_base (273)..(273): a, c, t, g, unknown or other
  misc_feature (273)..(273): n is a, c, g, or t
  modified_base (359)..(359): a, c, t, g, unknown or other
  misc_feature (359)..(359): n is a, c, g, or t
  modified_base (369)..(369): a, c, t, g, unknown or other
  misc_feature (369)..(369): n is a, c, g, or t
tcagcgcagtacgacacgaccggtgctcgatttagtcgctgcgtaaaggagaaaggggggggtcagtcccagtcaggacacagcatggacatgagggtccccgctcagctcctggggctcctgctgctctggctcccaggtgccagatgtgacatccagttgacccagtctccatccttcctgtctgcatctggtgggggacagagtcaccatcacttgccggacagtgaggacatctacactagattagctggtatcagcaaggaccggganacgacccctaaatcctagactccatactgctactcctactttgactatcgcgtcggggtccctagttcgaggttcggcgcaggtgntcgacggganagtattcactctacacaatcagcacgacctgaccagtactacgaaacgtacctaccggtaacttaaactttaacgttacttacggttaacctaaaacccgtaaacccggttaccctaaacccggttttaacccccggaactttaacccgtaccccgtttaaccggggaaccccggaaaacgggggacccgtaaaccgggtacggttaacgggtaaacggttaaaaccgttaaaacccggtaaaacgttcgggtacggtacccgttacggaaccctacctaacgttccgtttaaccg

SEQ ID NO: 301468 - DNA, 595 bp, Homo sapiens
  misc_feature: GZ8MTXP02FGMM3.52.69.G03.1.454.CMB.2.raw
  modified_base (275)..(275): a, c, t, g, unknown or other
  misc_feature (275)..(275): n is a, c, g, or t
  modified_base (357)..(357): a, c, t, g, unknown or other
  misc_feature (357)..(357): n is a, c, g, or t
  modified_base (393)..(393): a, c, t, g, unknown or other
  misc_feature (393)..(393): n is a, c, g, or t
  modified_base (403)..(403): a, c, t, g, unknown or other
  misc_feature (403)..(403): n is a, c, g, or t
tcagcgcagtacgacacgaccggtgctcgatttagtcgctgcgtaaaggagaaagggggggtcagtcccagtcaggacacagcatggacatgagggtccccgctcagctcctggggctcctgctgctctggctcccaggtgccagatgtgacatccagttgacccagtctccatccttcctgtctgcatctgtggggacagagtcaccatcacttgccggaccagtgaggacatctacactagattagcctggtatcagcaaaggaaccgggganacgacccctaaatcctgactccatactgacactccatttgctatcgcgtcggggtccattccgagggttcgcggcaggtgtntcgtgggactagtaacttcactctacaacatcgacncaacgtcccngacacgacgtagaactaccgtccgaacttaatttaacttactagtaaccaaaccgtaccgtacctaacccgtttaccgacttaccgtaacccgttaccggaccgtaaacggggaccaccggtacggtacggaaacgttaaaacgtaaaccgaaacgttcggacgtcgtacgaccctaacgtactcgtttacg

SEQ ID NO: 301469 - DNA, 638 bp, Homo sapiens
  misc_feature: GZ8MTXP02HGYR2.52.69.G03.1.454.CMB.2.raw
  modified_base (304)..(304): a, c, t, g, unknown or other
  misc_feature (304)..(304): n is a, c, g, or t
tcagcgcagtacgacacgaccggtgctcgatttagtcgctgcgtaaaggagaaaggggggggtcagtcccagtcaggacacagcatggacatgagggtccccgctcagctcctggggctcctgctgctctggctcccaggtgccagatgtgacatccagttgacccagtctccatccttcctgtctgcatcgtggtggggacagagtcaccatcacttgaccgacagtgagactatctagactagattagcctggtatcagacaaaggaaccggagacgacccctaaactcctagactcatacngacatcctaactttgactatcgcgtcggggtccctaagtcgacgggttcggcggacaagtggagttcgagggaataagtaaactttcaaactttcctaacaaccctaaactacgacgaccgtacgacgtacgaacgtaacgtaacgtaacgtaaacgtaccgtaccttaaacttaactttaactacgttacgtaaacctaaaccgtaaccgtaaccctaaccgttaccgtacgtaccgtaacgtaccggaacggtaacggaacgtacggtacgtaaacggtaacgtaaacgtaaacgacgtcgtaacgtcgtacgacctacgtacgttacgtcg

SEQ ID NO: 301470 - DNA, 624 bp, Homo sapiens
  misc_feature: GZ8MTXP02I7CQO.52.69.G03.1.454.CMB.2.raw
  modified_base (275)..(275): a, c, t, g, unknown or other
  misc_feature (275)..(275): n is a, c, g, or t
tcagcgcagtacgacacgaccggtgctcgatttagtcgctgcgtaaaggagaaagggggggtcagtcccagtcaggacacagcatggacatgagggtccccgctcagctcctggggctcctgctgctctggctcccaggtgccagatgtgacatccagttcgacccagtctccatccttcctgtctgcatcgtggtggggacagagtcacatcacttgccgacagtgagacatctacactagattacgcctggtatcagacaaggaaccgggganacgacccctaaactccgtagactaccatactgacctatcctactttgactagtcgcgtcgggtcctacgttcgaggttcggcgctaggtgtacgtcgtagggactaagtaacttcactctacacgaatcgagcacgctcgacacgtaacgtacgaacgaccttaccgtaacttaacgttttactacgtacgtaaaccaaaaccgtaaccgttacctaaaccccggttaaccacttaccgtaccccgtttaccggaaccggtaaacgggacccgacggtaccgtaaggtaacgtaaaacggttaaacgacgttaacggtcggactacggaccaccttacgttcgttaccg

SEQ ID NO: 301471 - DNA, 644 bp, Homo sapiens
  misc_feature: GZ8MTXP02FKMTQ.52.69.G03.1.454.CMB.2.raw
  modified_base (279)..(279): a, c, t, g, unknown or other
  misc_feature (279)..(279): n is a, c, g, or t
tcagcgcagtacgacacgaccggtgctcgatttagtcgctgcgtaaaggagaaaggggggggtcagtcccagtcaggacacagcatggacatgagggtccccgctcagctcctggggctcctgctgctctggctcccaggtgccagatgtgacatccagttgacccagtctccatccttcctgtctgcatcgtggtgggggacagagtcaccatcacttgccggacagtgagacatctacactagattagcctggtatcagacgaaaggaaccgggganacgacccctaaatcctagactccatactgcctaatcctaatttgactatcggccgttcggggtcccagtttccggaggggttccggacggtcgtaggttcgggagtcgtaggggaactaagtaacttcaccttcacaataactcaagccagtcccagcgaaggtacagaaactaccgtaccctattaaacttttacgtaccgtagtaaacctaaacccgtaccggttacctaaaccccggttaaccaccttaacccgtacccgttaccgggaaccgtaaacggggacctaccgggacgttaaggaaacgtaaaacgttaaacgtaacgtcggtaacggtctaccggactaaaccgttactcgtcg

SEQ ID NO: 301472 - DNA, 517 bp, Homo sapiens
  misc_feature: GZ8MTXP01DCMGP.8.28.C06.1.454.CMB.2.raw
  modified_base (494)..(494): a, c, t, g, unknown or other
  misc_feature (494)..(494): n is a, c, g, or t
  modified_base (504)..(504): a, c, t, g, unknown or other
  misc_feature (504)..(504): n is a, c, g, or t
  modified_base (515)..(515): a, c, t, g, unknown or other
  misc_feature (515)..(515): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatccccagccaggttcagcggcagtgggtctgggacttcgttcactctcaccatcaataacctgcaatctgacgacttgctagtttatttctgtcagcagtctggaagactggccgttcactttcgggcggagggacctaagggtcggacctcaaacgacttgtggctgcaccnttctgtctcntcttcccgccntc

SEQ ID NO: 301473 - DNA, 516 bp, Homo sapiens
  misc_feature: GZ8MTXP01BVK04.8.28.C06.1.454.CMB.2.raw
  modified_base (468)..(468): a, c, t, g, unknown or other
  misc_feature (468)..(468): n is a, c, g, or t
  modified_base (484)..(484): a, c, t, g, unknown or other
  misc_feature (484)..(484): n is a, c, g, or t
  modified_base (492)..(492): a, c, t, g, unknown or other
  misc_feature (492)..(492): n is a, c, g, or t
tcagctcgcgtgtccacgaccggtgctcgatttagagctcacgtattgggtttgggaggaactgctcagttaggacccagacggaaccatggaagccccagcgcagcttctcttcctcctgctactctggctcccagagatcattggagaagtggtgatgacacagtctccggtcaccctgtctgttttcctggggagagagccacctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaaataactgcaatctgacgactttgctagtttattctgtcagcagtctggaagactggccgtttcactttcgggcggtaagggccaaggtggacctnaaacgaacttgtcggntgcaccgnttcctgtctcatcttcccgcaatc

SEQ ID NO: 301474 - DNA, 551 bp, Homo sapiens
  misc_feature: GZ8MTXP01EEILK.8.28.C06.1.454.CMB.2.raw
  modified_base (210)..(210): a, c, t, g, unknown or other
  misc_feature (210)..(210): n is a, c, g, or t
  modified_base (531)..(531): a, c, t, g, unknown or other
  misc_feature (531)..(531): n is a, c, g, or t
tcagctcgcgtgtccacgaccggtgctcgatttagagctcacgtattgggttgggagagctctggggaggaactgctcagttaggacccagacggaaccatggaagccccagcgcagcttctcttcctcctgctactctggctcccagagatcattggagaagtggtgatgacacagtctccggtcaccctgtctgtttttcctgggganagagccaccctctcctgtgcggccagtcagagcgttaggacgaacttagcctggtatcagcagaggcctggccaggctcccagactcctcatctttggcgcctttaacagggcagtggaatcccagccaggttcagcggcagtgggtctggggacttcgtcactctcacatcaataacctgcaaatctagacgactttgctagtttattctgttcagtcagtctgaagactggccgttctacgttttcggccgggagggaacccaagggttcgggacccttcgaaaaccgtaaacttggttgggttacctcgcctaacctntcgttcgttccgttctaacg

SEQ ID NO: 301475 - DNA, 629 bp, Homo sapiens
  misc_feature: GZ8MTXP01D13SO.8.28.C06.1.454.CMB.2.raw
  modified_base (309)..(309): a, c, t, g, unknown or other
  misc_feature (309)..(309): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgttttcctggggagagagccacctctcctgtgcggccagtcagagcgttaggacgaacttagcctggtatcagcagagcctggccaggctcccagacctcctcatctttggcgtcctttaagngggccagtggaactcccagccaggttcagcgcaggtgggtctgggacttcgtcactctcacatcaaatacctgcaatctgacgtactttgcttagtttatttctgtcagctaagtcgtaggaaacgtacgttcgggtacccgtttactaacggttttccgggacggggtaaacggggaacccgtaaagggggttaccggtaacccgttaccgaaaaaaccggtaaccgttgggttcgggaccttcggaccttaaccccgttattcccgttcggttcctttaacctacgttcccctttccccggcccgttaactttcccgg

SEQ ID NO: 301476 - DNA, 568 bp, Homo sapiens
  misc_feature: GZ8MTXP01CHJA9.8.28.C06.1.454.CMB.2.raw
  modified_base (195)..(195): a, c, t, g, unknown or other
  misc_feature (195)..(195): n is a, c, g, or t
  modified_base (258)..(258): a, c, t, g, unknown or other
  misc_feature (258)..(258): n is a, c, g, or t
  modified_base (527)..(527): a, c, t, g, unknown or other
  misc_feature (527)..(527): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgcggccagtcagagcgttaggacgaacttagcctggtancagcagaggcctggccaggctcccagactcctcatctttggcgtcctttaacgagggccagtggaactcccagccaggttcaggcgcaggtgggtctgggacttcgtcactctcaccatcaatacctgacaatctgactacttgctagtttattctgtcagtcagtctaggaagtacgtggtcccgttctaccgtttcggggcgggtaacgggaaccgtaagggtcgaaccctacgaaaacgtacgttggtcgggctcggcacccgttnttccgttgtccttcacttcccgttcccgccttaacgttccg

SEQ ID NO: 301477 - DNA, 524 bp, Homo sapiens
  misc_feature: GZ8MTXP01EFK4Z.8.28.C06.1.454.CMB.2.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgttttcctggggagagagccacctctcctgtgcggccagtcagagcgttaggacgaacttagcctggtatcagcagaggcctggccaggctcccagactcctcatctttggcgcctttaacagggccagtggaatcccagccaggttcagcggcagtgggtctggggacttcgtcactctcacccatcaaataacctgaccaatctgacgactttgctagtttatttctgtcagcagtctggaagtactggccgttcacgtttcggcggaggggaccaagggtcggacctcgaaacgacttgtggctgcaccgattctgtcttcatcttccgccaatc

SEQ ID NO: 301478 - DNA, 553 bp, Homo sapiens
  misc_feature: GZ8MTXP01AGYPB.8.28.C06.1.454.CMB.2.raw
  modified_base (205)..(205): a, c, t, g, unknown or other
  misc_feature (205)..(205): n is a, c, g, or t
  modified_base (211)..(211): a, c, t, g, unknown or other
  misc_feature (211)..(211): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtctgttttccngggganagagccaccctctcctgtgcggccagtcagagcgttaggacgaacttagcctggtatcagcagaggcctggccaggctcccagactcctcatctttggctcctttaacgagggccaggtggaactccccagccaggttcaggcggcaggtgggtctgggacttcgtcactctcaccatcaataacctgacaatctagacgtactttgctagtttattctgtcagctagtctagaagtcgtggtccgttctacgtttcgggcggagggaaccaagggttcggaaccttacgaaacgtaacgttggttcggactggcctaaccgattccttgttccttcgtaac

SEQ ID NO: 301479 - DNA, 608 bp, Homo sapiens
  misc_feature: GZ8MTXP01CFLG8.8.28.C06.1.454.CMB.2.raw
  modified_base (201)..(201): a, c, t, g, unknown or other
  misc_feature (201)..(201): n is a, c, g, or t
  modified_base (312)..(312): a, c, t, g, unknown or other
  misc_feature (312)..(312): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctgggganagagccaccctctcctgtgcggccagtcagagcgttaggacgaacttagcctggtatcagcagaggcctggccaggctcccagactcctcatctttggcgtcctttaacgnggggccaggtggaactccccgagccaggttcaggcggcaggtgggtctgggacttcgtacactctcaccatcaataacctgacaatctagacgtactttgctagttttacttctgtcagcagttctaggaacgtacgtcgggtcccgttcgtaaccgttttccggggacgggtaacgggggaaccctaaagggggttcggtaaccccgttacgaaaaccggtaacgttggtacggcgttacggcaacccgttattccgttgtcctttcgacttcccgttccccgccgttaagtccg

SEQ ID NO: 301480 - DNA, 640 bp, Homo sapiens
  misc_feature: GZ8MTXP01E1XDU.8.28.C06.1.454.CMB.2.raw
  modified_base (311)..(311): a, c, t, g, unknown or other
  misc_feature (311)..(311): n is a, c, g, or t
  modified_base (352)..(352): a, c, t, g, unknown or other
  misc_feature (352)..(352): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgtcctttaacngggccagtggaatcccagccaggttcagcggcagtgggtcngggacttcgtcactctcaccatcaataacctgacaatctgacgtactttgcttagtttatttctgtcagcagtctaggggaaacgtacgtcgggtccgttacgtacgtttccggggacgggaacgggggtaccgtaaagggggttcggaaacccgttacgaaaaacccggtaaacgttcgggtacggggttacctacgggtacccaacccgttatttccccgttgggttcccttttaacccgaacgttttcccccttttaccccccggaacccgttaacgtttcccgg

SEQ ID NO: 301481 - DNA, 527 bp, Homo sapiens
  misc_feature: GZ8MTXP01AW9KZ.8.28.C06.1.454.CMB.2.raw
  modified_base (264)..(264): a, c, t, g, unknown or other
  misc_feature (264)..(264): n is a, c, g, or t
  modified_base (310)..(310): a, c, t, g, unknown or other
  misc_feature (310)..(310): n is a, c, g, or t
  modified_base (443)..(443): a, c, t, g, unknown or other
  misc_feature (443)..(443): n is a, c, g, or t
  modified_base (502)..(502): a, c, t, g, unknown or other
  misc_feature (502)..(502): n is a, c, g, or t
  modified_base (513)..(513): a, c, t, g, unknown or other
  misc_feature (513)..(513): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagnggcctggccaggctcccagactcctcatctttggcgtcctttaacngggccagtggaatcccagccaggttcagcggcagtggggtctgggacttcgtcactctcaccatcaataacctgacaatctgacgtactttgctagtttatttctgtcagcagtctggaagtactggccgttnacgtttcgggcggtaagggaccaagggtcggacctgaaaccgtattggtcgcgtgcacnttctgtcttcntcttcccgcaatcg

SEQ ID NO: 301482 - DNA, 601 bp, Homo sapiens
  misc_feature: GZ8MTXP01D07IX.8.28.C06.1.454.CMB.2.raw
  modified_base (311)..(311): a, c, t, g, unknown or other
  misc_feature (311)..(311): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgttttcctggggagagagccacctctcctgtgcggccagtcagagcgttaggacgaacttagcctggtatcagcagaggcctggccaggctcccagactcctcatctttggcgtcctttaacgngggccagtggaatcccagccaggttcagcggcagtgggtctgggacttcgtcactctcaccatcaataacctgactaatctagacgtactttgcttaagttttatttctagtcagctagtcttagggaagtacgttgggcccgtttctaccgttttcgggcgggaaacggggacccgtaaagggttcggacccttacgaaaaaccggtaacgttcggtcgggctcggtccaacccgttagttccttcggtcctttctacttcccgtttccccgaaccgttaacgtttccg

SEQ ID NO: 301483 - DNA, 525 bp, Homo sapiens
  misc_feature: GZ8MTXP01D5OW3.8.28.C06.1.454.CMB.2.raw
  modified_base (495)..(495): a, c, t, g, unknown or other
  misc_feature (495)..(495): n is a, c, g, or t
  modified_base (498)..(498): a, c, t, g, unknown or other
  misc_feature (498)..(498): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttcctggggagagagccaccctctcctgtgcggccagtcagagcgttaggacgaacttagcctggtatcagcagaggcctggccaggctcccagactcctcatctttggcgcctttaacagggccagtggaatccccagccaggttcagcggcaggtgggtctggggacttcgtcactctcaccatcaataacctgacaatctgacgtactttgctagtttatttctgtcagcagtctggagactggccgttcacgtttcggcggagggacctaagggtcgacctcaaacgacttgtggctgcnccnttctgtcttcatccttcccgccaatcg

SEQ ID NO: 301484 - DNA, 521 bp, Homo sapiens
  misc_feature: GZ8MTXP01B64V8.8.28.C06.1.454.CMB.2.raw
  modified_base (194)..(194): a, c, t, g, unknown or other
  misc_feature (194)..(194): n is a, c, g, or t
  modified_base (200)..(200): a, c, t, g, unknown or other
  misc_feature (200)..(200): n is a, c, g, or t
  modified_base (309)..(309): a, c, t, g, unknown or other
  misc_feature (309)..(309): n is a, c, g, or t
  modified_base (499)..(499): a, c, t, g, unknown or other
  misc_feature (499)..(499): n is a, c, g, or t
  modified_base (519)..(519): a, c, t, g, unknown or other
  misc_feature (519)..(519): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacgaacttagcctggtatcagcagaggcctggccaggctcccagactcctcatctttggcgcctttaacngggccagtggaatcccagccaggttcagcgcagtgggtctgggacttcgttcactctcaccatcaataacctgacaatctgacgtactttgctagtttattctgtcagcagtctggaagtactggccgttcacgtttcgggcggtacgggacctaagggtcgacctgaaacgaacttggtggctgcaccnttctgtctcatcttcccgcntc

SEQ ID NO: 301485 - DNA, 532 bp, Homo sapiens
  misc_feature: GZ8MTXP01DNGQ3.8.28.C06.1.454.CMB.2.raw
  modified_base (285)..(285): a, c, t, g, unknown or other
  misc_feature (285)..(285): n is a, c, g, or t
  modified_base (302)..(302): a, c, t, g, unknown or other
  misc_feature (302)..(302): n is a, c, g, or t
  modified_base (376)..(376): a, c, t, g, unknown or other
  misc_feature (376)..(376): n is a, c, g, or t
  modified_base (392)..(392): a, c, t, g, unknown or other
  misc_feature (392)..(392): n is a, c, g, or t
  modified_base (404)..(404): a, c, t, g, unknown or other
  misc_feature (404)..(404): n is a, c, g, or t
  modified_base (411)..(411): a, c, t, g, unknown or other
  misc_feature (411)..(411): n is a, c, g, or t
  modified_base (529)..(529): a, c, t, g, unknown or other
  misc_feature (529)..(529): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgttttcctggggagagagccaccctctcctgtgcggccagtcagagcgttaggacgaacttagcctggtatcagcagagctggcaggctccagactctnatctttgcgcctttaanagggccagtgaatcccagccaggttcagcgcagtgggtctgggacttcgtcactctcaccatcaaataaccgtnacatctagactacttntactatttattntgtacanactagtataggaagtacgtcgtcgtcgtacgttcggtacggacggacgtaaggtacgtacgtaacaaacgaacgttagtcgcgtcgacacgcttctcttcttctactccttccctccnctc

SEQ ID NO: 301486 - DNA, 536 bp, Homo sapiens
  misc_feature: GZ8MTXP01D6IGJ.8.28.C06.1.454.CMB.2.raw
  modified_base (311)..(311): a, c, t, g, unknown or other
  misc_feature (311)..(311): n is a, c, g, or t
  modified_base (510)..(510): a, c, t, g, unknown or other
  misc_feature (510)..(510): n is a, c, g, or t
  modified_base (533)..(533): a, c, t, g, unknown or other
  misc_feature (533)..(533): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacgngggccagtggaatcccagccaggttcagcgcacgtgggtctgggacttcgtcactctcaccatcaataacctgacaatctagacgtactttgcttagttttactttctgtcagcagtctggaagtctggtcccttcgtacgtttcgggcggtagggacctaagggtcgacctcgaaacgtacttggtggctgccacttnttctgtcttcactccttcccgcntcg

SEQ ID NO: 301487 - DNA, 668 bp, Homo sapiens
  misc_feature: GZ8MTXP01EBIAB.8.28.C06.1.454.CMB.2.raw
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
  modified_base (317)..(317): a, c, t, g, unknown or other
  misc_feature (317)..(317): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccngggganagagcccacctctcctgtgcggccagtcagagcgttaggacgtaattagcctggtatcagcagaggcctggccaggcctccagacctcctcattctttggccgtacctttaacgnggggccaggtcggaactccccagcctaggttcaggcggcaggtgggtctgggtacttccgttacacttctacacctatacaaatacctgacaatctagacgtactttgcttagttttacttctgtacagctagttcgtagggtaaacgtacgttcgggtacccgtttcgtaaccggtttcggggacggggtaaacgggggtaccctaaagggggttccggtaaaccccttaacggaaaaaccggtacgttcggggtacgggttccttacggacccttaaccgttacttcccgttaacggttccctttaaccgtaaccttcccggtttaccccgccttaacgtttaacccgg

SEQ ID NO: 301488 - DNA, 532 bp, Homo sapiens
  misc_feature: GZ8MTXP01AL2Q7.8.28.C06.1.454.CMB.2.raw
  modified_base (505)..(505): a, c, t, g, unknown or other
  misc_feature (505)..(505): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgtcctttaacgagggccagtggaactcccagccaggttcagcggcaggtgggtctgggacttcgtcactctcaccatcaatacctgacaatctgacgtactttgctagtttattctgtcagcagtctgggaagacgtggccgttcacgtttcgggcggtagggaccgtaagggtcggacctgaaacgacttggtggctgcaccgnttctgtctcactccttcccgcaagtcg

SEQ ID NO: 301489 - DNA, 563 bp, Homo sapiens
  misc_feature: GZ8MTXP01CA45J.8.28.C06.1.454.CMB.2.raw
  modified_base (195)..(195): a, c, t, g, unknown or other
  misc_feature (195)..(195): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgcggccagtcagagcgttaggacgaacttagcctggtatcagcagaggcctggccaggcctcccagacctcctcattctttggcctcctttaacgaggggccagtggaactcccagccaggttcagcgcaggtgggtctgggacttcgtcactctcaccatcaatacctgacaatctagacgtactttgctagtttatttctgtcagtctagtctaggaagtacgtcgggtccgttcgtacgtttcgggcgggacgggaccgtaagggtcggacctacgaaacgtaacgttggtacggcgtgccaccgttattctgttctcgacttccttcccgccttaatccg

SEQ ID NO: 301490 - DNA, 618 bp, Homo sapiens
  misc_feature: GZ8MTXP01CQZT7.8.28.C06.1.454.CMB.2.raw
  modified_base (195)..(195): a, c, t, g, unknown or other
  misc_feature (195)..(195): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgcggccagtcagagcgttaggacgaacttagcctggtatcagcagaggcctggccaggctccagactcctcattctttggctcctttaacgagggccagtggaactcccagccagttcagcggcaggtgggtctgggtacttcgtcactctcaccatcaaataacctgacaatctgacgtactttgctagtttattctgtctagctaagttcgtaggtaaacgtcgttcggcccgtttcgtaaccgttttccggggacggtaacggggaccctaaaggggttcggaacccttacgaaaaccggtaaacgttggtcggcttacggccttaaccccttagttcccttcgggttcccctttaaccgtacgttcccctttccccggccccttaaggtttcccg

SEQ ID NO: 301491 - DNA, 625 bp, Homo sapiens
  misc_feature: GZ8MTXP01BZ5SR.8.28.C06.1.454.CMB.2.raw
  modified_base (195)..(195): a, c, t, g, unknown or other
  misc_feature (195)..(195): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgcggccagtcagagcgttaggacgaacttagcctggtatcagcagaggcctggccaggctcccagactcctcatctttggcgtcctttaacgagggccaggtggaactccccagccaggttcagcggcaggtgggtctgggacttcgtcactctcaccatcaataacctgacaatctagacgtactttgcttagtttatttctgtcagctagtctagggaacgtacgtggtcccgtttctaccgtttcggggacgggtaacggggtacccgtaaaggggttcgggaaccccttacgaaaaaccggtaaccgttgggttcgggccttacggacccttaacccgttacgtttcccttcggttcctttcccgtaactttccccttttcccccggccttaacgtttcccg

SEQ ID NO: 301492 - DNA, 548 bp, Homo sapiens
  misc_feature: GZ8MTXP01CERLB.8.28.C06.1.454.CMB.2.raw
  modified_base (194)..(194): a, c, t, g, unknown or other
  misc_feature (194)..(194): n is a, c, g, or t
  modified_base (200)..(200): a, c, t, g, unknown or other
  misc_feature (200)..(200): n is a, c, g, or t
  modified_base (520)..(520): a, c, t, g, unknown or other
  misc_feature (520)..(520): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctccagagatcattggagaagtggtgatgacacagtctccggtcaccctgtcttgttttccngggganagagccaccctctcctgtgcggccagtcagagcgttaggacgaacttagcctggtatcagcagaggcctggccaggctcccagactcctcatctttggcgtcctttaacgaggggccaggtcggaactcccagccaggttcaggcggcaggtgggtctggggacttcgttcactctcaccatcaaataacctgacaatctagacgtactttgctagtttattctgtcagcagtctggaagcgtggccgttcacgtttcgggcgggtaacggacctaagggtcggaacctacgaaaacgtacttggtaggctacgcaccgnttcctgtccttcatccttcccgcaatcg

SEQ ID NO: 301493 - DNA, 853 bp, Homo sapiens
  misc_feature: GZ8MTXP01CR9IP.8.28.C06.1.454.CMB.2.raw
  modified_base (207)..(207): a, c, t, g, unknown or other
  misc_feature (207)..(207): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtcttgtttttccnggggagagagccaccctctcctgtgcggccagtcagagcgttaggacaacttagcctggtatcagcagaggcctggccaggcctcccagacctcctcattcgtttggccgtacctttaaacgacgggggcccaaggttcgggaaacttcccccgaaggtccccgtaaacggggttttccaacgggcccggggaccgtaaggggttcggggggttcccttcgggggggtaaaccctttttcccggggtttccctaaccgttcccttacccaaacccctaacttaccctaaaacgttaaaaccccttggacctaaaacttcccgttaaggtaccggttaactttttcggaccctttaaggtttttaacttttcctttcggttaccgtaaggtacccttaagggtttcccgttagggtaaaccggttaaccgtttccgggggtaccccggtttttaccgtaaacccgggtttttcccgggggacccgggggttaaaccgggggaaaccccgggtaaaacgggggtttccggggaaaccccgttaaccggaaaaaacccgggtaaccgttacggggttcggggccctttaacggggacccttaaacccggtactttaccgttacggtttaacccgttttcccgttaaccg

SEQ ID NO: 301494 - DNA, 569 bp, Homo sapiens
  misc_feature: GZ8MTXP01DTA46.8.28.C06.1.454.CMB.2.raw
  modified_base (314)..(314): a, c, t, g, unknown or other
  misc_feature (314)..(314): n is a, c, g, or t
  modified_base (536)..(536): a, c, t, g, unknown or other
  misc_feature (536)..(536): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttcctggggagagagccaccctctcctgtgcggccagtcagagcgttaggacgaacttagcctgggtatcagcagaggcctggccaggctcccagactcctcatctttggcgtcctttaacgngggccagtggaatccccagccaggttcagcggcaggtgggtctgggacttcgttcactctcaccatcaataacctgacaatctagacgtactttgacttagttttatttctgtcagtcagttctaggaacgtacgttggtcccgtttcaccgtttcgggacggtaacggggaccctaagggtcggaccttacgaaaacgtacttggtacggctggcaccttnttctgttcttcacttccttcccgcttaacttcg

SEQ ID NO: 301495 - DNA, 601 bp, Homo sapiens
  misc_feature: GZ8MTXP01AEP04.8.28.C06.1.454.CMB.2.raw
  modified_base (206)..(206): a, c, t, g, unknown or other
  misc_feature (206)..(206): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgcggccagtcagagcgttaggacgaacttagcctggtatcagcagaggcctggccaggcctcccagacctccctcattctttggccgtacctttaaacgacgggggcccaggtcggaaactccccgagccctaggttccaggcggcgtaggtcgggtctggggtacttcgttcactctcaccatacaactaacctgacaatctagacgtactttgcttagtttattctgtcagtctagtctagaagtacgtcgggtcccgttcgtaccgtttccggggacggggaacgggaacccgtaaggggttcggaacccgttacgaaaacggtaacgttggttcggctgaccaaccgattcgttcgttcttctaacc

SEQ ID NO: 301496 - DNA, 561 bp, Homo sapiens
  misc_feature: GZ8MTXP01AQ9RD.8.28.C06.1.454.CMB.2.raw
  modified_base (193)..(193): a, c, t, g, unknown or other
  misc_feature (193)..(193): n is a, c, g, or t
  modified_base (199)..(199): a, c, t, g, unknown or other
  misc_feature (199)..(199): n is a, c, g, or t
  modified_base (437)..(437): a, c, t, g, unknown or other
  misc_feature (437)..(437): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgttttccngggganagagccaccctctcctgtgcggccagtcagagcgttaggacgaacttagcctggtatcagcagaggcctggccaggctcccagactcctcatctttggcgtcctttaacagggccagtggaatcccagccaggttcagcggcagtgggtctgggacttcgtcactctcaccatcaataacctgacaatctgacgtacttgctagtttattctgtcagcagtctggagactggccgttnacgtttcggcgggaacgggtaccaagggttcggaacccgttacgaaaaccggtaacgttggtcgggcttcggccaacccgttcttccgttcgttcttcctacttcccttacccgtcttcgtccg

SEQ ID NO: 301497 - DNA, 604 bp, Homo sapiens
  misc_feature: GZ8MTXP01D41RU.8.28.C06.1.454.CMB.2.raw
  modified_base (311)..(311): a, c, t, g, unknown or other
  misc_feature (311)..(311): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgttttcctggggagagagcccaccctctcctgtgcggccagtcagagcgttaggacgaacttagcctggtatcagcagaggcctggccaggctcccagactcctcatctttggcgcctttaacngggccagtggaatcccagccaggttcagcggcagtgggtctgggacttcgttcactctcaccatcaataacctgacaatctgacgactttgcttagtttattctgtcagcagtctggaaagtacgtggcccgttctacgtttcgggcgggtaaacggggacccgtaaaggggttcggaacccgttacgaaaaaccggtaacgttgggttcgggaccttcgggaccttaacccgttaacgttcccttggttcccttttcaactttccctttaccccggtcccgttaatttcccg

SEQ ID NO: 301498 - DNA, 555 bp, Homo sapiens
  misc_feature: GZ8MTXP01C9VN0.8.28.C06.1.454.CMB.2.raw
  modified_base (208)..(208): a, c, t, g, unknown or other
  misc_feature (208)..(208): n is a, c, g, or t
  modified_base (214)..(214): a, c, t, g, unknown or other
  misc_feature (214)..(214): n is a, c, g, or t
  modified_base (245)..(245): a, c, t, g, unknown or other
  misc_feature (245)..(245): n is a, c, g, or t
  modified_base (274)..(274): a, c, t, g, unknown or other
  misc_feature (274)..(274): n is a, c, g, or t
  modified_base (320)..(320): a, c, t, g, unknown or other
  misc_feature (320)..(320): n is a, c, g, or t
  modified_base (546)..(546): a, c, t, g, unknown or other
  misc_feature (546)..(546): n is a, c, g, or t
tcagctcgcgtgtccacgaccggtgctcgatttagagctcacgtattggggtttggggagagctctggggaggaactgctcagttaggacccagacggaaccatggaagccccagcgcagcttctcttcctcctgctactctggctcccagagatcattggagaagtggtgatgacacagtctccggtcaccctgtcttgtttttccngggganagagccaccctctcctgtgcggccagtcagngcgttaggacgaactgctggatcagcagngctggccaggcctccagactcctctatcgtttggcgtccttaacgngggccaggtcgaactcccagccgtaggtcaggcggctaggtcgggtctgggtacttcgtacactctcaccatacaactacctgacaatctagtacgtacttgacttagtttattctgtcgtagctagtctagagtacgtcggtccgttcgtacgtttcgggcggagggaaccgaaggttcgaaccgttacgaaacgtacgttaggttcggctcgcaacctatcttntcttcgtcc

SEQ ID NO: 301499 - DNA, 539 bp, Homo sapiens
  misc_feature: GZ8MTXP01B6AFJ.8.28.C06.1.454.CMB.2.raw
  modified_base (205)..(205): a, c, t, g, unknown or other
  misc_feature (205)..(205): n is a, c, g, or t
  modified_base (211)..(211): a, c, t, g, unknown or other
  misc_feature (211)..(211): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtctgttttccngggganagagccaccctctcctgtgcggccagtcagagcgttaggacgaacttagcctggtatcagcagaggcctggccaggctcccagactcctcatctttggcgtcctttaacagggccagtggaactcccagccaggttcagcggcaggtgggtctgggacttcgtcactctcaccatcaataacctgcaatctagacgtactttgctagtttattctgtcagtctagtctgaagtactggtccgttctacgtttcgggcgggtagggaaccgtaagggttcggaccttacgaaacgaacttggttgctgcaacgatcttcgtcttctaac

SEQ ID NO: 301500 - DNA, 580 bp, Homo sapiens
  misc_feature: GZ8MTXP01DYYYA.8.28.C06.1.454.CMB.2.raw
  modified_base (312)..(312): a, c, t, g, unknown or other
  misc_feature (312)..(312): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgttttcctggggagagagccaccctctcctgtgcggccagtcagagcgttaggacgaacttagcctggtatcagcagaggcctggccaggctcccagacctcctcatctttggcgtcctttaacgngggccagtggaactcccagccaggttcagcggcaggtgggtctgggacttcgtcactctcacatacaataacctgacaatctgacgactttgcttaagttttattctgtcagctagtctagggaagtctgggtcctttcgaccgtttcgggacggtaacggggacccgtaaagggttacggaacccttaaggaaaacgtacgttgggtaggcctggaccttacgttattcgtaagttccttctacttcccgttcccgccttaattccg

SEQ ID NO: 301501 - DNA, 525 bp, Homo sapiens
  misc_feature: GZ8MTXP01DMEOO.8.28.C06.1.454.CMB.2.raw
  modified_base (206)..(206): a, c, t, g, unknown or other
  misc_feature (206)..(206): n is a, c, g, or t
  modified_base (212)..(212): a, c, t, g, unknown or other
  misc_feature (212)..(212): n is a, c, g, or t
  modified_base (510)..(510): a, c, t, g, unknown or other
  misc_feature (510)..(510): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccacctctcctgtgcggccagtcagagcgttaggacaacttagcctggtatcagcagaggcctggccaggctccagactcctcatctttggcgcctttaacagggccagtggaactcccagccaggttcagcggcagtgggtctggggactttcgtcactctcaccatcaaataacctgacaatctagacgtactttgctagtttattctgttcagtctagtctgaagtactggccgttctacgtttcggcgggagggaaccaaggttggaccttcaaacgacttgttgctgcncatcttgtcttcaac

SEQ ID NO: 301502 - DNA, 587 bp, Homo sapiens
  misc_feature: GZ8MTXP01AZVVN.8.28.C06.1.454.CMB.2.raw
  modified_base (206)..(206): a, c, t, g, unknown or other
  misc_feature (206)..(206): n is a, c, g, or t
  modified_base (212)..(212): a, c, t, g, unknown or other
  misc_feature (212)..(212): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccacctctcctgtgcggccagtcagagcgttaggacgaacttagcctggtatcagcagaggcctggccaggctcccagacctcctcattctttggcgtcctttaacgagggccaggtggaactcccagccaggttcagcggcaggtgggtctgggacttcgtcactctcacatcaatacctgacaatctagacgtactttgctagtttattctgtcagtctagtctagaacgtacgtcgggtcccgtttcgtaaccgttttcggggaccgggtaacggggaacccgaaggggttcggaacccttacggaaaacggtaaccgttgggttcggcttcggctaaccgtattccgttcgttccgtttcgtaaccc

SEQ ID NO: 301503 - DNA, 666 bp, Homo sapiens
  misc_feature: GZ8MTXP01CEPLB.8.28.C06.1.454.CMB.2.raw
  modified_base (206)..(206): a, c, t, g, unknown or other
  misc_feature (206)..(206): n is a, c, g, or t
  modified_base (212)..(212): a, c, t, g, unknown or other
  misc_feature (212)..(212): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctccagagatcattggagaagtggtgatgacacagtctccggtcaccctgtcttgtttttccngggganagagccaccctctcctgtgcggccagtcagagcgttaggacgaacttagcctggtatcagcagaggcctggccaggcctacccagacctcctcattcgtttcgggccgtacccttttaaacgacgggggtcccaaggttacgggaaactccccgaggacccgtaacgggtttccgaggccgggccgtaaggggttcgggggttccttcggggggtaaccttttccgggttaccaaccttcctaccaaccctaattacctaaactaaacccttggactaaacttccgtagtaaccgtaactttgtacttaagttttactttctgttacagtctagttctagtaacgtacgtcggttcccgttctaaccggtttcggacgggacgggaacccgaagggttcgaaccttacgaaacgtacgttgttcgcgtgcaacctagtcttacgtcttaactcc

SEQ ID NO: 301504 - DNA, 607 bp, Homo sapiens
  misc_feature: GZ8MTXP01EML05.8.28.C06.1.454.CMB.2.raw
  modified_base (194)..(194): a, c, t, g, unknown or other
  misc_feature (194)..(194): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgttttccnggggagagagccaccctctcctgtgcggccagtcagagcgttaggacgaacttagcctggtatcagcagaggcctggccaggctcccagactcctcattctttggcgtcctttaacgagggccagtggaatcccagccaggttcagcgcagtgggtctgggacttcgtcactctcaccatcaaataacctgacaatctgacgtactttgacttagttttatttctgtcagctagtctagggaagacttgggtccgtttcaccgtttcggggaccgggtaacggggaacccgtaaaggggtcggtaacccctcgaaaaaccggtaacgttgggttcgggccttacggaccttacccgttattccgtcggtttccttcctaacttcccgtttcccccggcccttaacgtttcccg

SEQ ID NO: 301505 - DNA, 617 bp, Homo sapiens
  misc_feature: GZ8MTXP01A9Y9K.8.28.C06.1.454.CMB.2.raw
  modified_base (207)..(207): a, c, t, g, unknown or other
  misc_feature (207)..(207): n is a, c, g, or t
  modified_base (596)..(596): a, c, t, g, unknown or other
  misc_feature (596)..(596): n is a, c, g, or t
tcagctcgcgtgtccacgaccggtgctcgatttagagctcacgtattggggtttggggagagctctggggaggaactgctcagttaggacccagacggaaccatggaagccccagcgcagcttctcttcctcctgctactctggctcccagagatcattggagaagtggtgatgacacagtctccggtcaccctgtcttgttttccnggggagagagccaccctctcctgtgcggccagtcagagcgttaggacgaacttagcctggtatcagcagaggcctggccaggcctcccagacctcctcattcgtttggccgtacctttaaacgacgggggtcccaggtcggaaactccccgaggtccctagggttccaggcggcgaggtcggggtccgtggggtactttcggttcacttctacacctatacaaactaacctgacaatctagacgtactttgcttagtttattctgtctagtctagttctagaacgtacgtcgggtacccgttcgtaccgtttcgggacggggaacggggtaacccgtaaaggggttcggtaacccttacgaaaacgtaacgttggttcggctgccaacncttcttcgttccttcgtaacc

SEQ ID NO: 301506 - DNA, 567 bp, Homo sapiens
  misc_feature: GZ8MTXP01DQVPQ.8.28.C06.1.454.CMB.2.raw
  modified_base (195)..(195): a, c, t, g, unknown or other
  misc_feature (195)..(195): n is a, c, g, or t
  modified_base (308)..(308): a, c, t, g, unknown or other
  misc_feature (308)..(308): n is a, c, g, or t
  modified_base (365)..(365): a, c, t, g, unknown or other
  misc_feature (365)..(365): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccacctctcctgtgcggccagtcagagcgttaggacgaacttagcctggtatcagcagaggcctggccaggctcccagactcctcatctttggctctttaacngggccagtggaatcccagccaggttcagcgcaggtgggtctgggacttcgtcactcncaccatcaataacctgacaatctgacgactttgctagttttattctgtcagctagtctaggggaagtacttgggtcccgtttacgacgtttcgggacgggtaacgggaccgtaaagggttggaacccttacgaaaacgtaacgttggtacggctacggcacccgttattcctgtccttcacttccttccccgcttaattccg

SEQ ID NO: 301507 - DNA, 549 bp, Homo sapiens
  misc_feature: GZ8MTXP01EBM8A.8.28.C06.1.454.CMB.2.raw
  modified_base (206)..(206): a, c, t, g, unknown or other
  misc_feature (206)..(206): n is a, c, g, or t
  modified_base (212)..(212): a, c, t, g, unknown or other
  misc_feature (212)..(212): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacaacttagcctggtatcagcagaggcctggccaggcctcccagacctcctcattctttggctcctttaacgacgggccaggtggaactcccagccaggttcaggcggcaggtgggtctgggacttcgtcactctcacatcaatacctgcaatctagacgtacttgcttagtttattctgtcagtctagtctagaagtacgtcggacctttcgtacgtttcgggcgggtaagggaacccaagggttcgaccttacgaaacgtaacttggttcggctgcaacatcttgttcttctaacc

SEQ ID NO: 301508 - DNA, 662 bp, Homo sapiens
  misc_feature: GZ8MTXP01BIMFZ.8.28.C06.1.454.CMB.2.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (309)..(309): a, c, t, g, unknown or other
  misc_feature (309)..(309): n is a, c, g, or t
  modified_base (387)..(387): a, c, t, g, unknown or other
  misc_feature (387)..(387): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccacctctcctgtgcggccagtcagagcgttaggacgaacttagcctggtatcagcagagcctggccaggctcccagactcctcatctttggctcctttaacgngggccagtggaactcccagccaggttcagcggcaggtggtctgggaccttcgtacactcaccaccatcaaagtacccngacaatctagacgtactttgactagtttattctgtcagtcctagttctagggaaacgtacgtcgggtacccgtttcgtaaccgttttccgggggacgggaacgggggtaaccccgtaaagggggttcggaaaccccgttaacggaaaaaccggtaacccgttggggttacggccgttacgggaaccccttaaccggttaccgtttaccttcgggtttcccctttaaccgtaacgtttcccccttttcccccgggaacccttaacgtttccccggg

SEQ ID NO: 301509 - DNA, 620 bp, Homo sapiens
  misc_feature: GZ8MTXP01AGDEZ.8.28.C06.1.454.CMB.2.raw
  modified_base (194)..(194): a, c, t, g, unknown or other
  misc_feature (194)..(194): n is a, c, g, or t
  modified_base (200)..(200): a, c, t, g, unknown or other
  misc_feature (200)..(200): n is a, c, g, or t
  modified_base (397)..(397): a, c, t, g, unknown or other
  misc_feature (397)..(397): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgttttccngggganagagccacctctcctgtgcggccagtcagagcgttaggacgaacttagcctggtatcagcagaggcctggccaggctcccagacctcctcattctttggcgtcctttaacgaggggcccaggtcggaactcccgaagccgaggttcagcggctaggtggggtctggggtacttcgtcactctcaccatacaataccngacaatctagacgtactttgactagtttattctgtcagtctagtctagggaacgtacgtcggtcccgtttacgtacgtttcggggacgggtaacgggtaacccgtaaaggggtccggtaaacccgtacgaaaaacggtaaccgttgggtacggcgttacggacccttacccgttattccgttcgttccttctaccttccctttaccccggccttaacgttccg

SEQ ID NO: 301510 - DNA, 610 bp, Homo sapiens
  misc_feature: GZ8MTXP01AQG61.8.28.C06.1.454.CMB.2.raw
  modified_base (290)..(290): a, c, t, g, unknown or other
  misc_feature (290)..(290): n is a, c, g, or t
tcagctcgcgtgtccacgaccggtgctcgatttagagctcacgtattgggtttgggggaggaactgctcagttaggacccagacgaacatggaagcccagcgcagcttctcttcctcctgctactctggctcccagagatcattggagaagtggtgatgacacagtctccggtcaccctgtcttgtttttcctggggagagagcccaccctctcctgtgcggccagtcagagcgttaggacgaacttagcctggtatcagcagaggcctggccaggctcccagactcctnattctttcggccgtacctttaaacgacggggccaaggttcgggaactccccagccgaggttcaggcggcgaggttcgggtcgtgggtacttcgttcactctcacctatacaactaacctgactaactctagacgtactttgtacttagtttactttctacgtcagctagtctagggaagtacgttcggtaccgttctacggtttccgggacggggaacgggaaccgtaacgggtacggtaaccctacggaaaacgtacgttgggtcggcgtacgccgttaacccttgttcctgttctctactccttcccgccttaatccg

SEQ ID NO: 301511 - DNA, 602 bp, Homo sapiens
  misc_feature: GZ8MTXP01CO5SN.8.28.C06.1.454.CMB.2.raw
  modified_base (194)..(194): a, c, t, g, unknown or other
  misc_feature (194)..(194): n is a, c, g, or t
  modified_base (200)..(200): a, c, t, g, unknown or other
  misc_feature (200)..(200): n is a, c, g, or t
  modified_base (289)..(289): a, c, t, g, unknown or other
  misc_feature (289)..(289): n is a, c, g, or t
  modified_base (308)..(308): a, c, t, g, unknown or other
  misc_feature (308)..(308): n is a, c, g, or t
  modified_base (417)..(417): a, c, t, g, unknown or other
  misc_feature (417)..(417): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgttttccngggganagagccacctctcctgtgcggccagtcagagcgttaggacgaacttagcctggtatcagcagaggcctggccaggctccagacctcctnatctttggcgtcctttaanagggccagtggaactcccagccaggttcagcgcagtgggtctgggacttcgtcaactctcaccatacaataacctgacaatctagacgtacttgacttagtttatttcngtcagctagtcctaggggtaacgtacgttcgggacccgtttcacgttttccggggacgggtaacggggtaacccgtaaagggttacgggtaacccttacgaaaaccggtaacttggtacgggccttaggcccaccgttattccgttgttccttcctacttcccgtttacccgccttaacgttccg

SEQ ID NO: 301512 - DNA, 521 bp, Homo sapiens
  misc_feature: GZ8MTXP01A2TBC.8.28.C06.1.454.CMB.2.raw
  modified_base (194)..(194): a, c, t, g, unknown or other
  misc_feature (194)..(194): n is a, c, g, or t
  modified_base (441)..(441): a, c, t, g, unknown or other
  misc_feature (441)..(441): n is a, c, g, or t
  modified_base (498)..(498): a, c, t, g, unknown or other
  misc_feature (498)..(498): n is a, c, g, or t
  modified_base (516)..(516): a, c, t, g, unknown or other
  misc_feature (516)..(516): n is a, c, g, or t
  modified_base (518)..(518): a, c, t, g, unknown or other
  misc_feature (518)..(518): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgttttccnggggagagagccaccctctcctgtgcggccagtcagagcgttaggacgaacttagcctggtatcagcagagcctggccaggctcccagactcctcatctttggcgcctttaacgagggccagtcggaatcccagccaggttcagcggcagtgggtctgggacttcgtcactctcaccatcaataaccgtgacaatctagacgtactttgctagtttattctgtcagcagtctggagactggccgttnacgttcggacggtagggacctaaggtcggacctacgaaacgaacttggtgctgcacnttctgtctcatcttcccncntcg

SEQ ID NO: 301513 - DNA, 577 bp, Homo sapiens
  misc_feature: GZ8MTXP01DA4D8.8.28.C06.1.454.CMB.2.raw
  modified_base (195)..(195): a, c, t, g, unknown or other
  misc_feature (195)..(195): n is a, c, g, or t
  modified_base (289)..(289): a, c, t, g, unknown or other
  misc_feature (289)..(289): n is a, c, g, or t
  modified_base (543)..(543): a, c, t, g, unknown or other
  misc_feature (543)..(543): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgcggcagtcagagcgttaggacgaacttagcctggtatcagcagaggcctggccaggctccagactcctnatctttggctcctttaacgagggccaggtggaactcccagccaggttcagcggcaggtgggtctgggacttcgtcactctcaccatacaataacctgactaatctagacgtacttttgactaagttttactttctagtcagctagtcttagggaaagtcgtcggtccgtttcgaccgtttcggggcgggtaaacggggacctaaaggggttcggaacctacgaaaaaccgtattgggtcggctagccaccgttnttcttgtcttcacttccttcccgccttaagtccg

SEQ ID NO: 301514 - DNA, 754 bp, Homo sapiens
  misc_feature: GZ8MTXP01A0W1U.8.28.C06.1.454.CMB.2.raw
  modified_base (197)..(197): a, c, t, g, unknown or other
  misc_feature (197)..(197): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgnggggagagagcccaccctctcctgtgcggccagtcagagcgttaggacgaacttagcctggtatcagcagaggcctggccaggcctcccgagacctcctctattcgtttgggccgtaccctttaacggacgggggtaccaaggttacgggaaactcccccgaaggtcccgtaagggtttccaacgggtccgggacgtacgggttcgggggtcgtaggggggtaccctttccgggtttaccaaccttcccgtacccaaccctaactacctaaaacttaacccgtgacctaaacttcgtacgtaaccgttactttgtacctttaagttttactttccgtagttacgacgtctaagttccgtaaggggtaaacggtacgttccggggttacccgtttacgtaacccggtttccggggacggggtaaaccggggtaccggtaaacggggtacggtaacccgtaaccgtaaaacggtaacgttgggtaccggcgttacggacccttaccttcgttcgtaacgttccttccgtacttcccttccccgtaaccttaacgttccg

SEQ ID NO: 301515 - DNA, 548 bp, Homo sapiens
  misc_feature: GZ8MTXP01AFPHC.8.28.C06.1.454.CMB.2.raw
  modified_base (206)..(206): a, c, t, g, unknown or other
  misc_feature (206)..(206): n is a, c, g, or t
  modified_base (212)..(212): a, c, t, g, unknown or other
  misc_feature (212)..(212): n is a, c, g, or t
  modified_base (434)..(434): a, c, t, g, unknown or other
  misc_feature (434)..(434): n is a, c, g, or t
  modified_base (530)..(530): a, c, t, g, unknown or other
  misc_feature (530)..(530): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacgaacttagcctggtatcagcagaggcctggccaggctcccagactcctcatctttggcgcctttaacgagggccagtggaactcccagccaggttcagcggcaggtgggtctgggacttcgttcactctcacatcaataacctgcaatctagacgtactttgacttagtttatttctgtcngcagtctgaagactggtcccgttcgtacgtttcgggcgggtacgggaaccaagggttcgggaccttacgaaacgaacttggttcggctgcaaccgntcgttgtccttcgtaacc

SEQ ID NO: 301516 - DNA, 545 bp, Homo sapiens
  misc_feature: GZ8MTXP01C8ETL.8.28.C06.1.454.CMB.2.raw
  modified_base (194)..(194): a, c, t, g, unknown or other
  misc_feature (194)..(194): n is a, c, g, or t
  modified_base (200)..(200): a, c, t, g, unknown or other
  misc_feature (200)..(200): n is a, c, g, or t
  modified_base (515)..(515): a, c, t, g, unknown or other
  misc_feature (515)..(515): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgttttccngggganagagccaccctctcctgtgcggccagtcagagcgttaggacgaacttagcctggtatcagcagaggcctggccaggctcccagactcctcatctttggctcctttaacaggggccagtggaatcccagccaggttcagcggcagtgggtctgggacttcgtcactctcaccatcaataacctgacaatctagacgtactttgctagttttattctgtcagcagtctaggaagtacgtggccgtttcaacgtttcgggacggtaagggacctaaaggggtcggaacctcgaaaacgtacttggtcggctgcaccgnttcgtgtcttcatccttcccgcaagttccg

SEQ ID NO: 301517 - DNA, 535 bp, Homo sapiens
  misc_feature: GZ8MTXP01BTUDZ.8.28.C06.1.454.CMB.2.raw
  modified_base (310)..(310): a, c, t, g, unknown or other
  misc_feature (310)..(310): n is a, c, g, or t
  modified_base (319)..(319): a, c, t, g, unknown or other
  misc_feature (319)..(319): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctccagactcctcatcttggcncctttaacngggccagtggaatccagccagttcagcggcagtgggtctgggacttcgtcactctcacatcaatactgcatctgacgtcttgctagtttattctgtcgagctagtctagagactgggcccgtttctacgttttcgggcgggagggaaccgaagggttcggaccttacgaaaccgtaacgttgttcggctggcaaccgtatcttgtcctttctaacc

SEQ ID NO: 301518 - DNA, 568 bp, Homo sapiens
  misc_feature: GZ8MTXP01ECUSR.8.28.C06.1.454.CMB.2.raw
  modified_base (201)..(201): a, c, t, g, unknown or other
  misc_feature (201)..(201): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctgggganagagccaccctctcctgtgcggccagtcagagcgttaggacgaacttagcctggtatcagcagaggcctggccaggctcccagactcctcatctttggcgtcctttaacgacgggccaggtggaactcccagccaggttcagcggcagtgggtctgggacttcgtcactctcaccatcaataacctgacaatctgacgtatttgactagtttatttctgtcagcagtctggaagtactgggtccgttcacgtttcgggcgggaacgggaccctaagggtcggacctacgaaaacgtaacgttggtcgggcttcggacacccgttattcctgttcctttcacttccctttccccgccttaacgttccg

SEQ ID NO: 301519 - DNA, 534 bp, Homo sapiens
  misc_feature: GZ8MTXP01BOSZ2.8.28.C06.1.454.CMB.2.raw
  modified_base (311)..(311): a, c, t, g, unknown or other
  misc_feature (311)..(311): n is a, c, g, or t
  modified_base (320)..(320): a, c, t, g, unknown or other
  misc_feature (320)..(320): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccacctctcctgtgcggccagtcagagcgttaggacgaacttagcctggtatcagcagaggcctggccaggctcccagactcctcatctttggcncctttaacngggccagtggaatcccagccaggttcagcggcagtgggctgggacttcgtcacgtctcacatcaataacctgacaaagtctagacgtactttgctagtttattctgttcagctagtctagaagactggtccgtttcacgttttcggcgggagggaacccgaaggttcgggaccttcgaaacgaacttgttgctggcaacatcttgtcttctaac

SEQ ID NO: 301520 - DNA, 623 bp, Homo sapiens
  misc_feature: GZ8MTXP01A2FHI.8.28.C06.1.454.CMB.2.raw
  modified_base (312)..(312): a, c, t, g, unknown or other
  misc_feature (312)..(312): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgttttcctggggagagagccaccctctcctgtgcggccagtcagagcgttaggacgaacttagcctggtatcagcagaggcctggccaggctcccagactcctcattctttggcgtcctttaacgngggccagtggaactcccagccaggttcaggcggcaggtgggtctgggacttcgttcactctcaccatcaaatacctgacaatctagacgtactttgctaagtttattctgtcagctagtctagggaaacgtcgttcggtcccgtttacgtaccggtttccgggacgggtaacggggtacccgtaaaggggtcggtaaaccccgttacgaaaaacggtaaccgttgggtacgggccttacgggcccttaaccgttacttccgttcggttcctttccgtaactttcccgttacccccgtccttaactttcccg

SEQ ID NO: 301521 - DNA, 540 bp, Homo sapiens
  misc_feature: GZ8MTXP01DKHMY.8.28.C06.1.454.CMB.2.raw
  modified_base (511)..(511): a, c, t, g, unknown or other
  misc_feature (511)..(511): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctccagactcctcatctttggcgcctttaacgaggggccaggtggaactccccagccaggttcagcggcagtgggtctggacttcgtcactctcaccatcaaatacctgacaatctgacgtatttgctagtttattctgtcagcagtctaggaagtacgtggtccgttctacgtttcgggcgggtaacgggactaaggggtcgacctacaaacgaacttggtcggctggcaccnttctgtcttcactccttcccgcttaagtc

SEQ ID NO: 301522 - DNA, 549 bp, Homo sapiens
  misc_feature: GZ8MTXP01BQT7N.8.28.C06.1.454.CMB.2.raw
  modified_base (194)..(194): a, c, t, g, unknown or other
  misc_feature (194)..(194): n is a, c, g, or t
  modified_base (200)..(200): a, c, t, g, unknown or other
  misc_feature (200)..(200): n is a, c, g, or t
  modified_base (268)..(268): a, c, t, g, unknown or other
  misc_feature (268)..(268): n is a, c, g, or t
  modified_base (365)..(365): a, c, t, g, unknown or other
  misc_feature (365)..(365): n is a, c, g, or t
tcagctcgcgtgtccacgaccggtgctcgatttagagctcacgtattgggtttgggggaggaactgctcagttaggacccagacggaaccatggaagcaccagcgcagcttctcttcctcctgctactctggctcccagagatcattggagaagtggtgatgacacagtctccggtcaccctgtctgttttccngggganagagccaccctctcctgtgcggccagtcagagcgttaggacaacttagcctggtatcagcagaggccnggccaggctcccagactcctcatctttggccgtcctttaacgagggccagtggaatcccagccaggttcagcggccaggtggtctgggacttcgtcnctctcaccatcaataacctgacaatctagacgtactttgactagtttattctgtcagcagtcgtagaacgtactgggtccgttcacgtttcgggacgggaggggacccaagggttcgaacccttaacgaaaacgttactggttcggctcggcaccattcctgtccttcattccttcccgctaac

SEQ ID NO: 301523 - DNA, 829 bp, Homo sapiens
  misc_feature: GZ8MTXP01D4NRY.8.28.C06.1.454.CMB.2.raw
  modified_base (209)..(209): a, c, t, g, unknown or other
  misc_feature (209)..(209): n is a, c, g, or t
  modified_base (215)..(215): a, c, t, g, unknown or other
  misc_feature (215)..(215): n is a, c, g, or t
tcagctcgcgtgtccacgaccggtgctcgatttagagctcacgtattgggtttggggagagctctgggggaggaactgctcagttaggacccagacggaaccatggaagccccagcgcagcttctcttcctcctgctactctggctcccagagatcattggagaagtggtgatgacacagtctccggtcaccctgtcttgtttttccgngggganagacgccacctctcctgtgcggccagtcagagtcgtaggactaacttagctggtatcagcaggacggcctggccaggcctcccgagacctcctctacttcgtttcggcgtaccgtttaaacgacgggtcctaaggttacggaaaccttccccgaacggacccgtaacgggttccgaacggggtccggggtaccgtaagggggtttcgggggttccgttcggggggtaacccttttcccgggttaccctaacccgtttccgttacccaaaccctaacttaacctaaaacttaaacccgtacggaacctaaacgttccgtaacggtaaccgttacgttttacggtaccttaagtttttaactttcgttacgttaccggtaacgtccgttaaaggttaccgtaaggtaaaaccggtaccggtttccggggttaccccgtttaccgtttaaccggggttttacccgggggaccggggtaaacgggggtaaaccccgtaaagggggttacccggtaaaccccgttaaaccggaaaaaccgggttaaacgttcgggttcggttaccgttaacggaccctaaccggtacttccgttcggtttaaccctttccgttaacccg

SEQ ID NO: 301524 - DNA, 557 bp, Homo sapiens
  misc_feature: GZ8MTXP01DO5IV.8.28.C06.1.454.CMB.2.raw
  modified_base (523)..(523): a, c, t, g, unknown or other
  misc_feature (523)..(523): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgtggccagtcagagcgttaggacgaacttagcctggtatcagcagaggcctggccaggctcccagactcctcatctttggcgtcctttaacagggccagtggaactcccgagccaggttcagcggcagtgggtctgggacttcgtcactctcaccatcaatacctgacaatctagacgtactttgctagtttattctgtcagcagtctggaactacgttggtccgttctacgtttcgggacgggtacgggtaccgtaagggtacggacctaacgaaacgtaacgttggtacgcgtgcaccgttnttctgtcttcacttcgttcccgtcttaacgtccg

SEQ ID NO: 301525 - DNA, 635 bp, Homo sapiens
  misc_feature: GZ8MTXP01BFX7V.8.28.C06.1.454.CMB.2.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacgaacttagcctggtatcagcagaggcctggccaggctcccagacctcctcattctttggccgtacctttaacgaggggccaggtcggaactccccgagccgaggttcaggcggcaggtgggtctggggacttcgtcactctcaccatacaataacctgacaatctgactactttgactagtttatttctgttcagtctagtctagggaacgtacgtcgggtacccgtttcgacgtttccggggacgggtaacggggtacccgtaaaggggtacggaacccgttaacggaaaaccggtaacgttcgggtcgggccgttacggacccttacccgttacgttccgttcggttacctttcctaccgtttcccttaccccggtccttaacgtttcccg

SEQ ID NO: 301526 - DNA, 581 bp, Homo sapiens
  misc_feature: GZ8MTXP01CIBI6.8.28.C06.1.454.CMB.2.raw
  modified_base (213)..(213): a, c, t, g, unknown or other
  misc_feature (213)..(213): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtcttgtttttcctgggganagagccaccctctcctgtgcggccagtcagagcgttaggacgaacttagcctggtatcagcagaggcctggccaggcctcccagacctcctcattctttggcgtcctttaacagggccaggtggaactcccagccacggttcaggcggcaggtgggtctgggactttcgtcactctcacatcaataacctgcaatctagacgtactttgcttagtttattctagtcgagtctagttctagaagtacgtgggtacccgttcgtacgtttcgggcgggaacgggaacccgtaaagggttcgggaacccttacgaaaaccgtacgttagggttcggccttggccaaccgtatccttgttcctttcgtaacc

SEQ ID NO: 301527 - DNA, 620 bp, Homo sapiens
  misc_feature: GZ8MTXP01BUQW2.8.28.C06.1.454.CMB.2.raw
  modified_base (194)..(194): a, c, t, g, unknown or other
  misc_feature (194)..(194): n is a, c, g, or t
  modified_base (200)..(200): a, c, t, g, unknown or other
  misc_feature (200)..(200): n is a, c, g, or t
  modified_base (367)..(367): a, c, t, g, unknown or other
  misc_feature (367)..(367): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgttttccngggganagagccacctctcctgtgcggccagtcagagcgttaggacgaacttagcctggtatcagcagaggcctggccaggctcccagactcctcatctttggctcctttaacgagggccagtggaatcccagccaggttcagcggcagtgggtctgggacttcgttcactcncaccatcaataacctgacaatctgacgtactttgctagtttatttctgtcagcagtctagaagtacgtcggtaccgttcgtaccgtttcggggacggtaacgggggaacccgtaaaggggttcggaaacccgttacgaaaaacggtaaccgttgggtacggggttccttacggacccttaaacccgttagttccctttaaggttaccctttcctaacgtttcccctttccccgggccccttaagtttaacccg

SEQ ID NO: 301528 - DNA, 566 bp, Homo sapiens
  misc_feature: GZ8MTXP01A53AW.8.28.C06.1.454.CMB.2.raw
  modified_base (194)..(194): a, c, t, g, unknown or other
  misc_feature (194)..(194): n is a, c, g, or t
  modified_base (200)..(200): a, c, t, g, unknown or other
  misc_feature (200)..(200): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgttttccngggganagagccacctctcctgtgcggccagtcagagcgttaggacgaacttagcctggtatcagcagaggcctggccaggctcccagtactcctcatctttggcgtcctttaacaggggccagtcggaatcccagccaggttcagcggcaggtgggtctggggacttcgtcactctcaccatcaaataacctgacaatctgacgtactttgcttagtttatttctgtcagtcagtctagggaagtacgttcgggtccgtttacgacgtttcgggacgggtaacggggaccgtaagggtacggaccctacgaaaacgtaacgttgggtcggctggcacccgattctgtcttcacttccttcccgcttaatcg

SEQ ID NO: 301529 - DNA, 583 bp, Homo sapiens
  misc_feature: GZ8MTXP01A9ZC0.8.28.C06.1.454.CMB.2.raw
  modified_base (214)..(214): a, c, t, g, unknown or other
  misc_feature (214)..(214): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtcttgtttttccgtgggganagagccacctctcctgtgcggccagtcagagcgttaggacaacttagcctggtatcagcagaggcctggccaggcctccagacctcctcattctttggcgtaccttttaacgacggggccaggtggaactcccagccctaggttcaggcggcaggtcgggtctggggactttccggtcactctcacctatacaaactaactgcaatctagacgtactttgactagtttattctgtcagtctagtcttagaagtacgtcgggtccgttactaccggtttcgggccgggtaaggggaacctaaagggttcggaacccttacgaaaacgacgttggttgggctgaccaacgtatcttcgtaacttcgtaacc

SEQ ID NO: 301530 - DNA, 525 bp, Homo sapiens
  misc_feature: GZ8MTXP01BQIOI.8.28.C06.1.454.CMB.2.raw
  modified_base (309)..(309): a, c, t, g, unknown or other
  misc_feature (309)..(309): n is a, c, g, or t
  modified_base (499)..(499): a, c, t, g, unknown or other
  misc_feature (499)..(499): n is a, c, g, or t
  modified_base (510)..(510): a, c, t, g, unknown or other
  misc_feature (510)..(510): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacngggccagtggaatcccagccaggttcagcggcaggtgggtctgggacttcgttcactctcaccatcaataacctgcaatctgacgtactttgctagtttattctgtcagcagtctggaagctggccgttcacgtttcgggcggagggacctaagggtcggacctcgaaacgacttggtcggctgcaccgnttctgtcttcntccttcccgcaatcg

SEQ ID NO: 301531 - DNA, 544 bp, Homo sapiens
  misc_feature: GZ8MTXP01AX6OK.8.28.C06.1.454.CMB.2.raw
  modified_base (311)..(311): a, c, t, g, unknown or other
  misc_feature (311)..(311): n is a, c, g, or t
  modified_base (527)..(527): a, c, t, g, unknown or other
  misc_feature (527)..(527): n is a, c, g, or t
  modified_base (538)..(538): a, c, t, g, unknown or other
  misc_feature (538)..(538): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgttttcctggggagagagccaccctctcctgtgcggccagtcagagcgttaggacgaacttagcctggtatcagcagaggcctggccaggctccagactcctcattctttggcgtcctttaacgngggccagtggaactcccagccaggttcagcggcaggtgggtctgggacttcgtcactctcaccatcaataacctgacaatctgacgtactttgtcgttttatttctgtcagcagtctagaaggtacgtgggtccttcgtacgtttccgggcgggtagggaaccgtaagggtcggacctacgaaacgaactggttggcttgcacagttcttgtctcnctcctccgctnttcgtg

SEQ ID NO: 301532 - DNA, 596 bp, Homo sapiens
  misc_feature: GZ8MTXP01BZPR6.8.28.C06.1.454.CMB.2.raw
  modified_base (195)..(195): a, c, t, g, unknown or other
  misc_feature (195)..(195): n is a, c, g, or t
  modified_base (302)..(302): a, c, t, g, unknown or other
  misc_feature (302)..(302): n is a, c, g, or t
  modified_base (311)..(311): a, c, t, g, unknown or other
  misc_feature (311)..(311): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgcggccagtcagagcgttaaggacgaacttagcctggtatcagcagaggcctggccaggctcccagactcctcatctttggcncctttaacngggccagtggaatcccagcaggttcagcgcaggtgggtctgggacttcgtcactctcaccatcaatacctgactaatctagacgtactttgactagtttatttactgtacagtctagtcgtaggaagtaccgtcggtcccgttacgtaccgtttcgggacgggtaacggggacccgtaagggttccgggaacccttacgaaaaccggtaacgttgggttgggccgttaggccttacccgttattccgttgttccctttcacttcctttccccgcttaacgttccg

SEQ ID NO: 301533 - DNA, 533 bp, Homo sapiens
  misc_feature: GZ8MTXP01EVKHW.8.28.C06.1.454.CMB.2.raw
  modified_base (509)..(509): a, c, t, g, unknown or other
  misc_feature (509)..(509): n is a, c, g, or t
  modified_base (530)..(530): a, c, t, g, unknown or other
  misc_feature (530)..(530): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctccagactcctcatctttggcgtcctttaacagggccagtggaatccccagccaggttcagcggcagtgggtctggggacttcgttcactctcaccatcaatacctgactaatctgacgtactttgcttagtttatttctgtcagcagtctagggaatacgtggccttcacgtttcgggacggtagggaccgtaaggtcggacctacgaaacgtacgttgtcggctgcacnttctgtctcatccttcccgcntcg

SEQ ID NO: 301534 - DNA, 538 bp, Homo sapiens
  misc_feature: GZ8MTXP01EVAKF.8.28.C06.1.454.CMB.2.raw
  modified_base (510)..(510): a, c, t, g, unknown or other
  misc_feature (510)..(510): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctccagactcctcatctttggcgtcctttaacgaggggccagtggaactccccagccaggttcagcggcagtgggtctgggacttcgtcactctcaccatcaataacctgacaatctgacgactttgctagtttatttctgtcagcagtctgggaagtacgtggccgttcacgtttcgggcggtacgggacctaagggtcggacctcgaaacgtaacttggtgcgtcgcaccnttctgtcttcattccttccgcttaatcg

SEQ ID NO: 301535 - DNA, 705 bp, Homo sapiens
  misc_feature: GZ8MTXP01ARZ8W.8.28.C06.1.454.CMB.2.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacgtaacttagcctggtatcagcagaggcctggccaggcctccagactcctcattctttggccgtacctttaacgcgggccaggtcggaactcccagccaggttcagcggctaggtggggtctggggtacctttcggttaccaccgttctccaaccctatacctaaacttaaccctgaccctaaacttcgtagaacggtaccttttaggccttaagttttaactttcgtacgtactaagtcgtaagttcctaggggaaacgtccgttcgggtacccgtttacgttaccggtttccggggacggggaaccgggggtaaccccgtaaagggggttaccgggaaacccttacggaaaaaccggtaaccgttgggtacggggaccttcgggacccttaccgttactttcccgttcggtttaccctttccgtaacctttccccgttcccccggaaccttaacgttcccgg

SEQ ID NO: 301536 - DNA, 579 bp, Homo sapiens
  misc_feature: GZ8MTXP01DQFM5.8.28.C06.1.454.CMB.2.raw
  modified_base (207)..(207): a, c, t, g, unknown or other
  misc_feature (207)..(207): n is a, c, g, or t
  modified_base (213)..(213): a, c, t, g, unknown or other
  misc_feature (213)..(213): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtctgtttttccgngggganagagccaccctctcctgtgcggccagtcagagcgttaggacgaacttagcctggtatcagcagacggcctggccaggcctcccagacctcctcattcgtttggccgtacctttaaacgacggggccaggtaggaactcccagccgtaggttcaggcggcaggtgggtctgggtacttcgtcactctcacatacaaataactgacaatctagacgtacttgcttagtttatttctgtcaagctagtctagaagtacgtggtcccttctacgtttcgggcgggtaagggaaccgtaagggttcggtaaccttaacgaaaacgtacgttaggttcggctgctaacctatccgttcgttccttcgtaacc

SEQ ID NO: 301537 - DNA, 629 bp, Homo sapiens
  misc_feature: GZ8MTXP01EDQMA.8.28.C06.1.454.CMB.2.raw
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
  modified_base (292)..(292): a, c, t, g, unknown or other
  misc_feature (292)..(292): n is a, c, g, or t
  modified_base (313)..(313): a, c, t, g, unknown or other
  misc_feature (313)..(313): n is a, c, g, or t
  modified_base (375)..(375): a, c, t, g, unknown or other
  misc_feature (375)..(375): n is a, c, g, or t
  modified_base (389)..(389): a, c, t, g, unknown or other
  misc_feature (389)..(389): n is a, c, g, or t
  modified_base (424)..(424): a, c, t, g, unknown or other
  misc_feature (424)..(424): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccngggganagagccacctctcctgtgcggccagtcagagcgttaggacgaacttagcctggtatcagcagaggcctggccaggcctcccagactcctnattctttggctcctttaacgngggccagtcggaactcccagcctaggttcaggcggcaggtgggtctgggcttcgtacactcncacatacaactacngacaatctagacgtatttgacttagttttatttcngtacagctagttctaggggaacgtcgttcgggtacccgtttcgtacggtttcggggacgggtaaacggggtaccccgtaaagggggtccgtaaacccgtacgaaaaaccggtcgttcgggtacgggttccttacggcccttaaccgttattccgttcgtttacccttaaccgtcctttccccgttccccggtccttaagttcccg

SEQ ID NO: 301538 - DNA, 560 bp, Homo sapiens
  misc_feature: GZ8MTXP01A7ACN.8.28.C06.1.454.CMB.2.raw
  modified_base (530)..(530): a, c, t, g, unknown or other
  misc_feature (530)..(530): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggccgtcctttaacgagggccaggtggaactccccagccaggttcaggcggcaggtgggtctggggtacttcgttacactctcacatcaataacctgacaatctagacgtactttgctagtttattctgtcagcagtctaggaagtcgtggccgttcaccgtttcgggcggtaacggggaccgtaagggtcggacctcgaaaaccggtacttggtcggctacggcacccgttnttctcgtctctctcccttccctcttcgtcg

SEQ ID NO: 301539 - DNA, 622 bp, Homo sapiens
  misc_feature: GZ8MTXP01CANYG.8.28.C06.1.454.CMB.2.raw
  modified_base (195)..(195): a, c, t, g, unknown or other
  misc_feature (195)..(195): n is a, c, g, or t
  modified_base (307)..(307): a, c, t, g, unknown or other
  misc_feature (307)..(307): n is a, c, g, or t
  modified_base (370)..(370): a, c, t, g, unknown or other
  misc_feature (370)..(370): n is a, c, g, or t
  modified_base (385)..(385): a, c, t, g, unknown or other
  misc_feature (385)..(385): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgcggccagtcagagcgttaggacgaacttagcctggtatcagcagagctggcaggctccagactcctcatcttggcgtcctttaacgnggccagtggaactcccagccaggttcaggcggcaggtcgggtctggggtacttcgtacactcncaccatacaataccnacaatctagacgtactttgctagttttattctgtcagcagtctgggaacgtacgttcgggtccgtttcgaccgtttccggggacgggtaacggggaccctaaaggggtccgggaacccttacgaaaacggtaacgttgggtcgggttccttacggccttaacccggttacttccctttaacggtttaccttttaaccttccccgtttccccggaccttaacgttcccgtttaacggg

SEQ ID NO: 301540 - DNA, 556 bp, Homo sapiens
  misc_feature: GZ8MTXP01CFZPE.8.28.C06.1.454.CMB.2.raw
  modified_base (194)..(194): a, c, t, g, unknown or other
  misc_feature (194)..(194): n is a, c, g, or t
  modified_base (200)..(200): a, c, t, g, unknown or other
  misc_feature (200)..(200): n is a, c, g, or t
  modified_base (256)..(256): a, c, t, g, unknown or other
  misc_feature (256)..(256): n is a, c, g, or t
  modified_base (461)..(461): a, c, t, g, unknown or other
  misc_feature (461)..(461): n is a, c, g, or t
  modified_base (521)..(521): a, c, t, g, unknown or other
  misc_feature (521)..(521): n is a, c, g, or t
  modified_base (546)..(546): a, c, t, g, unknown or other
  misc_feature (546)..(546): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctccagagatcattggagaagtggtgatgacacagtctccggtcacctgtctgtttttccngggganagagccaccctctcctgtgcggccagtcagagcgttagacgaacttagcctggtancagcagaggcctggccaggctccagacctcctcattctttggcgtacctttaacgaggggccaaggtcggaactcccgaagcctaggttcaggcggcaggtcgggtctgggtacttcgtacactctcacatcaaatacctgacaatctaggactactttgcttaagttttattctgtacagtctagtctaggaagctggccgttnacgttcggcggaacggactaaggtcgaacctagaaacgtacttggtacgctgcttaccgnttcctgtccttcactcccgttcccncttaattccg

SEQ ID NO: 301541 - DNA, 647 bp, Homo sapiens
  misc_feature: GZ8MTXP01BXA44.8.28.C06.1.454.CMB.2.raw
  modified_base (210)..(210): a, c, t, g, unknown or other
  misc_feature (210)..(210): n is a, c, g, or t
  modified_base (216)..(216): a, c, t, g, unknown or other
  misc_feature (216)..(216): n is a, c, g, or t
  modified_base (249)..(249): a, c, t, g, unknown or other
  misc_feature (249)..(249): n is a, c, g, or t
  modified_base (274)..(274): a, c, t, g, unknown or other
  misc_feature (274)..(274): n is a, c, g, or t
  modified_base (281)..(281): a, c, t, g, unknown or other
  misc_feature (281)..(281): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtcctccggtccaccctgtcttgtttttccgngggganagacgcctaccctctcctgtcgcgccagtcagngcgttaggactaactagcctggtancagcagngcctggccaggcctccagacctcctcacttcgtttcggccgtacctttaagacgggacctaggtacggaactcccgagccgtaacggttcagggcgcgtagggttcgggtcgtggggtacctttccgtacaccgttctaccacctatactaaactaacctgactactctacgacgttacttagcttaagtttacttctacggtctaacggtctacgttctaggtaaaccgtcgttcggtacccgtttcctaccgggtttaccgggacgggtaaacgggtaaccggaaacgggttaccggaacccttaacgaaaaccggtacgttcggcggctaacgcctaaccgtatcgttacttcttcgtaaccg

SEQ ID NO: 301542 - DNA, 618 bp, Homo sapiens
  misc_feature: GZ8MTXP01DLSLV.8.28.C06.1.454.CMB.2.raw
  modified_base (195)..(195): a, c, t, g, unknown or other
  misc_feature (195)..(195): n is a, c, g, or t
  modified_base (312)..(312): a, c, t, g, unknown or other
  misc_feature (312)..(312): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgcggccagtcagagcgttaggacgaacttagcctggtatcagcagaggcctggccaggctccagacctcctcattctttggctcctttaacgngggccagtggaatcccagccaggttcaggcggcaggtgggtctgggacttcgtcactctcacatcaataacctgactaatctagacgtactttgcttagttttatttctgtacagtctagttcctagggaacgtacgttcgggtacccgtttcgtaaccgtttcggggacgggtaacggggaaccgtaaggggtacggtaaccctaacgaaaacggtaacgttgggttcggcgttacggcccttaaccgttattccgttcggttacctttcgtaacttccctttaccccggccttaacgttcccgg

SEQ ID NO: 301543 - DNA, 832 bp, Homo sapiens
  misc_feature: GZ8MTXP01DA57L.8.28.C06.1.454.CMB.2.raw
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccngggganagagtcaccctctcctgtgcggccagtcagagcgttaggacgaacttagcctggtatcagcagaggcctggccaggcctcccagacctcctctattcgtttggccgtacctttaaacgacgggggccctaaggttcgggaaacttcccccgaaaggtccccgtaaagggtttccaacgggccggggacctaacggggttcgggggttcgttacggggggtaacccttttcccggggtttaacccaacccgtttcccgtacctaaaccccgtaaattacccgtaaaacttaaaccccgttgggaaccctaaattccgtacggtaacgtaccttttaggacccttaggtttttaactttccttacggttaccaacggtctaaacggttccgtttaagggggaaaaccggttaccgtttcggggtaccccggttttaccgtaaaccggttttccgggggtaaccgggggaaacggggtaaccccggtaaaagggggttcccgggaaaccctttaaccggaaaaaaaccggtacgttacgggtacggttacgttacggacccttaacccgttagttcccttaaggtttacccttaacgtacctttcccgttttccccggcccgttaatttcccg

SEQ ID NO: 301544 - DNA, 542 bp, Homo sapiens
  misc_feature: GZ8MTXP01C8MHU.8.28.C06.1.454.CMB.2.raw
  modified_base (206)..(206): a, c, t, g, unknown or other
  misc_feature (206)..(206): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgcggccagtcagagcgttaggacgaacttagcctggtatcagcagagctggccaggctccagactcctcatctttggcgtacctttaacgagggccagtgaactccagccaggttcagcgcaggtgggtctgggacttcgtcactctcacatacaatacctgacaatctagacgtactttgctagtttattctgtcagtctagtctgaacgtctggtccttctacgtttcgggacgggagggaacccgaagggttcggaaccttacgaaacgtaacgttggttcgctgccaaccattcgttgtcttcgtaac

SEQ ID NO: 301545 - DNA, 689 bp, Homo sapiens
  misc_feature: GZ8MTXP01A83YK.8.28.C06.1.454.CMB.2.raw
  modified_base (298)..(298): a, c, t, g, unknown or other
  misc_feature (298)..(298): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggcccagggcccctaccgagacctcctntacttcgttcggccttacctttaacggcgggactaggtacggaacctcccgacgaccgtaggtacagacacgccgtaggtcgggtcgtcgggtactttccgtctctctcaacctatacaactactgactaatcgtacgacgttacttgactttagttttacttcgtagtactacgtacgtacgttacggtaaggtaaacgttccggtccgggtttacccgttaacgttaccgggtttccgggggaacgggggtaaccgggtaaacccggtaaggggtacccgtaaccccgtaaaacggtaaacccgttagggttcgggccggtcgtacggacccttaacttcgttccggttcgttcttaacccgtccttccccggttccccgaacttaacg

SEQ ID NO: 301546 - DNA, 577 bp, Homo sapiens
  misc_feature: GZ8MTXP01EAE8V.8.28.C06.1.454.CMB.2.raw
  modified_base (207)..(207): a, c, t, g, unknown or other
  misc_feature (207)..(207): n is a, c, g, or t
  modified_base (325)..(325): a, c, t, g, unknown or other
  misc_feature (325)..(325): n is a, c, g, or t
  modified_base (558)..(558): a, c, t, g, unknown or other
  misc_feature (558)..(558): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtcttgtttttccnggggagagagccaccctctcctgtgcggcagtcagagcgttaggactaacttagcctggtatcagcagaggcctggccaggctccagacctcctcattctttggcgtcctttaaacgngggtccaggttcggaaactcccgagcccgtaaggttcaggcggctaggtcgggtctggggtacttcgtcactctcactatacaatacctgacaatctagacgtacttgactagtttattctgtcagtcaagtctagaacgactggtaccgtttcgtaaccgtttcgggcgggaagggtaacccgaagggttcggaacccttacgaaacgtacgttaggttcgcgtgctaaccngtcttcgttcttcgtaacc

SEQ ID NO: 301547 - DNA, 582 bp, Homo sapiens
  misc_feature: GZ8MTXP01BIQKU.8.28.C06.1.454.CMB.2.raw
  modified_base (314)..(314): a, c, t, g, unknown or other
  misc_feature (314)..(314): n is a, c, g, or t
  modified_base (548)..(548): a, c, t, g, unknown or other
  misc_feature (548)..(548): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttcctggggagagagcccacctctcctgtgcggccagtcagagcgttaggacgaacttagcctggtatcagcagaggcctggccaggcctcccagacctcctcatctttggcctcctttaagngggccagtggaactcccgagtccaggttcaggcggcgaggtggggtctggggtacctttcggttcactctcaacctataccaaatacctgacaatctgacgtactttgacttacgtttattctgtcagctaagtcaggggtaatcgtcggtccgttcaacggtttcgggacggtacgggaaccgtagggtacggacctacgaaacgtaacgttgggtacgcgtagccaacgttnttctgtcttctactccgttcccgtcttaacgtcg

SEQ ID NO: 301548 - DNA, 532 bp, Homo sapiens
  misc_feature: GZ8MTXP01BFOYY.8.28.C06.1.454.CMB.2.raw
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
  modified_base (315)..(315): a, c, t, g, unknown or other
  misc_feature (315)..(315): n is a, c, g, or t
  modified_base (347)..(347): a, c, t, g, unknown or other
  misc_feature (347)..(347): n is a, c, g, or t
  modified_base (386)..(386): a, c, t, g, unknown or other
  misc_feature (386)..(386): n is a, c, g, or t
  modified_base (429)..(429): a, c, t, g, unknown or other
  misc_feature (429)..(429): n is a, c, g, or t
  modified_base (444)..(444): a, c, t, g, unknown or other
  misc_feature (444)..(444): n is a, c, g, or t
  modified_base (502)..(502): a, c, t, g, unknown or other
  misc_feature (502)..(502): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccngggganagagcccaccctctcctgtgcggccagtcagagcgttaggacgaacttagcctggtatcagcagaggcctggccaggctcccagacctcctcatctttggcgtcctttaacgngggccagtggaactcccagccagttcagcggnacgtgggtctgggacttcgtcactctcacatcaataccngacaatctgactactttgctagtttatttctgtcagtcagtcnggaagactggccttnacgtttcggcggacggactaagggtcggacctacgaaacgacttgtcggctgcaccgnttctgtctctactccttacccgcttaagtc

SEQ ID NO: 301549 - DNA, 763 bp, Homo sapiens
  misc_feature: GZ8MTXP01AU7NM.8.28.C06.1.454.CMB.2.raw
  modified_base (206)..(206): a, c, t, g, unknown or other
  misc_feature (206)..(206): n is a, c, g, or t
  modified_base (212)..(212): a, c, t, g, unknown or other
  misc_feature (212)..(212): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtcttgttttccngggganagagccacctctcctgtgccggccagtcagagcgttaggacaacttagcctggtatcagcagaggcctggccaggcctcccagacctcctcattcgtttcggccgtacctttaacgacggggtcccaaggttcggaaaccttccccgaggtcccgtaacggggtttccacgggcccgggtactaaggggttcgggggttcccgttggggggtaaccctttttcccgggttaccaaccctttcctacccaaaccctacttaccaaaactttaaacccctcggaacctaaacgttcccgttacggtaacccgtttaacttttcggaccgttaagtttttaactttccgttcgttacgacgtcgtaacgttaccgttaggaaacgtaccgttcgggtacccgtttcgtaaccggttttccgggaccgggtaacggggaacccgtaaagggggttccggtaaacccgttaacgtaaaaccggtaacgttcgggttcggttccgttaacgaccgtaaacccttcgttccgttaccggttccctttcgttaaccccg

SEQ ID NO: 301550 - DNA, 531 bp, Homo sapiens
  misc_feature: GZ8MTXP01AMLKR.8.28.C06.1.454.CMB.2.raw
  modified_base (195)..(195): a, c, t, g, unknown or other
  misc_feature (195)..(195): n is a, c, g, or t
  modified_base (384)..(384): a, c, t, g, unknown or other
  misc_feature (384)..(384): n is a, c, g, or t
  modified_base (506)..(506): a, c, t, g, unknown or other
  misc_feature (506)..(506): n is a, c, g, or t
  modified_base (516)..(516): a, c, t, g, unknown or other
  misc_feature (516)..(516): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgcggccagtcagagcgttaggacgaacttagcctggtatcagcagaggcctggccaggctccagactcctcatctttggcgtcctttaacagggccagtggaatcccagccaggttcagcggcagtgggtctggggacttcgttcactctcaccatcaataaccngacaatctgacgtactttgctagtttatttctgtcagcagtctggaacgcgtcggccgttcacgtttcggcgggacgggaccgtagggtacggacctacgaaacgacttggtggctgcaccnttctgtctcnctcttcccgcaatcg

SEQ ID NO: 301551 - DNA, 705 bp, Homo sapiens
  misc_feature: GZ8MTXP01BFD1Q.8.28.C06.1.454.CMB.2.raw
  modified_base (207)..(207): a, c, t, g, unknown or other
  misc_feature (207)..(207): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtcttgttttccgnggggagagacgccaccctctcctgtgcggccagtcagagcgttaggactaacttagctggtatcagcaggacggccgtggccaggcctcccagacctcctcattcgtttcggccgtacctttaacgacggggtaccctaaggtacggaaactccccgaggacccgtaacgggttccaagggccgggacgtaggggttcgggggttccgtcgggggtaaccctttccgggttacccaaccgttcctaccaaaccctaataacctaaactaaccctcgaactaaattcgttacggtaacgttaactttcggtacttaagtttatttcgtgtacaggtctaagttcgtagaaacgtacgttcggttcccgtttacgtaccggtttacggggaccgggtaacggggaacccgtaaagggttcggaaacccgttaacgaaaaccggtaacgttggttcggttctaacggcctaaccgtattccgttacgttccttcgtaaccg

SEQ ID NO: 301552 - DNA, 586 bp, Homo sapiens
  misc_feature: GZ8MTXP01AHUGT.8.28.C06.1.454.CMB.2.raw
  modified_base (193)..(193): a, c, t, g, unknown or other
  misc_feature (193)..(193): n is a, c, g, or t
  modified_base (199)..(199): a, c, t, g, unknown or other
  misc_feature (199)..(199): n is a, c, g, or t
  modified_base (308)..(308): a, c, t, g, unknown or other
  misc_feature (308)..(308): n is a, c, g, or t
  modified_base (386)..(386): a, c, t, g, unknown or other
  misc_feature (386)..(386): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctccagagatcattggagaagtggtgatgacacagtctccggtcaccctgtctgttttccngggganagagccacctctcctgtgcggccagtcagagcgttaggacgaacttagcctggtatcagcagaggcctggccaggctccagacctctcatctttggcgtcctttaacgngggccagtggaactcccgagccgaggttcaggcggcaggtgggtcgtgggtacttcgtacactctcacatcaataccngacaatctagacgtactttgcttagtttattctgtcagctagttcgtaggaaagtcgtcggtccgtttacgtacgtttcggggacgggaacggggaaccgtaaggggtcggaacctacgaaaacggtacttgggtacggcttacggcccttacgttacttctaacgttcttctaccgttcccttccccgtcttaactccg

SEQ ID NO: 301553 - DNA, 602 bp, Homo sapiens
  misc_feature: GZ8MTXP01CCDO4.8.28.C06.1.454.CMB.2.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (562)..(562): a, c, t, g, unknown or other
  misc_feature (562)..(562): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacgtaacttagcctggtatcagcagaggcctggccaggctcccagactcctcatctttggcgtccctttaacgacggggccaggtcgggaactcccccaggcccaggttcaaggcggcaggtggggtcgtggggtacttcggtcactctcacccatcaaactaacctgacaatctagacgtactttgacttagttttatttctgtctagctagtctaggaagtctcgggtcccgtttcgaccgtttcgggcgggtaacggggtaccgtaagggtcggaacccgtacgaaaacgtaacgttggtacgggcttggccaccgttnttcgtcgttccttcacgttccttccccgccttaacgtccg

SEQ ID NO: 301554 - DNA, 794 bp, Homo sapiens
  misc_feature: GZ8MTXP01C4D7N.8.28.C06.1.454.CMB.2.raw
  modified_base (203)..(203): a, c, t, g, unknown or other
  misc_feature (203)..(203): n is a, c, g, or t
  modified_base (209)..(209): a, c, t, g, unknown or other
  misc_feature (209)..(209): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctccagagatcattggagaagtggtgatgacacagtctcggtcacctgtctgtttttccngggganagagccacctctcctgtgcggccagtcagagtcgttaggacaacttagcctggtatcagcagaggcctggccaggctcccagacctcctcattcgtttcggaccgtacccttttaaacgacggggccctaaggtacggaaaccttcccccgaaggtaccccgtaacggggtttccaacgggccgggtccgtaaggggtttcgggggttccgttcggggggttaaaccctttttccgggtttaccctaaacccgtttcccttacccaaaccccgttaaacttaaccctaaaaacctttaaacccctacggtaacctaaaacttcccgttaacggtaaaccgtttaaccgtttttacggtaccctttaaggtttttaacgttttaccttggtttaccggaacggttaccctaaaggttccgtaagggtaaacgtaccgttcgggttaccccgtttacgtacccggttttaccggggaccgggaacggggtaaacccgtaaaggggttaccggtaaacccgttacggaaaacgtaccgttaggttcggacgtcgacctaacgtacttcgttcgttccttcgtaacccg

SEQ ID NO: 301555 - DNA, 648 bp, Homo sapiens
  misc_feature: GZ8MTXP01AQGY8.8.28.C06.1.454.CMB.2.raw
  modified_base (196)..(196): a, c, t, g, unknown or other
  misc_feature (196)..(196): n is a, c, g, or t
  modified_base (295)..(295): a, c, t, g, unknown or other
  misc_feature (295)..(295): n is a, c, g, or t
  modified_base (319)..(319): a, c, t, g, unknown or other
  misc_feature (319)..(319): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgttttccgnggggagagacgccaccctctcctgtgcggccagtcagagcgttaggacgtaacttagctggtatcagcaggaggcctggacaggcctccagacctcctnattcgtttggcctacctttaacgngggccaggtggaactcccaggcctaggttcaggcggcgtaggtgggtctggggtaccttcgttacacgttctacacctatacaactacctgactaactctacggtaacgttctttgactttagttttactttcgtcggtacagactaggttccgtaggggtaaacgtcggttcggtacccgtttacgtaccggtttcggggacgggtaacgggacccgtaaggggtccggtaaacctacggtaaaacgtacgttggtacgggttctacggaccttaccttgttccgtgttccttaactaccgttcccgttaccccgcttaacgtaaccg

SEQ ID NO: 301556 - DNA, 581 bp, Homo sapiens
  misc_feature: GZ8MTXP01BGTDX.8.28.C06.1.454.CMB.2.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (382)..(382): a, c, t, g, unknown or other
  misc_feature (382)..(382): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccacctctcctgtgcggccagtcagagcgttaggacgaacttagcctggtatcagcagaggcctggccaggctccagactcctcatctttggcgtcctttaacgagggccagtggaactcccagccaggttcagcgcaggtgggtctgggacttcgtcactctcaccatcaataccngacaatctgacgtactttgcttagttttacttctgtacagtctagtctagggaacgtacgtcggtccgttcgacgtttcgggacggacgggtaccgtaaggggtcgaacctacgaaaacggtacgttggtacggcttacggccttaccgttattcgttaacgttcttcctacttccgttaccccgtccttaagttcccg

SEQ ID NO: 301557 - DNA, 514 bp, Homo sapiens
  misc_feature: GZ8MTXP01EXHDV.8.28.C06.1.454.CMB.2.raw
  modified_base (206)..(206): a, c, t, g, unknown or other
  misc_feature (206)..(206): n is a, c, g, or t
  modified_base (212)..(212): a, c, t, g, unknown or other
  misc_feature (212)..(212): n is a, c, g, or t
  modified_base (320)..(320): a, c, t, g, unknown or other
  misc_feature (320)..(320): n is a, c, g, or t
  modified_base (446)..(446): a, c, t, g, unknown or other
  misc_feature (446)..(446): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacaaacttagcctggtatcagcagaggcctggccaggctcccagactcctcatctttggcgcctttaanagggccagtggaatccagccaggttcagcggcagtgggctgggacttgtcatctcaccatcaataacctgcaatctagacgtactttgctagtttattctgttcagcagtctgaagactggccttntactttcggcgagggccaaggttggaccttgaaacgaacttgttggctgcaacatcttgtcttctaac

SEQ ID NO: 301558 - DNA, 639 bp, Homo sapiens
  misc_feature: GZ8MTXP01B2QPC.8.28.C06.1.454.CMB.2.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (307)..(307): a, c, t, g, unknown or other
  misc_feature (307)..(307): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgttttccngggganagagccacctctcctgtgcggcagtcagagcgttaggacgtaacttagcctggtatcagcagaggcctggccaggctccagactctcatctttggctcctttaacngggccagtggaactcccagccaggttcagcggcacggtgggtctggggacctttcgtcacttctcaaccatacaaataacctgactaatctacgtacgtactttgacttagttttactttctgttcagctaagttcgtagggtaaacgtacgttcgggtacccgtttacgtacgtttcggggacggtaacggggtaaccctaaaggggttccggaacccttaacgaaaaccggtaacgttcgggtacggccgttacggaccttaccgttacttccgttaacggttccctttaacctaacgttccctttccccggaacccttaacggttcccg

SEQ ID NO: 301559 - DNA, 605 bp, Homo sapiens
  misc_feature: GZ8MTXP01DGBT3.8.28.C06.1.454.CMB.2.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (212)..(212): a, c, t, g, unknown or other
  misc_feature (212)..(212): n is a, c, g, or t
  modified_base (355)..(355): a, c, t, g, unknown or other
  misc_feature (355)..(355): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccacctntcctgtgcggccagtcagagcgttaggacgaattagcctggtatcagcagaggcctggccaggctccagactcctcatctttggcgtacctttaacgaggggccagtggaactcccagccaggttcaggcggcacggtgggtntgggtacttcgttacactctcacatcaaataacctgactaatctagaccgtattgcttagtttattctgtacagctagtcttaggaaagtcgtggtccgttctaacgtttcgggacgggaacgggaaccgaaagggttacggaaccctaacgaaaaaccgaacgttcggtgggcgttacgaccaacccgttattcccgtttcgttccttaacctaccgttcccgttaccccgtaaccgttaacgtaaccg

SEQ ID NO: 301560 - DNA, 611 bp, Homo sapiens
  misc_feature: GZ8MTXP01CQUET.8.28.C06.1.454.CMB.2.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (410)..(410): a, c, t, g, unknown or other
  misc_feature (410)..(410): n is a, c, g, or t
  modified_base (443)..(443): a, c, t, g, unknown or other
  misc_feature (443)..(443): n is a, c, g, or t
  modified_base (572)..(572): a, c, t, g, unknown or other
  misc_feature (572)..(572): n is a, c, g, or t
  modified_base (600)..(600): a, c, t, g, unknown or other
  misc_feature (600)..(600): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggaacgtaacttagcctggtatcgagcagacggcctggccaggcctcccagacctcctcattccgtttggccgtacctttaacgcgggaccaggtaggaactccccgagccgtaggttcaggcggctagggtgggtctggggtaccttcgtacactctcaccatcaatactnacatctagacgtacttgacttagttttacttcngtcagctagttctaggaacgtacgttcgggtccttacgtaaccgtttcggggacggggtaacgggaaccgtaaggggtaccgaccctaacgaaaaccggtaacgttgggacgcgtacggccttaaccgnttcttcgtccttcacttccgttaccccncgttaattccg

SEQ ID NO: 301561 - DNA, 585 bp, Homo sapiens
  misc_feature: GZ8MTXP01EFC5X.8.28.C06.1.454.CMB.2.raw
  modified_base (207)..(207): a, c, t, g, unknown or other
  misc_feature (207)..(207): n is a, c, g, or t
  modified_base (213)..(213): a, c, t, g, unknown or other
  misc_feature (213)..(213): n is a, c, g, or t
  modified_base (366)..(366): a, c, t, g, unknown or other
  misc_feature (366)..(366): n is a, c, g, or t
  modified_base (569)..(569): a, c, t, g, unknown or other
  misc_feature (569)..(569): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtcttgtttttccngggganagacgccacctctcctgtgcgccagtcagagcgttaggactaacttagcctggtatcagcaggacggcctggccaggcctccagacctcctctattcgtttggctacctttaacgacgggccaggtgaaactccgagccgtaggttcagcggnaggtgggtctgggtacttcgtcactctcacatacaaataacctgactaatctacgacgttactttgacttagtttacttacgtcggttacaagtcgtaagttcgtagaaacgtcgttggtacccgttctacggtttcgggacgggtacgggaacgtaaggttcggaaccttaacgaaacgtacgttgttcggctgcaaccttntcttcttccttctccg

SEQ ID NO: 301562 - DNA, 641 bp, Homo sapiens
  misc_feature: GZ8MTXP01AWDLX.8.28.C06.1.454.CMB.2.raw
  modified_base (194)..(194): a, c, t, g, unknown or other
  misc_feature (194)..(194): n is a, c, g, or t
  modified_base (200)..(200): a, c, t, g, unknown or other
  misc_feature (200)..(200): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgttttccngggganagagccacctctcctgtgcggcagtcagagcgttaggacgtaacttagcctggtatcagcagaggcctggccaggctcccagactcctcatctttggcgcctttaacagggccagtggaatcccagccaggttcagcggcacggtgggtctggggacttcgtacactctacacctatcaaataaccctgaccaatctagacgtactttgctagtttattctgtcagcagttcctaggggaacgtacgtcgggtcccgtttccgtaaccggtttccgggacggggtaacggggaacccgtaaagggggttccgggaaacccttaccggaaaacggtaaacccgttagggtcgggaccgttcgggaccttaaccccacgttcccgttaaggttccctttaaccgtaaccttccccttttcccccggaaccttaactttcccgg

SEQ ID NO: 301563 - DNA, 571 bp, Homo sapiens
  misc_feature: GZ8MTXP01BL6OA.8.28.C06.1.454.CMB.2.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcgccagtcagagcgttaggacgaacttagcctggtatcagcagagcctggccaggctcccagactcctcatctttggcgtcctttaacagggccagtggaatcccagcaggttcagcgcaggtgggtctgggacttcgtacactctcaccatacaataacctgacaactctaggactactttgctagttttatttctgtcagctagtctaggaacgtacgttcggtcccgttctaccgtttcggggacggtacggggaaccgtaaggggtcggaacccttaacgaaaacgtaacgttcggtggccgtagcaacccttgttctgttctctacttccttcccgccttaattcg

SEQ ID NO: 301564 - DNA, 631 bp, Homo sapiens
  misc_feature: GZ8MTXP01DY2QD.8.28.C06.1.454.CMB.2.raw
  modified_base (196)..(196): a, c, t, g, unknown or other
  misc_feature (196)..(196): n is a, c, g, or t
  modified_base (598)..(598): a, c, t, g, unknown or other
  misc_feature (598)..(598): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgttttccgnggggagagacgccacctctcctggtgcggccagtcagagcgttaggacgtaacttagcctggtatcagcaggaggcctggccaggcctccgagacctcctctattcgtttggctacctttaacgacggggccaggtggaactccccgagccgtaggttcaggcggcgtacggttggggtcgtaggggtacctttccggttaccaacttctaccaaccctaataccaaaactaccctgacctaactcgtagtacgtactttgactttagttttactttcgtcgtcagtctagttcgtaggggtaaacgtacggttcggtccgttacgtaccgtttcggggacggtacgggtaccgtaagggtcgaaccgtacgaaacgtacgttggtacggctcggcacgttnttctcgttctctacttccttccgtcttaactcg

SEQ ID NO: 301565 - DNA, 561 bp, Homo sapiens
  misc_feature: GZ8MTXP01CHIJ6.8.28.C06.1.454.CMB.2.raw
  modified_base (196)..(196): a, c, t, g, unknown or other
  misc_feature (196)..(196): n is a, c, g, or t
  modified_base (315)..(315): a, c, t, g, unknown or other
  misc_feature (315)..(315): n is a, c, g, or t
  modified_base (403)..(403): a, c, t, g, unknown or other
  misc_feature (403)..(403): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgcggccagtcagagcgttaggacgaacttagcctggtatcagcagaggcctggccaggctcccagacctcctcattctttggcgtcctttaacgnggggcccagtggaatcccgagccgtaggttcagcggcaggtgggtctggacttcgtacactctcacatcaataacctgctaatcgtanacgtacttgactagtttattctgtcagtcagtctagggaagtacgtggtccgttctacgtttcgggcggtaacgggacctaaggggtcgaccgtcaaaacggtacttggtcggctcgcacgattctgtccttctacgtccttaccccgtcaacttccg

SEQ ID NO: 301566 - DNA, 704 bp, Homo sapiens
  misc_feature: GZ8MTXP01BO5G8.8.28.C06.1.454.CMB.2.raw
  modified_base (214)..(214): a, c, t, g, unknown or other
  misc_feature (214)..(214): n is a, c, g, or t
tcagctcgcgtgtccacgaccggtgctcgatttagagctcacgtattggggtttggggagagctctggggaggaactgctcagttaggacccagacggaaccatggaagccccagcgcagcttctcttcctcctgctactctggctcccagagatcattggagaagtggtgatgacacagtctccggtcaccctgtcttgtttttcctgggganagagccacctctcctgtgcggcagtcagagcgtaggacgaactagcctggtatcagcagacggccgtggccaggcctcccagacctcctcattcctttaggccgtacctttaaacgacggggcccaggtcggaaacctccccgaagcccgtaaggttccaggccggtcgagggttcgggtcgttggggtacctttccggttacaaccgttcctaccaaacctactacctaaacttaaacccggtcaccgtaaacttacgtacggtaacgtacgttttaggacttagttttaatttccgttgttaccgtaaggtcctaggttaccttaggaagtacgttcggtacccggtttccgtaccgggttttccgggaccggggtaacggggaaaccggtaaacgggttaccgggaaccttaacgtaaaaccggtaacgttggttacgggttctaacggtaccaaccgtacgtccttcgttaaccgttcgtaacccg

SEQ ID NO: 301567 - DNA, 609 bp, Homo sapiens
  misc_feature: GZ8MTXP01BZX99.8.28.C06.1.454.CMB.2.raw
  modified_base (200)..(200): a, c, t, g, unknown or other
  misc_feature (200)..(200): n is a, c, g, or t
  modified_base (313)..(313): a, c, t, g, unknown or other
  misc_feature (313)..(313): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgttttcctgggganagagccaccctctcctgtgcggccagtcagagcgttaggacgaacttagcctggtatcagcagaggcctggccaggctcccagacctcctcatctttggccgtcctttaacgngggccagtggaactcccagccaggttcagcggcaggtgggtctgggacttcgtcactctcaccatcaataacctgactaatctgacgtactttgactagtttatttctgtcagtcagtctgggaacgtacgttcggccgtttcgtaccgtttcgggacggtaacggggaaccgtaaggggtacgtaacccgtacgaaaaccggtaacgttggtcgggccttacggaccttaaccccgttagttccgtttcgttccctttaactacttccccgtttaccccggccttaacgttcccg

SEQ ID NO: 301568 - DNA, 611 bp, Homo sapiens
  misc_feature: GZ8MTXP01DX3XY.8.28.C06.1.454.CMB.2.raw
  modified_base (197)..(197): a, c, t, g, unknown or other
  misc_feature (197)..(197): n is a, c, g, or t
  modified_base (204)..(204): a, c, t, g, unknown or other
  misc_feature (204)..(204): n is a, c, g, or t
  modified_base (320)..(320): a, c, t, g, unknown or other
  misc_feature (320)..(320): n is a, c, g, or t
  modified_base (392)..(392): a, c, t, g, unknown or other
  misc_feature (392)..(392): n is a, c, g, or t
  modified_base (567)..(567): a, c, t, g, unknown or other
  misc_feature (567)..(567): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctcccagagatcattggagaagtggtgatgacacagtctccggtcaccctgtcttgtttttccnggggganagagcccaccctctcctggtgcggccagtcagagcgttaggactaacttagcctggtatcagcagaggcctggccaggctcccagacctcctcattcgtttggcgtcctttaacgnggggccaggtggaactcccaagccgtaggttcaggtcggctaggtgggtctggggtactttcgtacacttcncaccatacaaatacctgacaatcaggactactttgcttagtttactttctgtcagctagtctaggggaacgtacgtcggtaccgttcgtaaccgtttcggggacgggtaacgggaccgtaaggggttcggaaccttacgaaaacggtacgttggttacggctcgtcaacccgttnttccttcgttcttaacctacttcccgttacccgtccttaagtcg

SEQ ID NO: 301569 - DNA, 616 bp, Homo sapiens
  misc_feature: GZ8MTXP01BMBDU.8.28.C06.1.454.CMB.2.raw
  modified_base (206)..(206): a, c, t, g, unknown or other
  misc_feature (206)..(206): n is a, c, g, or t
  modified_base (212)..(212): a, c, t, g, unknown or other
  misc_feature (212)..(212): n is a, c, g, or t
  modified_base (244)..(244): a, c, t, g, unknown or other
  misc_feature (244)..(244): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtcttgttttccngggganagacgccacctctcctgtcgcggccagtcagngcgttaggacgaacttagcctggtatcagcagaggcctggccaggcctcccagacctcctctattcgtttcggcgtaccttttaacgacggggcctaggtcggaactccccgaggcccctaagggtttcaggcggcgtacggtggggtctgggggtactttcggttcacctctcacctatacaatacctgactaatctagacgtactttgacttagtttattctgtcgagtcgtagtcgtagaagtacgtcggtccgttcgtaccgtttccgggacgggtacgggaaccgtaagggttcgggtaaccttacgaaaacggtacttaggttcggacgtcggactaacctagttccttcgttcctttccgtaacc

SEQ ID NO: 301570 - DNA, 642 bp, Homo sapiens
  misc_feature: GZ8MTXP01DSG8K.8.28.C06.1.454.CMB.2.raw
  modified_base (196)..(196): a, c, t, g, unknown or other
  misc_feature (196)..(196): n is a, c, g, or t
  modified_base (203)..(203): a, c, t, g, unknown or other
  misc_feature (203)..(203): n is a, c, g, or t
  modified_base (413)..(413): a, c, t, g, unknown or other
  misc_feature (413)..(413): n is a, c, g, or t
  modified_base (588)..(588): a, c, t, g, unknown or other
  misc_feature (588)..(588): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccnggggganagagcccacctctcctgtgcggccagtcagagcgttaggacgtaacttgcctggtatcagcagaggcctggccaggcctccagacctcctcattcgtttggaccgtcctttaaacgacgggggtccaggtacggaactcccagccgtaggttcaggcggactaggtgggtcgtgggtacttcgtacacttctacaacatacaactaaccngacatctgacctatttgacttagtttatttctgtcagtcgagtctagggaaacgcgttcggtaccgtttcgtacggtttccgggaacggggtaacggggaacccgtaaagggttaccgggaacccttaacggaaaacgtaacgttcgggtacgggacttcggaccttaaccgttnttaccttcgttaccctttaacgacccttccctttccccggccttaacgtttccg

SEQ ID NO: 301571 - DNA, 606 bp, Homo sapiens
  misc_feature: GZ8MTXP01B5KYT.8.28.C06.1.454.CMB.2.raw
  modified_base (315)..(315): a, c, t, g, unknown or other
  misc_feature (315)..(315): n is a, c, g, or t
  modified_base (387)..(387): a, c, t, g, unknown or other
  misc_feature (387)..(387): n is a, c, g, or t
  modified_base (394)..(394): a, c, t, g, unknown or other
  misc_feature (394)..(394): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggcagtcagagcgttaggacgtaacttagcctggtatcagcagaggcctggccaggctcccagactcctcattctttggccgtacctttaacgngggcccagtggaactcccagccaggttcagcggcaggtgggtctgggtactcgtcactctcacatcaatacngacatcngacgtactttgcttagtttattctgtcagctagtctgggaaacgtcgtcgggtcctttacgaccgtttccggggacggtaacggggaaccgtaaaggggtcggaaaccctacggtaaaacggtaacttcgggtacggcgttacggacccttaccgttacttccgttcggttaccttctaacttcccgttaccccgtccttaacgttaacccg

SEQ ID NO: 301572 - DNA, 749 bp, Homo sapiens
  misc_feature: GZ8MTXP01DVKFH.8.28.C06.1.454.CMB.2.raw
  modified_base (198)..(198): a, c, t, g, unknown or other
  misc_feature (198)..(198): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggcctccagagatcattggagaagtggtgatgacacagtctccggtcaccctgttcttgtttttccgnggggagagacgcccaccctctcctggtcgccggcagtcagagtcgttaggacgtaacttgccgtaggtatcgagcaggacggcctcggccaggcctcccagtacctcctctattcgtttcggcctacctttaacgcgggtaccaggtacggaactcccgagccgtaggttcaggcggacgtaggtcgggtcgtgggtacctttcgtaccacttcctaccaaacctatacctaaactaccgtgactaacttcgtacgtacgttacgtttcgtacgtttaagttttttactttcgttacggtactacgtacgtaacgtttcgttaaacggggtaaaccggttaaccggtttccggggtttaccccgttttacggttaacccgggttttccgggggaccggggtaaaccggggtaaccggtaacggggttaccggtaacccgttaacggaaaaacggtaccgttgggtaccggacgttaccggacccgttaccgttacttccggttaacgttccttaaccgtctttccccgttcccgtaaccttaacttcccgg

SEQ ID NO: 301573 - DNA, 662 bp, Homo sapiens
  misc_feature: GZ8MTXP01CXSJ1.8.28.C06.1.454.CMB.2.raw
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
  modified_base (310)..(310): a, c, t, g, unknown or other
  misc_feature (310)..(310): n is a, c, g, or t
  modified_base (618)..(618): a, c, t, g, unknown or other
  misc_feature (618)..(618): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccngggganagagccaccctctcctgtgcggcagtcagagtcgttaggacgtaacttagcctggtatcagcagaggcctggccaggctccagactctcatctttggctcctttaagngggccagtggaactcccagccaggttcaggcggcaggttgggtctgggtactttcgttaccacttcctacaccatacaaactaacctgactaaatcgtacgtacgttactttcgtacgtttaagttttactttcttacgtacgtacgtacgttacgttacgtaggggtaaacggttccggttaccgggttccccgtttacgtaaacccgggtttccgggggaacggggtaaccggtaaccgtaaacgggtaccgggtaaccctaaacggtaaaaccgtacgttgggtcgcgttacgacttaaccgttnttaccgttcttaccttctaccttccttacccgtcttaacgtccg

SEQ ID NO: 301574 - DNA, 803 bp, Homo sapiens
  misc_feature: GZ8MTXP01DQYC2.8.28.C06.1.454.CMB.2.raw
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
  modified_base (462)..(462): a, c, t, g, unknown or other
  misc_feature (462)..(462): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctccagagatcattggagaagtggtgatgacacagtctccggtcaccctgtcttgtttttccgngggganagagccacctctcctgtgcgcagtcagagcgttaggacgtaacttagcctaggtatcagcagacggcctggccaggcctcccgaagacctcctcattcgtttcggcctaccctttaaacgacggggcccaaggtacggaaactccccgaaggccgtagggttcaggtccgggacgtaggggttcgggggtacgtcgggggttacctttccggttaccaaccttccctacctaaccctaacttaccaaaacttaacccgtntaacctaaacgttcctacggtaacgttactttaggtacctttaaaggttttacttttacgttcgttacgtaacgaccttaaaggttccgttaaggggtaaaacggttcggttaccgggttcccgtttaaccggttaccggttttaccgggggaaccgggggtaaacgggggtaaacccgtaaaacgggggttacccgggaaacccgtaaacgtaaaaaacccgggttaacggttcggggtacggggttaccttacgggaaccaacccggttcttaccgtttaacggtttaccttttaacctttccccgttaccccggttaccttaacgttcgttaaccggg

SEQ ID NO: 301575 - DNA, 618 bp, Homo sapiens
  misc_feature: GZ8MTXP01AIZKO.8.28.C06.1.454.CMB.2.raw
  modified_base (203)..(203): a, c, t, g, unknown or other
  misc_feature (203)..(203): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgtgggganagacgcccaccctctcctgtgcggccagtcagagcgttaggacgtaacttagctggtatcagcagaggcctggccaggcctccgagacctcctcattcgtttggccgtcctttaacgacggggcccaggtcggaactcccagccgtaggttcaggcggacgtaggttcggggtctggggtacctttcggttaccactcctcaccctatacaataacctgactatctgactactttgtcttagtttatttctgtcagtcagtcgtagggaacgtacgttcggtcccgtttcgtacgtttcggggacggtaacggggaccgtaaggggtccgtaccgtacgaaaaccggtcgttgggtcggcgtggcccttacgttacttccgttgttcttcctacttcctttcctcgttcctaacg

SEQ ID NO: 301576 - DNA, 632 bp, Homo sapiens
  misc_feature: GZ8MTXP01C1B44.8.28.C06.1.454.CMB.2.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (391)..(391): a, c, t, g, unknown or other
  misc_feature (391)..(391): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctccagagatcattggagaagtggtgatgacacagtctccggtcaccctgtcttgttttccgngggganagacgcccacccctctgtgcggccagtcagagcgttaaggactaacttagctggtatcagcaggaggcctggccaggcctcccagacctcctcattcttcggccgtacctttaacgagggcccaaggtggaaactcccgagccaggttcaggcggcaggtcggtcgtggtacttcgtcaacttctcacanactaactactgacaatctagtactacttgacttagtttattctgtcagctagtcgtagaaggtcgtaggttccttcgtacggtttccgggacgggaacgggtaaaccgtaagggtccgtaacccgtaaacgaaaccggtaacgtggttacgggcttccggtacctaaccgttacttccggttcgttccctttacgtaaccctttccccggttaccccgttacctaacgttccgtaaccggg

SEQ ID NO: 301577 - DNA, 820 bp, Homo sapiens
  misc_feature: GZ8MTXP01BNQJH.8.28.C06.1.454.CMB.2.raw
  modified_base (194)..(194): a, c, t, g, unknown or other
  misc_feature (194)..(194): n is a, c, g, or t
  modified_base (200)..(200): a, c, t, g, unknown or other
  misc_feature (200)..(200): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctccagagatcattggagaagtggtgatgacacagtctccggtcacctgtcttgttttccngggganagacgccacctctcctgtgcgcagtcagagcgttagacaacttagcctggtatcagcagacggcctggccaggcctcccgagacctcctactattcgtttcgggccgtaccctttaaacgacgggggtaccctaaggttacgggtaaacttcccccgaaggtccccgtaagggtttccgaacggccggggacgtaaggggttccgggggttacgtcggggggtaaccttttccgggttacccaccttcctacccaaaccctatacctaaaacttaaccccgtgaacctaacttaccgtacggtaaccgttacgttttacggtactttaaacggtttttacttttcgtacggttaccaggtaccttaaggtttaccgtacgggggtaaaacggttcccggtttacgggttaccccggtttaccgtacccgggttttaccgggggaaccgggggtaaaccgggggtaaacccgtaacgggggttaacccggtaaaccccgttaaaccggtaaaaccggtaaccgtttgggaaccgggttcgtaccggacccttaacccggttacttacccgttcgtttcccttaacgtacccttcccctttccccggaaccttaacgttccg

SEQ ID NO: 301578 - DNA, 588 bp, Homo sapiens
  misc_feature: GZ8MTXP01AMNAK.8.28.C06.1.454.CMB.2.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (440)..(440): a, c, t, g, unknown or other
  misc_feature (440)..(440): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacgaacttagcctggtatcagcagaggcctggccaggctcccagactcctcattctttggccgtcctttaacgacggggccagtcggaactcccgagccaggttcagcggcaggtcgggtctggggtacttcgttcactctcacctatacaatacctgacaatctgacgtactttgctagtttattctgtcagctagtcnggaacgcgtcggccgtttcacgtttccgggcgggtaacgggaccgaagggttcggaacccttacgaaaccggtaaacgttgggtcggcgttcggccaccgttacttctcgtcctttaaccacttcccgttaccccgcttaacgttccg

SEQ ID NO: 301579 - DNA, 570 bp, Homo sapiens
  misc_feature: GZ8MTXP01C35PW.8.28.C06.1.454.CMB.2.raw
  modified_base (197)..(197): a, c, t, g, unknown or other
  misc_feature (197)..(197): n is a, c, g, or t
  modified_base (290)..(290): a, c, t, g, unknown or other
  misc_feature (290)..(290): n is a, c, g, or t
  modified_base (312)..(312): a, c, t, g, unknown or other
  misc_feature (312)..(312): n is a, c, g, or t
  modified_base (541)..(541): a, c, t, g, unknown or other
  misc_feature (541)..(541): n is a, c, g, or t
  modified_base (560)..(560): a, c, t, g, unknown or other
  misc_feature (560)..(560): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattgggagaagtggtgatgacacagtctccggtcaccctgtcttgtttttccnggggagagagccaccctctcctgtgcggccagtcagagcgttaggacaacttagcctggtatcagcagaggcctggccaggctccagactccncatctttggccgtcctttaacnggccagtggaactcccagccaggttcaggcgctaggtgggtctggggtacttcgtcactctaccacaatacaaataacctgacaatctaggacctatttgactagttttattctgtcagcagtctaggaacgtcgtggtccgttctacgttcgggacgggtaacgggacctaaggggtcggaacctacggaaaaccgtagttggtcggctgccttaccgttattccgtntaccttcatcccgttcccncttaattccg

SEQ ID NO: 301580 - DNA, 633 bp, Homo sapiens
  misc_feature: GZ8MTXP01EUCNY.8.28.C06.1.454.CMB.2.raw
  modified_base (197)..(197): a, c, t, g, unknown or other
  misc_feature (197)..(197): n is a, c, g, or t
  modified_base (294)..(294): a, c, t, g, unknown or other
  misc_feature (294)..(294): n is a, c, g, or t
  modified_base (394)..(394): a, c, t, g, unknown or other
  misc_feature (394)..(394): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgnggggagagagcccaccctctcctgtgcggccagtcagagcgttaggacgtaacttagcctggtatcagcagaggcctggccaggctccagactcctnatctttggcctacctttaacgagggccaagtggaactccccagccgtaggttcaggcggcaggtgggtctgggtacttcgtcactctcacatcaataccnacatctagacgtacttgacttagtttattctgtcagctagttctagggaacgtacgtcggtccgtttacgtaccggtttcggggacgggtaacggggaacccgtaaagggggtccggtaaacccgtaacggaaaaaccggtaacgttgggtacgggttcctacgggacccttaaccgttactttccgttaaggttcctttaacctacgtttcccggttaccccgtccttaacgttcccg

SEQ ID NO: 301581 - DNA, 521 bp, Homo sapiens
  misc_feature: GZ8MTXP01BRACN.8.28.C06.1.454.CMB.2.raw
  modified_base (197)..(197): a, c, t, g, unknown or other
  misc_feature (197)..(197): n is a, c, g, or t
  modified_base (233)..(233): a, c, t, g, unknown or other
  misc_feature (233)..(233): n is a, c, g, or t
  modified_base (252)..(252): a, c, t, g, unknown or other
  misc_feature (252)..(252): n is a, c, g, or t
  modified_base (259)..(259): a, c, t, g, unknown or other
  misc_feature (259)..(259): n is a, c, g, or t
  modified_base (262)..(262): a, c, t, g, unknown or other
  misc_feature (262)..(262): n is a, c, g, or t
  modified_base (277)..(277): a, c, t, g, unknown or other
  misc_feature (277)..(277): n is a, c, g, or t
  modified_base (495)..(495): a, c, t, g, unknown or other
  misc_feature (495)..(495): n is a, c, g, or t
  modified_base (500)..(500): a, c, t, g, unknown or other
  misc_feature (500)..(500): n is a, c, g, or t
  modified_base (514)..(514): a, c, t, g, unknown or other
  misc_feature (514)..(514): n is a, c, g, or t
  modified_base (518)..(518): a, c, t, g, unknown or other
  misc_feature (518)..(518): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgnggggagagagccaccctctcctgtgcggcagtcagngcgtagacgatagctggancagcagngcnggcagctccagctcnatcttggcgtccttaacgacgggccaggtcggaactcccagccgaggttcaggcggcaggtggggtctagggtacttcgtcactctcaccatacaatactgactatctgacgtacttgcttagttttattctgtcagctagtctaggaagtctcggtcgttcacgttcggagggacggaccaaggtcgacctacgaaacgattggtcgctgcacgttnttctntctctctccttccncttntcg

SEQ ID NO: 301582 - DNA, 633 bp, Homo sapiens
  misc_feature: GZ8MTXP01A991M.8.28.C06.1.454.CMB.2.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (290)..(290): a, c, t, g, unknown or other
  misc_feature (290)..(290): n is a, c, g, or t
  modified_base (312)..(312): a, c, t, g, unknown or other
  misc_feature (312)..(312): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacgaacttagcctggtatcagcagaggcctggccaggctcccagactccncatctttggcgtcctttaacgngggccagtggaatccccagccaggttcaggcggcaggtgggtctggggtaccttcggttcactctacaccctataccaattaaccctgaccaattctagtacgttactttgcttagtttattctgtcagtcagttcagggaactcgttcggtcccgttcgtacgtttccggggacgggtacggtaaccgtaagggtaccgacccgttaacggaaaacccggtaagttcgggtacggccttcgggacccttaaccgttcgttccgttaacgttccttcccgtaacctttccccggttcccccgtaaccgttaacttcccggg

SEQ ID NO: 301583 - DNA, 574 bp, Homo sapiens
  misc_feature: GZ8MTXP01DFQ1Z.8.28.C06.1.454.CMB.2.raw
  modified_base (194)..(194): a, c, t, g, unknown or other
  misc_feature (194)..(194): n is a, c, g, or t
  modified_base (545)..(545): a, c, t, g, unknown or other
  misc_feature (545)..(545): n is a, c, g, or t
  modified_base (567)..(567): a, c, t, g, unknown or other
  misc_feature (567)..(567): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgttttccnggggagagagccaccctctcctgtgcggccagtcagagcgttaggacgaacttagcctggtatcagcagaggcctggccaggcctccagactcctcatctttggcgtcctttaacgaggggccaggtggaactcccagccaggttcaggcgcaggtgggtctgggacttcgtacactctacaccatacaaataacctgaccaatctagacgtactttgctagtttattctgtcagtcagtctagggaacgtacgttcggtacccggttctaccggtttcggggacgggtaaacggggaccctaaaggggttcggaacctacgaaaacgtacgttggtggctcgcaccgttnttctgtcttcatccgttccccncttgtcg

SEQ ID NO: 301584 - DNA, 531 bp, Homo sapiens
  misc_feature: GZ8MTXP01ASFQ1.8.28.C06.1.454.CMB.2.raw
  modified_base (206)..(206): a, c, t, g, unknown or other
  misc_feature (206)..(206): n is a, c, g, or t
  modified_base (212)..(212): a, c, t, g, unknown or other
  misc_feature (212)..(212): n is a, c, g, or t
  modified_base (507)..(507): a, c, t, g, unknown or other
  misc_feature (507)..(507): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacaacttagcctggtatcagcagaggcctggccaggcctcccagactcctcatctttggcgtcctttaacagggccagtggaatcccagccaggttcagcggcagtgggtctgggacttcgtcactctcacatcaataacctgacaatctagacgtactttgactagtttattctgttcagcagtctgaagctggtaccgttctacgtttcggcgggtagggaaccaagggttgggaccttcgaaacgaacttggngctgcaacatcttcgtcttctaac

SEQ ID NO: 301585 - DNA, 799 bp, Homo sapiens
  misc_feature: GZ8MTXP01EBUSO.8.28.C06.1.454.CMB.2.raw
  modified_base (197)..(197): a, c, t, g, unknown or other
  misc_feature (197)..(197): n is a, c, g, or t
  modified_base (203)..(203): a, c, t, g, unknown or other
  misc_feature (203)..(203): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctcccagagatcattggagaagtggtgatgacacagtctccggtcaccctgtcttgtttttccngggganagagcccaccctctcctgtgcggccagtcagagtcgttaggactaacttagcctggtatcagcagagcctggccaggcctccagacctcctcattcgtttggccgtacctttaaacgacggggtacccaaggttcgggaaacttcccccgaaggtccccgtaagggtttccgaacgggccgggaccgtaacggggttcgggggttcttacggggggtaaccttttccggttaacccaacctttcctacccaaacccctaattaccctaaaaacgttaaacccctggaacctaaacgtttcctacggtaaccgttaaccttttggtacctttaaacggttttttattttcctggttaccaaggcctaaggttccttaaggggaaacgtacgttcgggtccccgtttacgtaaccggtttccggggacggggtaaacggggaacccgtaaagggggttccggaaaccccttaacggaaaaacccggtaacgtttgggaacgggttaccttcggtacccaaacccttggtttacccttaaggttccctttaaccgttaacgtttcccctttaacccccggccgttaactttaacccggg

SEQ ID NO: 301586 - DNA, 656 bp, Homo sapiens
  misc_feature: GZ8MTXP01DKXQ3.8.28.C06.1.454.CMB.2.raw
  modified_base (196)..(196): a, c, t, g, unknown or other
  misc_feature (196)..(196): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccnggggagagagccaccctctcctgtgcggcagtcagagcgttaggacgaacttagcctggtatcagcagaggctggccaggctcccagactcctcattctttggccgtccctttaaagcggggccaggtcggaactccccgagcccgtaggttcaggcggcaggtgggtctgggtacttcgtacactctcaccatacaactaacctgacaatctagacgtactttgtactagttttatttctagtcagtcagttcctagggtaacgtacgttcgggtacccgttcgtaaccgtttcggggacggggtaaacggggtacccgtaaaggggtccgggtaaaccctacggtaaaaaccggtaacgtttcgggtcggttacgttcggacccttaaccgttattcccgtttgttacccttttaacctaacctttcccgtttaccccccggccttaacgtttcccgg

SEQ ID NO: 301587 - DNA, 641 bp, Homo sapiens
  misc_feature: GZ8MTXP01CXII7.8.28.C06.1.454.CMB.2.raw
  modified_base (194)..(194): a, c, t, g, unknown or other
  misc_feature (194)..(194): n is a, c, g, or t
  modified_base (289)..(289): a, c, t, g, unknown or other
  misc_feature (289)..(289): n is a, c, g, or t
  modified_base (310)..(310): a, c, t, g, unknown or other
  misc_feature (310)..(310): n is a, c, g, or t
  modified_base (425)..(425): a, c, t, g, unknown or other
  misc_feature (425)..(425): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgttttccnggggagagagccaccctctcctgtgcggccagtcagagcgttaggacgaacttagcctggtatcagcagaggcctggccaggctcccagactccncatctttggctcctttaacgngggccaggtggactcccagccaggttcagcggcaggtgggtctgggtacttcggtcactctcaccatacaaataacctgactaatctagacgtactttgactagttttactttcngttacagctaagtctaggggaacgtacgttcgggtcccgtttcgtaccggttttcggggacgggtaacgggggaacccgtaaacggggtacggaaccccgttaacgaaaaccggtaaaccggttgggtcgggttccgtacggccttaaacccgttcgttaccgttcgttcccttaaccttaccgttccccgttaccccgtaaccgttaacgttccg

SEQ ID NO: 301588 - DNA, 723 bp, Homo sapiens
  misc_feature: GZ8MTXP01CE06F.8.28.C06.1.454.CMB.2.raw
  modified_base (198)..(198): a, c, t, g, unknown or other
  misc_feature (198)..(198): n is a, c, g, or t
  modified_base (204)..(204): a, c, t, g, unknown or other
  misc_feature (204)..(204): n is a, c, g, or t
  modified_base (675)..(675): a, c, t, g, unknown or other
  misc_feature (675)..(675): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctccagagatcattggagaagtggtgatgacacagtctccggtcaccctgttcttgtttttccgngggganagacgcccaccctctcctgtgcggccagtcagagcgttaggacgtaacttagctggtatcagcagacggcctggccaggcctcccagacctcctctattcgtttcggccgtaccctttaacgacggggtacccaaggtacggaactccccgaggtccgtaagggttccaagggccgggtcgtaacggggttcgggggttcgtagggggtacccttttccggttaaccaacccgttccttacccaaaccctaacttaccaaaacttaaaccccgtgaacctaaacttctacggtaaccgttactttcgtacttaagtttttactttcgtaggtcacgtactagttacgtaggggaaacggtccgttcgggtcccgtttacgtaaccggtttcggggacgggtaacgggaaccgtaaaggggtccgtaacctaacgaaaacggtacgttgggtacgcgttacgaccaacgttnttccgttgttccctttctacttcccctttacccggccttaacgttccg

SEQ ID NO: 301589 - DNA, 605 bp, Homo sapiens
  misc_feature: GZ8MTXP01A6J0W.8.28.C06.1.454.CMB.2.raw
  modified_base (206)..(206): a, c, t, g, unknown or other
  misc_feature (206)..(206): n is a, c, g, or t
  modified_base (212)..(212): a, c, t, g, unknown or other
  misc_feature (212)..(212): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccacctctcctgtgcggccagtcagagcgttaggacaacttagcctggtatcagcagaggcctggccaggcctcccagacctcctcattctttcggcgccttttaacgagggcccagtggaactcccagccaggttcaggcggcaggtgggtctgggacttcgtcactctacacatcaatacctgacaatctagacgtactttgacttagtttactttctagtcacgtctacgttcttacgaaagcgttcggtcccgtttctaaccggttttcgggaccgggtaggggaacccgtaaaggggttccggaaacccgttacgaaaacggtaaccttgggttcggttaccgtcggacccaacctagtccgttgttccgtttccgttaacccg

SEQ ID NO: 301590 - DNA, 847 bp, Homo sapiens
  misc_feature: GZ8MTXP01DF3J2.8.28.C06.1.454.CMB.2.raw
  modified_base (198)..(198): a, c, t, g, unknown or other
  misc_feature (198)..(198): n is a, c, g, or t
  modified_base (263)..(263): a, c, t, g, unknown or other
  misc_feature (263)..(263): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgnggggagagacgccaccctctcctgtgcggccagtcagagcgttaggacgtaacttagcctggtancagcaggacggcctggccaggcctcccagacctcctctattcgtttcgggcctaccctttaaacggacggggtccctaaggtacgggaaaccttccccgaaggcccgtagggttcaacgggccgggacgtacgggttcgggggttcgttacggggggttacccttttccgggttaaccctacctttcccgtaccctaaaccctaaacgttaaccgtaaaaccttaacccgtggaaccctaaactttccgtaacggtaaccggttaccgttttacggtacctttaaaggttttttacttttccgttacgttaccgtaacgtactaacgggttaccgtaagggggtaaaaccggttaccggttacgggttaccccggtttaccgttaaccgggttttccgggggaaccgggggtaaaccgggggtaacccggtaaagggggttaccgggtaaaccccgttaaaccggtaaaaaccggtaacggttcggggtacgggttaccgttacggacccttaaaccgttcttaccgttcggttacctttcctaacccgtttcccgttaccccgtaaccttaacgtttaaccgg

SEQ ID NO: 301591 - DNA, 663 bp, Homo sapiens
  misc_feature: GZ8MTXP01B93UN.8.28.C06.1.454.CMB.2.raw
  modified_base (192)..(192): a, c, t, g, unknown or other
  misc_feature (192)..(192): n is a, c, g, or t
  modified_base (213)..(213): a, c, t, g, unknown or other
  misc_feature (213)..(213): n is a, c, g, or t
  modified_base (317)..(317): a, c, t, g, unknown or other
  misc_feature (317)..(317): n is a, c, g, or t
  modified_base (437)..(437): a, c, t, g, unknown or other
  misc_feature (437)..(437): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctccagagatcattggagaagtggtgatgacacagtctccggtcacctgtctgttttccngggagagagccacctctctgngcggccagtcagagtcgttaggacgaattagctaggtatcagcaggacggcctggccaggcctacccagacctccgtcattcgtttggacctacctttaaacgnggggtaccagtacgggaacctcccgaaggtcccgtaggttcacgggcgggacgtacggtgggggtactgggggtcctttccggtaacaccttcctacaacctataccaaattaacccctnactaactcgtacgtacgttacttagtacttagttttacttcgtacgtactagtctagtacgtaacgggaacgtcgtcggtccgttacgtccggttaccgggaacgggtacgggtaaccgtaacgggtaccgtaaccgtaaccgtaaaacggtacgttcggacgttccgtacgtaccttacgttcttccgttcgtacttcctactcccgttacccgtcgttaactcg

SEQ ID NO: 301592 - DNA, 599 bp, Homo sapiens
  misc_feature: GZ8MTXP01EF7ET.8.28.C06.1.454.CMB.2.raw
  modified_base (206)..(206): a, c, t, g, unknown or other
  misc_feature (206)..(206): n is a, c, g, or t
  modified_base (212)..(212): a, c, t, g, unknown or other
  misc_feature (212)..(212): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtctgtttttccngggganagagcccaccctctcctgtgcggccagtcagagcgttaggacgaacttagcctggtatcagcagaggcctggccaggctccccagacctcctcattctttggccgtaccttttaaacgagggggcccaggtcggaaactcccaagccctaaggttcaggcggcaggtgggtctggggactttcgtcactctcactatcaatacctgacaatctagacgtattgacttagtttattctgtcagtctagtctaggaacgtacgttcggtcccgtttcgtaccggtttcgggacgggaacggggtaacccgtaaagggttcggtaaacccttacgaaaaccggtaaccttgggttggccttgacaacctatcgttcgttccttcgtaacc

SEQ ID NO: 301593 - DNA, 670 bp, Homo sapiens
  misc_feature: GZ8MTXP01EVNWC.8.28.C06.1.454.CMB.2.raw
  modified_base (197)..(197): a, c, t, g, unknown or other
  misc_feature (197)..(197): n is a, c, g, or t
  modified_base (203)..(203): a, c, t, g, unknown or other
  misc_feature (203)..(203): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctcccagagatcattggagaagtggtgatgacacagtctccggtcaccctgtcttgtttttccngggganagagcccaccctctcctgtgcggccagtcagagcgttaggacgtaacttagcctggtatcagcagaggcctggccaggcctccagacctcctctattctttggccgtacctttaaacgacggggccaaggtcggaaactccccgaagtcccgtagggtttccaaggccggactagggttcggggtacgtggggtacctttccggttaccaactcctacaacctatactaaactaaccctgactaatctagacgtactttgacttaagttttatttcgtgtacagctaagtctagggtaagtacgttcggtaccgttcgtaaccggtttcggggacgggaaacggggtaaccgtaaaggggttacggaacccttaacggaaaaccgtaacgttgggtcgggttctacggacccaccgttattccttcgttcttccgtaacctttcccttccccgtccttaacgttccg

SEQ ID NO: 301594 - DNA, 627 bp, Homo sapiens
  misc_feature: GZ8MTXP01C7H29.8.28.C06.1.454.CMB.2.raw
  modified_base (196)..(196): a, c, t, g, unknown or other
  misc_feature (196)..(196): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccnggggagagagccaccctctcctgtgcggccagtcagagcgttaggacgaacttagcctggtatcagcagaggcctggccaggctcccagactcctcatctttggcgtcctttaacgagggccagtggaactcccagccaggttcagcgcagtggtctggacttcgtcactctcacatacaataactgacaatctgacgtactttgctagtttatttctgtcagtcagtctagggaacgtacgttcggtccgttctaaccgtttcggggacggtaacggggaaccgtaaacggggttacggaaccccgttaacgaaaaccgggtaaaccgttaggggttcgggacctttacgggaccttaaaccccgttagttcctttcggttacctttcctaaccggtttccctttacccccggtcccttaacgtttcccg

SEQ ID NO: 301595 - DNA, 689 bp, Homo sapiens
  misc_feature: GZ8MTXP01DIE0G.8.28.C06.1.454.CMB.2.raw
  modified_base (208)..(208): a, c, t, g, unknown or other
  misc_feature (208)..(208): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtcttgtttttccgnggggagagagcccaccctctcctgtgcggcagtcagagcgttaggacgaacttagcctggtatcagcagaggcctggccaggcctcccacgacctccgtctacttccgttttggccgtacctttaacgacggggtccaggttacggaaccttccccaggtcccgtacgggttccaggcgggcaggggttcggggtcgtggggtactttcggttccactcctcaacctatacaaactacctgactaatcgtagacgttactttagacttagttttactttacgttcggtactagtccgtaagttccgtaggtaaacgttaccggttcggttaccccgtttacgttaccggttttacgggggaccggggtaaccgggggtaaaccctaaagggggttaccggaaacccgttaacgtaaaaccggtacgttacgggttgggttacctcgacctaacctacttcgttcgttcccgtttcttcccg

SEQ ID NO: 301596 - DNA, 592 bp, Homo sapiens
  misc_feature: GZ8MTXP01ACSU1.8.28.C06.1.454.CMB.2.raw
  modified_base (205)..(205): a, c, t, g, unknown or other
  misc_feature (205)..(205): n is a, c, g, or t
  modified_base (211)..(211): a, c, t, g, unknown or other
  misc_feature (211)..(211): n is a, c, g, or t
  modified_base (416)..(416): a, c, t, g, unknown or other
  misc_feature (416)..(416): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtctgttttccngggganagagccacctctcctgtgcggccagtcagagcgttaggacgaacttagcctggtatcagcagaggcctggccaggcctcccagacctcctctattctttggccgtacctttaacgacgggccaggtacggaactccccagcccgtaggttcaggcggcaggtggggtctggggtacctttcgtcactctcaccatacaactaccngacaattctagacgtactttgacttagtttattctgtcgtagctgtcgtagagtacgtggtcccgttctacgttccgggacggtaacgggaaccgtaagggttcggaccgttacgaaaaccggtaacgttcggcggttctcgcctaaccgtacttccttcgttccgttcgtaaccc

SEQ ID NO: 301597 - DNA, 613 bp, Homo sapiens
  misc_feature: GZ8MTXP01CLFOY.8.28.C06.1.454.CMB.2.raw
  modified_base (198)..(198): a, c, t, g, unknown or other
  misc_feature (198)..(198): n is a, c, g, or t
  modified_base (575)..(575): a, c, t, g, unknown or other
  misc_feature (575)..(575): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgttcttgtttttccgnggggagagacgccaccctctcctgtgcggccagtcagagtcgttaggacgtaacttagcctggtatcagcaggacggcctggccaggcctcccagacctcctcattcgtttggccgtacctttaaacgacgggccaaggtcggaactcccgagccgtaggttcaggcggcgaggtgggtcgtgggtacttcgtcactctacactatacaaatacctgactaactctagtacgtacttgtacttagttttacttctcgtacagcgtacgtcgtagggaacgtacgttcggtccgttacgtaccggttcggggacggtaacgggacgtaagggtaccgtaaccgtaacgaaacgtacgttggtcgcgtcgacttacttnttcttaagtccttctactccttcccgtcttcgtaaccg

SEQ ID NO: 301598 - DNA, 661 bp, Homo sapiens
  misc_feature: GZ8MTXP01DNPB7.8.28.C06.1.454.CMB.2.raw
  modified_base (208)..(208): a, c, t, g, unknown or other
  misc_feature (208)..(208): n is a, c, g, or t
  modified_base (214)..(214): a, c, t, g, unknown or other
  misc_feature (214)..(214): n is a, c, g, or t
  modified_base (435)..(435): a, c, t, g, unknown or other
  misc_feature (435)..(435): n is a, c, g, or t
tcagctcgcgtgtccacgaccggtgctcgatttagagctcacgtattgggtttgggggagagctctgggggaggaactgctcagttaggacccagacggaaccatggaagccccagcgcagcttctcttcctcctgctactctggctcccagagatcattggagaagtggtgatgacacagtctccggtcacctgtcttgtttttccngggganagagccacctctcctgtgcgcagtcagagcgttaggacgtaacttagcctggtatcagcagaggcctggccaggcctccagacctcctcattctttggctacctttaacgacgggtccaggtacggaaactccccgaggccctagggttccagggcggctagggtcggggtcgtggggtactttcgttaccactcctacaacctataccaaattaaacccngactaacttcgtacgtaacgttactttacgactttagttttactttcgttagtcgaacgtcgtaagttcgtaagtaacgtaccgttccggttaccccgtttacgtaccggtttccggggaaccgggaacgggtaaccggtaagggttaccggaaaccgttaaaccgtaaaacgtacgttcggttcgccgtcacccgtaacctcgttccttacgttccttccgtaac

SEQ ID NO: 301599 - DNA, 550 bp, Homo sapiens
  misc_feature: GZ8MTXP01B8XPX.8.28.C06.1.454.CMB.2.raw
  modified_base (205)..(205): a, c, t, g, unknown or other
  misc_feature (205)..(205): n is a, c, g, or t
  modified_base (211)..(211): a, c, t, g, unknown or other
  misc_feature (211)..(211): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtctgttttccngggganagagccacctctcctgtgcggccagtcagagcgttaggacgaacttagcctggtatcagcagaggcctggccaggcctcccagacctcctcatctttggcgtcctttaacgagggccagtcggaatcccagccgaggttcagcggcaggtgggtctgggacttcgtcactctcacatcaaataacctgacaatctagactactttgctagtttattctagtcagctagtctgaagctggccgttctacgtttcgggcggtagggaaccgtaagggttcggaccttacgaaaacggtacttaggttcggactgaccaacactcgttcgtccttcgtaacc

SEQ ID NO: 301600 - DNA, 610 bp, Homo sapiens
  misc_feature: GZ8MTXP01BK3MI.8.28.C06.1.454.CMB.2.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctgggtatcagcagaggcctggccaggctccagactcctcattctttggcgtcctttaacgacgggccaggtggaactcccagccaggttcagcggcagtgggtctgggtacttcgtcactctcacctatcaaataacctgacaatctagtacgtactttgactagttttatttctgtcagtcaagttctagggaacgtacgttcggtccgtttctaccgtttcgggacggtaacggggaccctaaaggggtcggtaacccttacgaaaaccgaacgttgggtacggcgttacggaccttaccgttattccgttcggttacctttctacttcccgttaccccggtcccttaagttcccg

SEQ ID NO: 301601 - DNA, 693 bp, Homo sapiens
  misc_feature: GZ8MTXP01DC5G9.8.28.C06.1.454.CMB.2.raw
  modified_base (207)..(207): a, c, t, g, unknown or other
  misc_feature (207)..(207): n is a, c, g, or t
  modified_base (213)..(213): a, c, t, g, unknown or other
  misc_feature (213)..(213): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtcttgtttttccngggganagagcccaccctctcctgtgcggccagtcagagcgttaggacgaacttagcctggtatcaagcagcgctggaccaggcctaccagtacctcccgtactacttccgttttcgggccttacccgtttaaacggcgggggtacccaggtacggtaacctcccgacgtcccgtaagggttccacgggcggtacgacggggtttcggggttcgtcgggggtaccttttccggttaccacctcctacacctatacctaaactacctgactatcgtagacgttacttgacttagtttacttcgtgtactagtacgtagtcgttagaacgtacgttcgggtaccgtttacgttacgtttccggggacggggtaacgggaaccgtaacgggttaccggtaacccgttaaacgtaaaacccggtacgttacggttcgggttacctcggacctaacccgttactccgtttacgtttccttccgttaacccg

SEQ ID NO: 301602 - DNA, 775 bp, Homo sapiens
  misc_feature: GZ8MTXP01C1F2C.8.28.C06.1.454.CMB.2.raw
  modified_base (199)..(199): a, c, t, g, unknown or other
  misc_feature (199)..(199): n is a, c, g, or t
  modified_base (205)..(205): a, c, t, g, unknown or other
  misc_feature (205)..(205): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattgggagaagtggtgatgacacagtctccggtcacccttgtcttgtttttccgngggganagacgcccacctctcctgtgcggcagtcagagtcgttaggacgtaacttagctggtatcgagcagacggcctggccaggcctcccaagacctcctacgtattcgtttacgggccgttaccctttaaacggacggggtacctaagggttacgggaaacctttcccccgaaggcccgtagggtttaccgaacgggtcgggaccgtaaggggttcgggggttcgttcgggggtacccttttcggttaccctaacttcctaccaaacctacttaacctaaactaacctgtacctaaacttcgtacggtaacgttacgttttgtaccgtttaaggtttttactttcgttacgtacgtacgtctaagttccgttaaggggaaacggtccggttcgggttacccggtttacgtaccgggtttccggggacggggtaaacgggtaaccgtaagggggtaccgttttaacccgaacggtaaaacggtacgttcgggtacgcgttacggacccttaaccgttacttccgttaacgtttaccttccgtaccttcccgttaccccgaaccttcgttaaccgg

SEQ ID NO: 301603 - DNA, 558 bp, Homo sapiens
  misc_feature: GZ8MTXP01BPC08.8.28.C06.1.454.CMB.2.raw
  modified_base (206)..(206): a, c, t, g, unknown or other
  misc_feature (206)..(206): n is a, c, g, or t
  modified_base (212)..(212): a, c, t, g, unknown or other
  misc_feature (212)..(212): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtcttgttttccngggganagagccaccctctcctgtgcgccagtcagagcgttaggacgaactgcctggtatcagcagaggcctggccaggcctccagacctcctcattctttggccgtcctttaacgagggccaggtggaactccccgagcctaggttcaggccggcaggtcgggtctggggtacctttcggtcactctcacctatcaataacctgactaatctagacgtacttgacttagtttattctgtctagctagtctagaagctggtccttcgtacgtttcggcggagggaaccgaagggttcggaccttagaaacgaacttggttgctaacgcaacctagtcttcgtccttgtaacc

SEQ ID NO: 301604 - DNA, 597 bp, Homo sapiens
  misc_feature: GZ8MTXP01DRVM8.8.28.C06.1.454.CMB.2.raw
  modified_base (196)..(196): a, c, t, g, unknown or other
  misc_feature (196)..(196): n is a, c, g, or t
  modified_base (425)..(425): a, c, t, g, unknown or other
  misc_feature (425)..(425): n is a, c, g, or t
  modified_base (549)..(549): a, c, t, g, unknown or other
  misc_feature (549)..(549): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccnggggagagagcccacctctcctgtgcgcagtcagagcgttaggacgaacttagcctggtatcagcagaggcctggccaggctccagactcctcattctttggcgtacctttaacgaggggccagtggaactccccagccaggttcaggcggcagtgggtcgtgggtacttcgtcactctcacctatacaactacctgactatctgactacttgcttagtttattctgtnagcagttctaggaagtacgtggtcccgttacgacgtttcggggacgggtaaacgggaccgtaaagggttacggaacctacgaaaacggtaacgttgggtcggacgttacggcccttaaccgttnttccgtaaggttccttctacttcccgtttccccgaaccttcttaaccg

SEQ ID NO: 301605 - DNA, 679 bp, Homo sapiens
  misc_feature: GZ8MTXP01DQJVC.8.28.C06.1.454.CMB.2.raw
  modified_base (197)..(197): a, c, t, g, unknown or other
  misc_feature (197)..(197): n is a, c, g, or t
  modified_base (429)..(429): a, c, t, g, unknown or other
  misc_feature (429)..(429): n is a, c, g, or t
  modified_base (436)..(436): a, c, t, g, unknown or other
  misc_feature (436)..(436): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctccagagatcattggagaagtggtgatgacacagtctccggtcaccctgttcttgtttttccgngggggagagagcccacctctcctgtgcggcagtcagagcgttaggacgaacttagcctggtatcgagcaggcggcctggccaggcctcccagacctcctcattctttggccgtacctttaacggcgggcctaggtcggaaactccccgaggccgtaggttccagggtcggacgtagggtgggtcgtggggtacctttcgtacactctacaccatacaactactgactattcngtacgtnttgtacttattttattctagtacagtctagtcgtaaggggaaagtcgttcggtcccgtttagtaaccgggtttcgggacggggtaaacgggtaccgtaaacggggtccgggtaaaccttaacggaaaaccggtacgttgggtaccggttacgttacggacccgttaaccgttctttccgggttaaccgtttaccgtttaaccttccggttcccctttaccccggaaccttaacgttaacccgg

SEQ ID NO: 301606 - DNA, 633 bp, Homo sapiens
  misc_feature: GZ8MTXP01DH4AT.8.28.C06.1.454.CMB.2.raw
  modified_base (195)..(195): a, c, t, g, unknown or other
  misc_feature (195)..(195): n is a, c, g, or t
  modified_base (381)..(381): a, c, t, g, unknown or other
  misc_feature (381)..(381): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgcggccagtcagagcgttaggacaacttagcctggtatcagcagaggcctggccaggctcccagctcctcatctttggcctcctttaacgaggggtcccaggtcggaatccccgaagccctaggttcaggcggcaggtgggtctggggtacttcgtcactcncaccatcaataacctgacaatctgacgtacttagctaagttttattctgtcagctagtcctagggaaacgtacgttacgggtcccgtttacgtaaccgttttccggggacggggtaaccggggtaacccgaaaggggttcgggaaacccttacgaaaaaccgtaaccgttggtcgggcctacggccttaacccttagttcccttggttcctttccgtactttcccttccccgtaacccgttaactttcccgg

SEQ ID NO: 301607 - DNA, 634 bp, Homo sapiens
  misc_feature: GZ8MTXP01BRE6Z.8.28.C06.1.454.CMB.2.raw
  modified_base (198)..(198): a, c, t, g, unknown or other
  misc_feature (198)..(198): n is a, c, g, or t
  modified_base (402)..(402): a, c, t, g, unknown or other
  misc_feature (402)..(402): n is a, c, g, or t
  modified_base (582)..(582): a, c, t, g, unknown or other
  misc_feature (582)..(582): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgttcttgtttttccgnggggagagagcccaccctctcctgtgcgccagtcagagcgttaggacgtaacttagcctggtatcagcagacggcctggccaggcctcccagacctcctctattcgtttggcctaccctttaagcgggccaggtcggactcccagccaggttcaggcgcgaggtgggtctgggtacttcgtcactctcaacctatacaataccngactatctagtacgtactttgacttagtttactttctgtacacgtctagtctagggaaacgtcgttaccggtccgtttacgtaccggtttcggggacgggtaacgggggtaacctaaggggtaccggtaacccttaacggaaaacgtaacgttgggtacgggttctacggaccaccgttnttaccgttcgtttcccttaactacttcccgttaccccgtccttaacgttccg

SEQ ID NO: 301608 - DNA, 612 bp, Homo sapiens
  misc_feature: GZ8MTXP01BDDXJ.8.28.C06.1.454.CMB.2.raw
  modified_base (196)..(196): a, c, t, g, unknown or other
  misc_feature (196)..(196): n is a, c, g, or t
  modified_base (320)..(320): a, c, t, g, unknown or other
  misc_feature (320)..(320): n is a, c, g, or t
  modified_base (394)..(394): a, c, t, g, unknown or other
  misc_feature (394)..(394): n is a, c, g, or t
  modified_base (408)..(408): a, c, t, g, unknown or other
  misc_feature (408)..(408): n is a, c, g, or t
  modified_base (571)..(571): a, c, t, g, unknown or other
  misc_feature (571)..(571): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccnggggagagagcccacctctcctgtgcggccagtcagagcgttaggacgtaacttagcctggtatcgagcagaggcctggccaggcctcccagacctcctcattctttcggcgtacctttaacgnggggaccaggtcggaactccccgagccgtaggttcaggcggctaggtcgggtctggggtacttcgttacactcncacatacaataccngacaatctagacgtactttgacttagtttactttctgtacagctagttctagggaacgtacgtcgggtccgttacgtaccggtttcggggacgggtaaacgggacccgtaaggggtacgaccctaacgaaaacgtaacgttggtacggctacggccaccgttnttccgttgttccttctacttcccgttcccgcttaacttccg

SEQ ID NO: 301609 - DNA, 525 bp, Homo sapiens
  misc_feature: GZ8MTXP01D6MMI.8.28.C06.1.454.CMB.2.raw
  modified_base (195)..(195): a, c, t, g, unknown or other
  misc_feature (195)..(195): n is a, c, g, or t
  modified_base (220)..(220): a, c, t, g, unknown or other
  misc_feature (220)..(220): n is a, c, g, or t
  modified_base (232)..(232): a, c, t, g, unknown or other
  misc_feature (232)..(232): n is a, c, g, or t
  modified_base (250)..(250): a, c, t, g, unknown or other
  misc_feature (250)..(250): n is a, c, g, or t
  modified_base (257)..(257): a, c, t, g, unknown or other
  misc_feature (257)..(257): n is a, c, g, or t
  modified_base (262)..(262): a, c, t, g, unknown or other
  misc_feature (262)..(262): n is a, c, g, or t
  modified_base (271)..(271): a, c, t, g, unknown or other
  misc_feature (271)..(271): n is a, c, g, or t
  modified_base (275)..(275): a, c, t, g, unknown or other
  misc_feature (275)..(275): n is a, c, g, or t
  modified_base (290)..(290): a, c, t, g, unknown or other
  misc_feature (290)..(290): n is a, c, g, or t
  modified_base (314)..(314): a, c, t, g, unknown or other
  misc_feature (314)..(314): n is a, c, g, or t
  modified_base (322)..(322): a, c, t, g, unknown or other
  misc_feature (322)..(322): n is a, c, g, or t
  modified_base (340)..(340): a, c, t, g, unknown or other
  misc_feature (340)..(340): n is a, c, g, or t
  modified_base (353)..(353): a, c, t, g, unknown or other
  misc_feature (353)..(353): n is a, c, g, or t
  modified_base (361)..(361): a, c, t, g, unknown or other
  misc_feature (361)..(361): n is a, c, g, or t
  modified_base (369)..(369): a, c, t, g, unknown or other
  misc_feature (369)..(369): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggggagagagccaccctctcctgngcggcagtcagngcgtagacgactgctgancagcagnggccngcagctcanctcnatcttgctacttagnggcagtgactccagcagtcagcgngagtggtntggtacttcgtacactcncacatacaatacnacatctanactacttntatatttattctgtacagctacgtacgtaggacgtacgtcgtcgttacgtacgttcggtacggacggacgtaacggtacgtacgacgaaacgtaacgttagtcgcgtcgtacacgttcttctcttcttaactacttccttccctaaccgttcgtcg

SEQ ID NO: 301610 - DNA, 574 bp, Homo sapiens
  misc_feature: GZ8MTXP01AZ3XE.8.28.C06.1.454.CMB.2.raw
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
  modified_base (291)..(291): a, c, t, g, unknown or other
  misc_feature (291)..(291): n is a, c, g, or t
  modified_base (313)..(313): a, c, t, g, unknown or other
  misc_feature (313)..(313): n is a, c, g, or t
  modified_base (396)..(396): a, c, t, g, unknown or other
  misc_feature (396)..(396): n is a, c, g, or t
tcagctcgcgtgtccacgaccggtgctcgatttagagctcacgtattgggtttgggggaggaactgctcagttaggacccagacggaaccatggaagccccagcgcaccttctcttcctcctgctactctggctcccagagatcattggagaagtggtgatgacacagtctccggtcaccctgtcttgtttttccngggganagagccaccctctcctgtgcggccagtcagagcgttaggacaacttagcctggtatcagcagaggcctggccaggctcccagactcctnatctttggccgtcctttaacgngggccaggtggaactcccagccgtaggtcaggcgcaggtcgggtctgggtacttcgtcaacctctcacctatacaaactaccngactaatctagacgtactttgctagttttattcgtgtcagcagtctagaaggtcgtggtccttacgtacgttcgggacggaacgggtaccgagggtccggacctacgaaacggtaactggttcggcttcgacacgttattcttacgtcttcaacttccctccgactaattccgtaagg

SEQ ID NO: 301611 - DNA, 593 bp, Homo sapiens
  misc_feature: GZ8MTXP01AVU9S.8.28.C06.1.454.CMB.2.raw
  modified_base (210)..(210): a, c, t, g, unknown or other
  misc_feature (210)..(210): n is a, c, g, or t
  modified_base (216)..(216): a, c, t, g, unknown or other
  misc_feature (216)..(216): n is a, c, g, or t
tcagctcgcgtgtccacgaccggtgctcgatttagagctcacgtattgggtttggggagagctctgggggaggaactgctcagttaggacccagacggaaccatggaagccccagcgcagcttctcttcctcctgctactctggctcccagagatcattggagaagtggtgatgacacagtcctccggtcaccctgtcttgtttttccgngggganagacgcccaccctctcctgtgcggccagtcagagcgttaggacgtaacttagcctggtatcagcagaggcctggccaggcctccagactcctcatcttggcgtacctttaacacgggccaggtcggaactcccagccacggttcaggcggcaggtgggtctgggacttcgtcactctcacatcaatacctgactaatctagacgtactttgccttaagttttacttcgtagttcgaagtctagtcctagtaaacgcctggtcccgtttactaccggtttcggacgggtaagggtaacccgtaagggttacgggaacccttacgaaaaccggtacgttaggttcggactcgacaaccatcgttctccttcgtaacccg

SEQ ID NO: 301612 - DNA, 665 bp, Homo sapiens
  misc_feature: GZ8MTXP01DGVCI.8.28.C06.1.454.CMB.2.raw
  modified_base (199)..(199): a, c, t, g, unknown or other
  misc_feature (199)..(199): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctcccagagatcattggagaagtggtgatgacacagtctccggtcaccctgttcttgtttttccgngggggagagacgccaccctctcctgtcgcggcagtcagagcgttaggactaacttgctggtatcagcgagacggcctggccaggcctccgagacctcctctacttcgtttggccgtaccgtttaacgacgggtaccaggtacggaactcccgagccgtaggttcgaggcggcgtagggttcgggtcgtggggtacctttcgtaccacttcacaacctatacaaactaccgtgactaatctagtacgttattgtactttaagtttttcttcgtacgtaccagtacgtacgttacgtacggggtaaacgttaccggttccggttacccgtttacgtaccgggtttcgggacggggtaacggggaaccgtaacggggtaccgtaacctaacggaaacgtacgttgggtcggactcgaccttacttcgttcgttcgttactctaccgttccgttccctaacttcgtaacg

SEQ ID NO: 301613 - DNA, 643 bp, Homo sapiens
  misc_feature: GZ8MTXP01ATAI8.8.28.C06.1.454.CMB.2.raw
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
  modified_base (601)..(601): a, c, t, g, unknown or other
  misc_feature (601)..(601): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccngggganagagcccaccctctcctgtgcggccagtcagagcgttaggacgaacttagcctggtatcagcaggacggcctggccaggcctcccagacctccctctattccgtttgggcccgttacctttaaacgacgggggccctaaggtcgggaaactccccgaagccgtaggttcaaggtcggcgaggggttggggtaccgtgggggtacctttccggttaccaccttctaccaaccctataccaaactaacctgactaactctcgacgttacttgacttaagtttactttctgtactacgctagttctagggaacgtacgtcgtaccgttctaccgttcgggacgggagggtacctaagggtcggtaaccacgaaacgtacgttggtcggcgtcgcttaccttnttaccgtcttccttctacttcccttacccgtccttaacgtcg

SEQ ID NO: 301614 - DNA, 867 bp, Homo sapiens
  misc_feature: GZ8MTXP01CCJMP.8.28.C06.1.454.CMB.2.raw
  modified_base (208)..(208): a, c, t, g, unknown or other
  misc_feature (208)..(208): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtcttgtttttccgnggggagagacgcccaccctctcctggtgcggccagtcagagtcgttaggacgaacttagcctggtatcagcaggaggcctggccaggcctacccagacctccgtcacttcgtttcggccgtacctttaacggacggggtccaaggtacggaaacttcccccgaggtacccgtacggtttaccgaaggccgggtacgtaaggggttcgggggttccgttcggggggtaccctttttacccgggttacctaacccgttccttaccccgtaaacctaactttaaacccaaaacgtttaaaccccttaggaacccttaaaacgttcccgttaacgggtaaacccggtttaaaccgttttcgggtaacctttaaacggttttttaacctttccgtttcggttaacccggtaagtacccgttaaaggttacccggttaaggtaaaacccggttccggttaccgggttccccggttttaacccggttaaacccgggttttaccggggggaaccggggtaaacgggggtaaaccccgggttaaacgggggttaccgggtaaaaccccgttaacgggttaaaaaacccgggtaacgttcggggttacgggttccttaacgggacccctaaccgtacttccgtttacgttaacccgtttccttaacccg

SEQ ID NO: 301615 - DNA, 607 bp, Homo sapiens
  misc_feature: GZ8MTXP01BG0HP.8.28.C06.1.454.CMB.2.raw
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
  modified_base (569)..(569): a, c, t, g, unknown or other
  misc_feature (569)..(569): n is a, c, g, or t
  modified_base (593)..(593): a, c, t, g, unknown or other
  misc_feature (593)..(593): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgttttccgngggganagagcccaccctctcctgtgcggccagtcagagcgttaggacgaacttagcctggtatcagcagacggctggccaggctcccagactcctcattcgtttggcctacctttaacgacggggaccaggtcggaaactccccgaggtaccgtaggttcaggcggactagggttgggtcgtggggtacctttcggtaccacttctacaccatacaactacctgacctaatctacgtacgtacttgattagtttattctgtcagtctagttcagggaacgtacgtcggtccgttacgtacgttcgggacggacgggtaaccgtaagggtacgtacctacgaaaacgtacgttggtcgcgtacgccaccgttnttcgtctttctcttacctttcccncctaattcgtaacg

SEQ ID NO: 301616 - DNA, 655 bp, Homo sapiens
  misc_feature: GZ8MTXP01BP746.8.28.C06.1.454.CMB.2.raw
  modified_base (199)..(199): a, c, t, g, unknown or other
  misc_feature (199)..(199): n is a, c, g, or t
  modified_base (206)..(206): a, c, t, g, unknown or other
  misc_feature (206)..(206): n is a, c, g, or t
  modified_base (608)..(608): a, c, t, g, unknown or other
  misc_feature (608)..(608): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctcccagagatcattggagaagtggtgatgacacagtctccggtcaccctgttcttgtttttccgnggggganagacgcccaccctctcctggtgccggccagtcagagtcgttaggacaacttgcctaggtatcagcaggacggcctggccaggcctcccagtacctcctctacttcgtttcggccgtacctttaacgacggggtccaaggtcggaactccccgagccgtaggttcaggcggcgtaggtcgggtcgtcgggtacctttcggtacaccttctacaacctatacctaaactaacctgactaatctacggtaacgtactttcgatttacgttttatttctgtcgagctaagtcgtaggggaacgtcgttccggtccgttaccgtaccggttccgggacgggaacgggtacgtaacgggttacgacctacgaaacggtacgttggtacggttcctgaccttaccgttnttccgtcgttccttaacgtaccttcccgttacccgccttaacgtccg

SEQ ID NO: 301617 - DNA, 746 bp, Homo sapiens
  misc_feature: GZ8MTXP01C9DDF.8.28.C06.1.454.CMB.2.raw
  modified_base (196)..(196): a, c, t, g, unknown or other
  misc_feature (196)..(196): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccnggggagagagcccaccctctcctgtgccggcagtcagagcgttaggacgtaacttagcctggtatcgagcaggaggcctggccaggctccagacctctacattctttgggcctaccgtttaaacgcgggggtaccgtaggtacgtacccgtacccgacgaccggtttagacgacggtcggacggttacgggttcgggttacggtacgggtttaccctttccggtaaccctaccttccacccgtaaaccttaactaaactaaccgtacgttcgaaactactcgtacggtacttagttaccgttatttaagtttttcttcgtacgtacgtcgtacgttacgtacggttaacgggtaacgttccggggttacgtttcccgttaaccgttacccggttacggggacgggtaaaccgggtaacggtacgggtaaccccgtaaccgtaaacgtaaacccggtgttacgggtccgttcgttaccgaccttaaaccgttcttcggtttaaccttctaacgttaccccttcccgttaccctaaccgttcgttaacccgg

SEQ ID NO: 301618 - DNA, 642 bp, Homo sapiens
  misc_feature: GZ8MTXP01B0K0Z.8.28.C06.1.454.CMB.2.raw
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
  modified_base (266)..(266): a, c, t, g, unknown or other
  misc_feature (266)..(266): n is a, c, g, or t
  modified_base (291)..(291): a, c, t, g, unknown or other
  misc_feature (291)..(291): n is a, c, g, or t
  modified_base (400)..(400): a, c, t, g, unknown or other
  misc_feature (400)..(400): n is a, c, g, or t
  modified_base (412)..(412): a, c, t, g, unknown or other
  misc_feature (412)..(412): n is a, c, g, or t
  modified_base (430)..(430): a, c, t, g, unknown or other
  misc_feature (430)..(430): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccngggganagagcccaccctctcctgtgcggcagtcagagtcgttaggacgtaattgcctggtatcagcagngctggccaggcctccagacctcctnattcttggcctcctttaagcgggccaggtaggactcccgagtccgaggttccgaggcggcgtaggtcgggtcgtggggtacctttcggtacactctcacatacaatacngacatctgactnttgcttagtttattcgtntcagtctagttaccagggaacgtacgttcggtacccgtttcgtaaccgtttcggggacgggtaacggggtaaccgtaaggggtccggtaacccgtaacggtaaaaccgtaacggttcggtacggggcctacggtacccttacccgttagttcccgttaagtttcccttaaccgttacctttccccgttacccccggtcttaacgtttcccgg

SEQ ID NO: 301619 - DNA, 623 bp, Homo sapiens
  misc_feature: GZ8MTXP01EULHY.8.28.C06.1.454.CMB.2.raw
  modified_base (396)..(396): a, c, t, g, unknown or other
  misc_feature (396)..(396): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttcctggggagagagccaccctctcctgtgcggccagtcagagcgttaggacgaacttagcctggtatcagcagaggcctggccaggcctcccagacctcctcattctttggcgtcctttaacgagggccaggtggaactccccgagccaggttcaggcggcaggtgggtctgggtacttcgtacactctcaccatcaataaccngacaatctagacgtactttgacttaagttttactttctgtacagctagtctagggaagtacgttcgggtccgttcgtacgtttccggggacgggtaacggggaaccgtaaggggttaccggaacccgttaacgaaaaccgggtaacgttcgggtcgggacctcggaccttaccgttacttccgtcgttccttcctacttccccgttccccgtaaccgttaacttccg

SEQ ID NO: 301620 - DNA, 557 bp, Homo sapiens
  misc_feature: GZ8MTXP01EBVF8.8.28.C06.1.454.CMB.2.raw
  modified_base (194)..(194): a, c, t, g, unknown or other
  misc_feature (194)..(194): n is a, c, g, or t
  modified_base (200)..(200): a, c, t, g, unknown or other
  misc_feature (200)..(200): n is a, c, g, or t
  modified_base (284)..(284): a, c, t, g, unknown or other
  misc_feature (284)..(284): n is a, c, g, or t
  modified_base (301)..(301): a, c, t, g, unknown or other
  misc_feature (301)..(301): n is a, c, g, or t
  modified_base (513)..(513): a, c, t, g, unknown or other
  misc_feature (513)..(513): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctccagagatcattggagaagtggtgatgacacagtctccggtcaccctgtctgttttccngggganagagccacctctcctgtgcggccagtcagagcgttaggacgaacttagcctggtatcagcagagctggcaggctccagactctnatctttggcgctttaanggcagtgaatcccagccagttcagcgcaggtggtctgggacttcgtcactctacacctatcaaataacctgacaatctagacgtactttgacttagtttattctgtcagcaagtctaggggaagacgttcgccgttctacgtttcggacgggaacgggacgaagggtcggaacctagaaaacgtaacgttggtcggcgttcgacaaccgttnttactcgttactttcacggttcctttacccctccgttaacgtcg

SEQ ID NO: 301621 - DNA, 628 bp, Homo sapiens
  misc_feature: GZ8MTXP01D9GU4.8.28.C06.1.454.CMB.2.raw
  modified_base (204)..(204): a, c, t, g, unknown or other
  misc_feature (204)..(204): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggcctcccagagatcattggagaagtggtgatgacacagtctccggtcaccctgtcttgttttcctggggaganagcccaccctctcctgtgcggccagtcagagcgttaggacgaacttagcctggtatcagcagaggcctggccaggctcccagactcctcatctttggcgctttaacagggccagtcggaatcccagccaggttcagcggcagtgggtctgggacttcgtcactctacaccatacctaactaactcacaacttctcgacgttactttgtacgtagtttactttctgttactacgtacgtacgttcggtacggtaacgttacgttacgggtccggttaccgttaccggtttaccgggacggggtaccgggtaacccgtaacgggtaccggtaacccgtaacgtaaacgttaacgtacggttacggtacgtcgttaccgttaccttacttcgtcgttccttccgtacttccttcccgttccgtaacg

SEQ ID NO: 301622 - DNA, 636 bp, Homo sapiens
  misc_feature: GZ8MTXP01AK8S4.8.28.C06.1.454.CMB.2.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacgaacttagcctggtatcagcagaggcctggccaggctcccagactcctcatctttggcgtcctttaacgagggccagtggaactcccagccaggttcagcggcacggtgggtctggggacttcggttcactctcacccatcaatacctgacaatctgacgtactttgcttagtttatttctgtcagtctagtcctagggaagtaccgttgggtaccccgtttcgaccgtttccgggggcgggtaacgggggtaccccgtaaaggggttccgggaacccttaccgaaaaccggtaacccgttgggttcgggccttacgggaccttaaccccgttattcccgttcgttcctttcccgaacgtttcccctttacccccggcccgttaacgttccccg

SEQ ID NO: 301623 - DNA, 585 bp, Homo sapiens
  misc_feature: GZ8MTXP01B497H.8.28.C06.1.454.CMB.2.raw
  modified_base (197)..(197): a, c, t, g, unknown or other
  misc_feature (197)..(197): n is a, c, g, or t
  modified_base (203)..(203): a, c, t, g, unknown or other
  misc_feature (203)..(203): n is a, c, g, or t
  modified_base (550)..(550): a, c, t, g, unknown or other
  misc_feature (550)..(550): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctcccagagatcattggagaagtggtgatgacacagtctccggtcaccctgtcttgtttttccngggganagagccacctctcctgtgcggccagtcagagtcgttaggacgaacttagcctggtatcagcagaggcctggccaggcctcccagacctcctcattctttggccgtacctttaacgcgggcctaggtacggaactcccgagccgtaggttcaggcggctacgggtgggtctggggtacttcgtacactctcgactatacaaatacctgactaattcgtagactactttgacttacgttttattctgtcacgctagtcgtaggaaacgtcgtcggtccttcgtacgttcgggacggaggaccgtaagggtccgaactacgaaacggtcgttggtcgctacgcttaacgnttacgtcgtctctacgtccttcccgtcttcgaacg

SEQ ID NO: 301624 - DNA, 644 bp, Homo sapiens
  misc_feature: GZ8MTXP01A8DN3.8.28.C06.1.454.CMB.2.raw
  modified_base (195)..(195): a, c, t, g, unknown or other
  misc_feature (195)..(195): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgttttccnggggagagagcccaccctctcctgtgcggccagtcagagtcgttaggacgtaacttagcctggtatcagcagaggcctggccaggcctcccagacctcctcattcgtttggccgtcctttaacgagggccaaggtcggaaactccccgaagcctaggttccaggcggctaggtgggtctggggtacttcggtacactctacacatacaataacctgacaatctagactactttgacttagtttatttctgtcagtctagttcgtagggaacgtacgttcgggtacccgtttacgtaaccggtttcggggacggggtaacggggtaaccgtaacggggtaccggtaaccctaacggaaaacgtaacgttgggtacggccgttacggcccttaaccgttacttccgtcgttccttccgtacttccctttccccggaaccttaacgttccgg

SEQ ID NO: 301625 - DNA, 658 bp, Homo sapiens
  misc_feature: GZ8MTXP01ATMYG.8.28.C06.1.454.CMB.2.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (406)..(406): a, c, t, g, unknown or other
  misc_feature (406)..(406): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgttttccngggganagacgccacctctcctgtgcgcagtcagagtcgttaggacgtaacttagcctggtatcagcagaggcctggccaggcctcccagtacctcctcattcgtttggccgtacctttaacgaggggcccaaggtcggaactcccgagccgtaggttcaggcggcgacggtgggtctgggtacttcgtacactctcaccatacaataccngacaatctagtacgtactttgacttaagttttatttcgtagtcacgtctagttctaggggaacgtacgttcgggtacccgtttacgtaccggtttcggggaccgggtaacgggaacccgtaagggtcggtaaccctaacgaaaaccggtacgttgggtaccgttcgtacggtccttaacccgttcgttaccgttcggttaccctttaacccgtactttccccgttaccccggtccttaacgtttaacccggg

SEQ ID NO: 301626 - DNA, 617 bp, Homo sapiens
  misc_feature: GZ8MTXP01ARK9O.8.28.C06.1.454.CMB.2.raw
  modified_base (197)..(197): a, c, t, g, unknown or other
  misc_feature (197)..(197): n is a, c, g, or t
  modified_base (203)..(203): a, c, t, g, unknown or other
  misc_feature (203)..(203): n is a, c, g, or t
  modified_base (362)..(362): a, c, t, g, unknown or other
  misc_feature (362)..(362): n is a, c, g, or t
  modified_base (380)..(380): a, c, t, g, unknown or other
  misc_feature (380)..(380): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgngggganagagcccaccctctcctgtgcggccagtcagagtcgttaggacgtaacttagcctggtatcagcagaggcctggccaggctcccagacctcctcattctttggcctacctttaacgagggccagtggaactcccagccagttcaggcgcaggtcgggtntgggtacttcgtcactcncacatacaatactgactaatctagtacgtactttcgacttagtttactttcgtgttcaacgtctagttccgtagggaacgtacgttcggtccgttctaccggtttcgggacgggtacggggtaccgtaaggggtacgtaacccgtaacgaaaccggtaacgttggtcgttcgtacgaccgttaccttattccgttaacgttcttccgtacttcccgttcccgaaccttcgttaaccg

SEQ ID NO: 301627 - DNA, 612 bp, Homo sapiens
  misc_feature: GZ8MTXP01AXI7M.8.28.C06.1.454.CMB.2.raw
  modified_base (206)..(206): a, c, t, g, unknown or other
  misc_feature (206)..(206): n is a, c, g, or t
  modified_base (579)..(579): a, c, t, g, unknown or other
  misc_feature (579)..(579): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtctgtttttccnggggagagacgccaccctctcctgtgcggccagtcagagcgttaggacgaacttagcctggtatcagcagaggcctggccaggcctcccagacctcctcattctttggcgtacctttaacgagggccaggtcggaaactccccgaagccgtaggttcaggcggctaggtcgggtctgggtacttcggtcaccgtctcacctatactaaactacctgactaactctacgacttactttgacgttagtttacttctcgttcgaagtccgtaagtcctaggaacgtacgttcggtaccctttctaaccggtttcgggaccgggtaggaacccgtaagggttccgtaaccacgtaaaaccgtcgttaggttcggacnggactaacccgtatccgttcgttcttaacgtcc

SEQ ID NO: 301628 - DNA, 651 bp, Homo sapiens
  misc_feature: GZ8MTXP01DX6U4.8.28.C06.1.454.CMB.2.raw
  modified_base (207)..(207): a, c, t, g, unknown or other
  misc_feature (207)..(207): n is a, c, g, or t
  modified_base (213)..(213): a, c, t, g, unknown or other
  misc_feature (213)..(213): n is a, c, g, or t
  modified_base (268)..(268): a, c, t, g, unknown or other
  misc_feature (268)..(268): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtcttgttttccgngggganagagccacctctcctgtgcggccagtcagagcgttaggacaacttagcctggtancagcagaggcctggccaggcctcccagacctcctcattcgtttggcgtacccttttaaacgacggggcccaaggtacggaaactccccgagtcccgtaaggttcaggcgggactagggttcggggttctgggggtacctttccggttaccaccttcctaccaacctatacctaaactaacctgactaaatctagtacgtactttgacttagtttattctgtacagtctagttactagaacgtacgtcgggtaccgttctaacgtttcgggacgggtaacgggaacccgtaagggttacgggtaacccttaacgaaaaccggtaacgttcgggttcgggttactcggaccaaccgtactccttacgttccttaacgttaacccg

SEQ ID NO: 301629 - DNA, 765 bp, Homo sapiens
  misc_feature: GZ8MTXP01CJQ43.8.28.C06.1.454.CMB.2.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggcagtcagagcgttaggacgtaacttagcctggtatcagcagaggcctggccaggcctcccagacctcctcattcgtttggccgtacctttaacgacgggccaggtcggaactcccgacgccgtaggttcgacggtcggctacgggttcggggtcgtgggggtacctttccggttaaccaaccgttcctacctaaaccctacttaacctaaacttaacccgttgaaccctaaacttccgtacggtaacgttacgtttgtccgtttaagtttttacttttcgttacgtacgtacgtacgtagttaccgttaggggtaacggtaccggttccgggttacccgtttaccgttaccgggttttaccggggacgggggtaaccgggggtaacccgtaaagggggttacccggtaacccgttaaccggtaaaacccgggtaaacgttcgggtccgggccgtaaccggtccttaaacccgttgtttccccttaacggtttcccctttcctacccgtttccccgtttacccccgtccttaacgtttcccgg

SEQ ID NO: 301630 - DNA, 570 bp, Homo sapiens
  misc_feature: GZ8MTXP01C3KQH.8.28.C06.1.454.CMB.2.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (401)..(401): a, c, t, g, unknown or other
  misc_feature (401)..(401): n is a, c, g, or t
  modified_base (528)..(528): a, c, t, g, unknown or other
  misc_feature (528)..(528): n is a, c, g, or t
  modified_base (538)..(538): a, c, t, g, unknown or other
  misc_feature (538)..(538): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctcccagagatcattggagaagtggtgatgacacagtctccggtcaccctgtctgttttccngggganagagccacctctcctgtgcggccagtcagagtcgttaggacgaacttgcctggtatcagcaggaggctggccaggcctccagactcctcattcgtttggcgtacctttaacgacggggccagtaggaactcccagccgtaggttcagcggcaggtcggggtctgggtaccttcgtcactctacaccatacaataaccgtnactatctagacgtattgtcttagttttacttctgtcagctacgtcgtagggtaacgtcgtcggtccgttcgtacggttcgggacgggacggacgtaggtacgaacctacgaaacgtacgttggtcgntcgcacgttnttcgttctctctcttccgttccctcttcgtcg

SEQ ID NO: 301631 - DNA, 859 bp, Homo sapiens
  misc_feature: GZ8MTXP01B04YN.8.28.C06.1.454.CMB.2.raw
  modified_base (208)..(208): a, c, t, g, unknown or other
  misc_feature (208)..(208): n is a, c, g, or t
  modified_base (214)..(214): a, c, t, g, unknown or other
  misc_feature (214)..(214): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtcttgtttttccgngggganagacgcccaccctctcctgtgccggccagtcagagcgttaggacgtaacttagcctggtatcagcagacggcctggccaggcctcccagacctcctctattcgtttcggccgttaccgtttaacggacggggtccctaaggttacgggaaaccttcccccgaaggtcccgtaacggggtttccgaacggggtcccgggtacgtacggggttacgggggttccgtttcggggggtaccctttttcccgggtttaccacccttccgttacccaaccctacttaaccctaaacttaaacccgtagtacctaaacgttcctaacggtaccgttaacttttcggacctttaagtttttaacttttcgtacggttacgtacggtccgttaacggttacgttaaggaaaccggttccggttaccggggttaccccggttttaccggtaaccccggggtttttaccgggggaaccgggggttaaccgggggtaaaccccgtaaagggggtttcccgggtaaacccccgttaaaccgggtaaaaaaccgggtaacccggtttaggggttccggggttacccgttaacgggaaccccgttaacccttaacgtttacccgggtttaccgtttccccgtttaaccgtttaacccccg

SEQ ID NO: 301632 - DNA, 639 bp, Homo sapiens
  misc_feature: GZ8MTXP01BTKNG.8.28.C06.1.454.CMB.2.raw
  modified_base (197)..(197): a, c, t, g, unknown or other
  misc_feature (197)..(197): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgnggggagagacgcccaccctctcctggtgcggccagtcagagcgttaggacgaacttagcctggtatcagcagaggcctggccaggctcccagactcctcattctttggcgtcctttaacgacggggccaggtcggaactcccgagcctaggttcaggcggcaggtgggtctggggtacttcggtccactctacacctatacaaactaacctgactaatctagtacgtactttgacttagtttatttctgtcagtctagttctaggggaaacgtcgtacggtccgtttacgtaaccgtttccgggacgggtaacggggtacccgtaaagggggttaccggaacccgttaacggaaaaccggtaacgttgggtcggggcttcgggaccttaaaccggttcttacgttcgttccttaactcttcccttccccgccttaacttccg

SEQ ID NO: 301633 - DNA, 659 bp, Homo sapiens
  misc_feature: GZ8MTXP01A7453.8.28.C06.1.454.CMB.2.raw
  modified_base (197)..(197): a, c, t, g, unknown or other
  misc_feature (197)..(197): n is a, c, g, or t
  modified_base (203)..(203): a, c, t, g, unknown or other
  misc_feature (203)..(203): n is a, c, g, or t
  modified_base (260)..(260): a, c, t, g, unknown or other
  misc_feature (260)..(260): n is a, c, g, or t
  modified_base (455)..(455): a, c, t, g, unknown or other
  misc_feature (455)..(455): n is a, c, g, or t
  modified_base (608)..(608): a, c, t, g, unknown or other
  misc_feature (608)..(608): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgngggganagagcccaccctctcctgtcgcggcagtcagagtcgttagacgtaactagctggtancagcagaggcctggccaggcctcccgagtacctcctcagtttccgtttcggccgtacccgtttaacggacggggtcccgaaggtacggaacctaccccgaaggtccgtaggttaccgaggccggacgtacgggtcgggtcgtcgggtacttccgtaacactctacaccatacaactactgacatctagactcttnacttagtttatttcgtcgtctagtctagttacgtagggaacgtcgtacggtacccgttacgtaccggttcgggacggggtaacgggaccgtaaggggtaccggtaacctaaccggaaaacgtaacgttggtaccggttcgtacgaccttaccncgtttcctaagttccttaaccgtacttccccgttaccctcttaacgttccg

SEQ ID NO: 301634 - DNA, 582 bp, Homo sapiens
  misc_feature: GZ8MTXP01CCETF.8.28.C06.1.454.CMB.2.raw
  modified_base (206)..(206): a, c, t, g, unknown or other
  misc_feature (206)..(206): n is a, c, g, or t
  modified_base (211)..(211): a, c, t, g, unknown or other
  misc_feature (211)..(211): n is a, c, g, or t
  modified_base (214)..(214): a, c, t, g, unknown or other
  misc_feature (214)..(214): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtctgttttccgnggganagngccacctctcctgtgcggccagtcagagcgttaggacgaacttagcctggtatcagcaggaggcctggccaggcctcccagactcctcatctttggcgtcctttaacgagggtccaggtggaaactcccagcctaggttcagcggcaggtcgggtctgggactttcgtcactctcaccatacaatacctgactaatctagtacgttattgacttagtttacttctgttcgagtctagtcctagaaacgtgtcgggtccgttactacgtttccggggacggtacggggaaccgtaagggttcgggaaccttaacggaaaacgtaacgttgggttcgctaaggaccaaccgtatcgttgtcttcgtaacc

SEQ ID NO: 301635 - DNA, 614 bp, Homo sapiens
  misc_feature: GZ8MTXP01C4ZOT.8.28.C06.1.454.CMB.2.raw
  modified_base (197)..(197): a, c, t, g, unknown or other
  misc_feature (197)..(197): n is a, c, g, or t
  modified_base (203)..(203): a, c, t, g, unknown or other
  misc_feature (203)..(203): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctcccagagatcattggagaagtggtgatgacacagtctccggtcaccctgtcttgtttttccngggganagagccacctctcctgtgcggccagtcagagcgttaggacgaacttagcctggtatcagcagaggcctggccaggctcccagactcctcattctttggcgtcctttaacgacggggccagtggaactccccgagccaggttcaggcggctacggtcggggtctgggtactttcgtcactctccacatcaaactaactgacaatctagacgtacttgactagtttactttctgtacacgcagttcgtaggggaaacgtaccgttgggtcccgttacgtaccgtttccgggacgggtaacggggaacccgtaaaggggtccggtaaccgttaacgaaaacggtaacgttggttcggcgttacggcaccgttattccgtgttacttcacgttcccttacccgtcttaagttccg

SEQ ID NO: 301636 - DNA, 584 bp, Homo sapiens
  misc_feature: GZ8MTXP01B62UQ.8.28.C06.1.454.CMB.2.raw
  modified_base (207)..(207): a, c, t, g, unknown or other
  misc_feature (207)..(207): n is a, c, g, or t
  modified_base (213)..(213): a, c, t, g, unknown or other
  misc_feature (213)..(213): n is a, c, g, or t
  modified_base (242)..(242): a, c, t, g, unknown or other
  misc_feature (242)..(242): n is a, c, g, or t
  modified_base (435)..(435): a, c, t, g, unknown or other
  misc_feature (435)..(435): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtcttgtttttccngggganagagccacctctcctgtgcgccagtcagngcgttaggactaacttagcctggtatcagcagaggcctggccaggcctccagactcctcattctttggctcctttaacgagggccagtgaactcccagccaggttcaggcgcgagtcgggtctgggtactttcgtcactcgtcactatcaataacctgacaatctagacgtctttagacttagtttatttcgngttcgagtcgtagttactagaacgtacgttcggtacccgtttctaaccggttttcgggacgggtaacgggtaacccgtaaaggttcggtaaccttacgaaaacggtacttggttcggactggaccaactactcgttcttcgttctaacc

SEQ ID NO: 301637 - DNA, 571 bp, Homo sapiens
  misc_feature: GZ8MTXP01AXL0R.8.28.C06.1.454.CMB.2.raw
  modified_base (207)..(207): a, c, t, g, unknown or other
  misc_feature (207)..(207): n is a, c, g, or t
  modified_base (213)..(213): a, c, t, g, unknown or other
  misc_feature (213)..(213): n is a, c, g, or t
  modified_base (324)..(324): a, c, t, g, unknown or other
  misc_feature (324)..(324): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtcttgtttttccngggganagagcccacctctcctgtgcggccagtcagagcgttaggacgaacttagcctggtatcagcagacggctggccaggcctcccagactcctcatctttggcgtcctttaacnggggccagtcggaactcccagccaggttcaggcggcaggtgggtctgggacttcgtcactctcacatcaataacctgacaatctagacgtactttgctagtttattctgtacagtctagtctagaagtacgtggtaccgtttctaccgtttcgggacgggacgggtaacccaagggttcgaccgttacgaaaaccggaacttgggttcggctaacgctaaccctatcttcgttaaccttcgtaaccc

SEQ ID NO: 301638 - DNA, 709 bp, Homo sapiens
  misc_feature: GZ8MTXP01EWE6Q.8.28.C06.1.454.CMB.2.raw
  modified_base (209)..(209): a, c, t, g, unknown or other
  misc_feature (209)..(209): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattagagaagtggtgatgacacagtctccggtcaccctgttcttgtttttccgnggggagagacgccacctctcctgtcgcggcagtcagagtcgttaggactaacttagcctggtatcagcagacggcctggccaggcctaccccgagacctccctactattcgtttacgggccttacccgtttaaacgacgggggtaccctaggtacggaaccttcccgagccgtaacggttcgacggcggcgtaggtcggggttctggggtacctttcggtcaccttccgtaccaactactactaactaaccgtgaactactcgtacgtaacgttacgtttaggtaccttaagttttatttcgttacgtacggtacgtcgtaacgttcgtaacggtaacgtacgttcggtacccgtttacgtaccggttttacggggaccggggtaacgggaacccggtaacgggttaccggtaaaccgttaaccgtaaacggtaacgttcggttcggttaccttcgaccgtaaccgttcgttaccgttcggtttcctttccgttaacccg

SEQ ID NO: 301639 - DNA, 674 bp, Homo sapiens
  misc_feature: GZ8MTXP01B98I6.8.28.C06.1.454.CMB.2.raw
  modified_base (198)..(198): a, c, t, g, unknown or other
  misc_feature (198)..(198): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgttcttgtttttccgnggggagagacgccaccctctcctgtgcgcagtcagagtcgtaggacgaacttacgccgtggtatcgagcagacggcctggccaggcctacccagacctcctctaagttccgtttcggaccgtacctttaacggcgggacctaaggtcggaaactcccgagaccgtaggttcacggcggtacgtagggttcgggtcgtcggggtaccttcggtacacctctacactatacaactacctgactaatctacgtacgtactttagcttaacgttttactttctcggttacaacggtactacggttaccgttaaggggaaacgttacggtcgggttacccgtttactaccggtttcggggacgggtaaccggggtaactaaggggtacgtaaccgtacgaaaccgtaaggttggtaccggcgtcgtaccaccgttcttcgttcgtaccttctacggttccccttaccgtccttaagtaacg

SEQ ID NO: 301640 - DNA, 663 bp, Homo sapiens
  misc_feature: GZ8MTXP01ALHUR.8.28.C06.1.454.CMB.2.raw
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
  modified_base (410)..(410): a, c, t, g, unknown or other
  misc_feature (410)..(410): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccngggganagagccaccctctcctgtgcggccagtcagagcgttaggacgtaacttgcctggtatcagcagaggcctggccaggctcccagacctcctcattctttggcgtacctttaacgacgggccaggtcggaactccccgagtcccgaggttccaggcggcgtacggtgggtcgtggggtaccttcgttacacttctcaccatacaataccngactaatctagacgtactttgacttagtttatttcgtgtcagtctagttccgtagggtaaacgtcgttcgggtcccgtttacgtaaccggtttccgggaccggggtaacggggtaacccgtaaaggggtccggtaaacccgttacgaaaaccggtaaccgttggacggttcgtacgggaccttaaccggttcgttccttcggttccctttaaccgtaccctttccctttccccggaaccttaaccgtttccgg

SEQ ID NO: 301641 - DNA, 608 bp, Homo sapiens
  misc_feature: GZ8MTXP01ASQYK.8.28.C06.1.454.CMB.2.raw
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
  modified_base (295)..(295): a, c, t, g, unknown or other
  misc_feature (295)..(295): n is a, c, g, or t
  modified_base (315)..(315): a, c, t, g, unknown or other
  misc_feature (315)..(315): n is a, c, g, or t
  modified_base (571)..(571): a, c, t, g, unknown or other
  misc_feature (571)..(571): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgttttccgngggganagacgccacctctcctgtgcggccagtcagagtcggttaaggacgtaacttagcctggtatcagcagcggcctggccaggcctccagactccncattcttggctaccttaagngggccagtcgactcccagcctaggtcaggcggctaggtgggtctgggtacctttcgtaccacttctaccaaccatacctaaataaccctgacctaaatcgtacgacgttacgtttgcttaagttttactttcgtgtacgacgtctagttccgtaggggaacgtacggttcggtacccgttcgtaacggttcgggacgggaaggggaccgtagggtacgacctacgaaacgtcgttgggtacgcgtacgcaccgttnttccttgtcttcctactcccttcccgtcttaacgtcg

SEQ ID NO: 301642 - DNA, 712 bp, Homo sapiens
  misc_feature: GZ8MTXP01DDUFP.8.28.C06.1.454.CMB.2.raw
  modified_base (210)..(210): a, c, t, g, unknown or other
  misc_feature (210)..(210): n is a, c, g, or t
  modified_base (216)..(216): a, c, t, g, unknown or other
  misc_feature (216)..(216): n is a, c, g, or t
tcagctcgcgtgtccacgaccggtgctcgatttagagctcacgtattgggtttgggggagagctctggggaggaactgctcagttaggacccagacggaaccatggaagccccagcgcagcttctcttcctcctgctactctggctcccagagatcattggagaagtggtgatgacacagtcctccggtcaccctgtcttgtttttccgngggganagagcccaccctctcctgtcgcgccagtcagagtcgttaaggacctaacttagccttggtatcagcaggacggcctggccaggccctcccagtacctcctctacttcgtttggccttacccgtttaacgacgggtcccaggtacggaactccccgagccccgtaaggttccaggccggtacacggggttcggggttcccgttgggggtacctttccgggttaccaaccttccctaccaaccctatacctaaactaacctgacaacttctagtacgtactttgtacttacgtttactttacgtcgttactacgtcgtaacgttcgtaagtaaacgtccgttcggttacccgtttacgtaccggtttaccgggacggggttaacgggaaacccgtaacggggttaccggtaaacccgttaacgtaaaaccggtacgttacgggttcggttaccgtaacggtacctaaccgtactcgttacttccgttccgttaacccg

SEQ ID NO: 301643 - DNA, 774 bp, Homo sapiens
  misc_feature: GZ8MTXP01BPY7Z.8.28.C06.1.454.CMB.2.raw
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctcccagagatcattggagaagtggtgatgacacagtctccggtcaccctgtctgttttccgngggganagagccacctctcctgtgcggccagtcagagtcgttaggactaacttagcctggtatcagcagacggcctggccaggcctcccagacctccgtcactttcgtttcgggccgtaccctttaaacgacgggggtccctaaggtcggaaacttccccgagtccgtagggttcaggcgggactaggggttcggggtctagggggtactttcggtaccaccgtctaccaaccctataccaaacttaaccgtgaacctaattcgtacggtaacgttacttttcggactttaaggtttttactttcgtcggttaccagtccgtaacgttccgttaagggggtaaacggttaccggtttcgggtccccgtttacgtaacccggggttttcgggggaaccggggtaaaccgggggtaacccgtaaagggggttaccggtaaaccccgttaacggaaaaaaccggtccggttgggttccggaccgttcgggaacccttaaaccggttctttccggtttaaccgttcccttttaaccgtaacctttccccgtttccccggtaaccgttaacgtttaacccggg

SEQ ID NO: 301644 - DNA, 600 bp, Homo sapiens
  misc_feature: GZ8MTXP01ED900.8.28.C06.1.454.CMB.2.raw
  modified_base (197)..(197): a, c, t, g, unknown or other
  misc_feature (197)..(197): n is a, c, g, or t
  modified_base (203)..(203): a, c, t, g, unknown or other
  misc_feature (203)..(203): n is a, c, g, or t
  modified_base (408)..(408): a, c, t, g, unknown or other
  misc_feature (408)..(408): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctcccagagatcattggagaagtggtgatgacacagtctccggtcaccctgtcttgtttttccngggganagagccacctctcctgtgcggcagtcagagcgttagacgtaacttagctggtatcagcagacggctggccaggcctcccagtacctcctcattctttggccgtacctttaacgacgggccaggtcggaactcccagccgtaggttcaggcggacgtacggtcggtcgtgggtactttccgtacactctacacctatacaactacngactaatcgtgtaacgtactttgacgtttaagttttctttcctggttacacggtactagttctagggtaaacgtcgttacggtccgttacgtacgttcgggacggacggtaccgtaggtacggacctacgaaacgtagttgacggttctcgacacgttcttctcgtctctactccttccgaacttcgtaacg

SEQ ID NO: 301645 - DNA, 594 bp, Homo sapiens
  misc_feature: GZ8MTXP01AN4ZF.8.28.C06.1.454.CMB.2.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (266)..(266): a, c, t, g, unknown or other
  misc_feature (266)..(266): n is a, c, g, or t
  modified_base (422)..(422): a, c, t, g, unknown or other
  misc_feature (422)..(422): n is a, c, g, or t
  modified_base (590)..(590): a, c, t, g, unknown or other
  misc_feature (590)..(590): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacgaacttagcctggtatcgagcagnggcctggccaggcctcccgagactcctcattcgtttggcgtacctttaacgacggggaccctaggtacggaactccccgaagcccgtaggttcaggcggctaggtcggggtctggggtacttcggttaccacttctccactatacaaagttaaccngactaactcgtgaacgtactttgactagtttattctgtcagctagtcagggaacgtcgtcggcccgtttacacgtttcgggacgggacgggtaccgtaagggtcggaacctcgaaaacgtacttggtcggctgcaccgttattcgtaagtctcattccttcccgaacntccg

SEQ ID NO: 301646 - DNA, 747 bp, Homo sapiens
  misc_feature: GZ8MTXP01DENRF.8.28.C06.1.454.CMB.2.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctccagagatcattggagaagtggtgatgacacagtctccggtcacctgtcttgttttccgngggganagagccacctctcctgtgcggcagtcagagcgttaggacgtaaacttgctggtatcagcagacggcctggccaggcctccagacctcctcattcgtttggccgtacctttaaacgacggggacccaaggttacgggaaactccccgaaggccccgtagggtttaccaagggtccgggaccgtaacggggttcgggggttacgtacggggggtaacctttccgggtttaaccaacctttcccttaccaaaccctaacgtaacctaaaacttaaaccccttgaaacctaaacttaccgtacggaaccggttaccttttaggaccctttaaaggttttttactttctcgggttacctaaggcctaagttccgttaggggaaaacgttcggttcgggtcccgtttacgtaacggtttcggggacgggaacggggtacccgaagggtccgaacctaacgaaacgtaacgttggtacgggttctacggcaacccgttcttccgttcgttacccttccgtaccttcccgttacccgtaaccgttaacgtaacg

SEQ ID NO: 301647 - DNA, 660 bp, Homo sapiens
  misc_feature: GZ8MTXP01DNOFI.8.28.C06.1.454.CMB.2.raw
  modified_base (208)..(208): a, c, t, g, unknown or other
  misc_feature (208)..(208): n is a, c, g, or t
  modified_base (213)..(213): a, c, t, g, unknown or other
  misc_feature (213)..(213): n is a, c, g, or t
  modified_base (244)..(244): a, c, t, g, unknown or other
  misc_feature (244)..(244): n is a, c, g, or t
  modified_base (269)..(269): a, c, t, g, unknown or other
  misc_feature (269)..(269): n is a, c, g, or t
  modified_base (462)..(462): a, c, t, g, unknown or other
  misc_feature (462)..(462): n is a, c, g, or t
  modified_base (644)..(644): a, c, t, g, unknown or other
  misc_feature (644)..(644): n is a, c, g, or t
  modified_base (649)..(649): a, c, t, g, unknown or other
  misc_feature (649)..(649): n is a, c, g, or t
tcagctcgcgtgtccacgaccggtgctcgatttagagctcacgtattggggtttgggggagagctctgggggaggaactgctcagttaggacccagacggaaccatggaagccccagcgcagcttctcttcctcctgctactctggctccagagatcattggagaagtggtgatgacacagtctccggtcacctgtcttgttttccgnggganagagccacctctcctgtgcggcagtcagagngttaaggactaaacttagctggtancagcagacggcctggccaggcctaccgagacctcctctattccgtttggccgtacctttaacgacggggtcccaaggttacggaaacttccccgagtacccgtaggttccgaagggtcggacctaggggtcggggttctcgggggtacctttcgttacaccttcctcaaccgtaatacctaaacttaaacctnactaactacgtacgtacgttactttcgacgttaagtttacttacgtcgtacgtacgtacgtacgttacgtagtaacgtcgtccggtccgttcgttaccggttacggggacgggaacgggtaacgtaagggttacgaaccgttaaacgtaaacggtcgttaggttcgttactcgactaacctntcttnttcgttctaac

SEQ ID NO: 301648 - DNA, 822 bp, Homo sapiens
  misc_feature: GZ8MTXP01AC4PS.8.28.C06.1.454.CMB.2.raw
  modified_base (205)..(205): a, c, t, g, unknown or other
  misc_feature (205)..(205): n is a, c, g, or t
  modified_base (210)..(210): a, c, t, g, unknown or other
  misc_feature (210)..(210): n is a, c, g, or t
  modified_base (213)..(213): a, c, t, g, unknown or other
  misc_feature (213)..(213): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcacctgtctgttttccgnggganagngccacctctcctgtgcggccagtcagagcggttaggacgtaacttagccgtggtactcagcaggaggccctggaccaggcctaccccgagacccttcccgtactaacgtttccgtttcggccgttacccgttttaaacggacggggtaccctaaggtcgggtaaacctcccccgaagggtcccccgtaaagggttccgacgggccggggtccgtaagggggttcggggggttcccttcggggggttaaacccttttcccgggtttactaaccccgttcctacccgtaaaccctaacttaacccgtaaaacttaaccccgtacgtaactaaacctttcgtaacgtaacccgttacgttttaggacctttaagttttactttcgttacgggtaccgtaaaggtaccggttaagttacccgttaaggaaaccggttaccgttcggggttaccccgtttccggttacccgggtttaccggggcgggggaaacccgggtaaacggtaaggggttacccgaaacccgttaacgaaaaacggtaacccgttgggttaaccgggccttaacgggaccttaaacccgtcgtttccgttaccttccgttccttaacccg

SEQ ID NO: 301649 - DNA, 597 bp, Homo sapiens
  misc_feature: GZ8MTXP01BM8HU.8.28.C06.1.454.CMB.2.raw
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
  modified_base (395)..(395): a, c, t, g, unknown or other
  misc_feature (395)..(395): n is a, c, g, or t
  modified_base (553)..(553): a, c, t, g, unknown or other
  misc_feature (553)..(553): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccngggganagagccaccctctcctgtgcggccagtcagagtcgttaggacgaacttagcctgggtatcagcagaggcctggccaggcctcccagactcctcatctttggccgtcctttaacgcgggccagtaggaactcccagccgaggttcagcggcaggtgggtctgggaccttcgttcactctcaccatacaataccngactaatctacgacgtacttgacttagtttactttctagtcagtctagtctaggggaacgtacgtcgggtccgttcgtaccggtttcggacgggacgggaacctaaggggtcgtaaccctgaaaccgtaagttcggttacgcgttcggaccttaccgnttcgttcgtaccttctaccgttccgttacccctcgttaacgtcg

SEQ ID NO: 301650 - DNA, 657 bp, Homo sapiens
  misc_feature: GZ8MTXP01D832F.8.28.C06.1.454.CMB.2.raw
  modified_base (211)..(211): a, c, t, g, unknown or other
  misc_feature (211)..(211): n is a, c, g, or t
  modified_base (279)..(279): a, c, t, g, unknown or other
  misc_feature (279)..(279): n is a, c, g, or t
tcagctcgcgtgtccacgaccggtgctcgatttagagctcacgtattgggtttgggggagagctctggggaggaactgctcagttaggacccagacggaaccatggaagccccagcgcagcttctcttcctcctgctactctggcctcccagagatcattggagaagtggtgatgacacagtcctccggtcaccctgtcttgtttttccgnggggagagacgcccacccttctccgtgtgcggccagtcagagtcgttaggactaactagcctaggtancagcaggacgcctggccaggcctacccagacctcctctagttcgtttcggacgtcctttaagcgggtccaggtcggaactcccgagccgtaggttcaggcggacgtagggtcgggttacgtcggggtactttccggttaccacttcctacacctatacaaataacctgactaatctagtacttactttagcttagtttacttcgtagtctagtctagttacgtaggaaacgtcgttcggtacccgttcgtacggtttcgggacgggtaacgggaacccgtaaggggttacgtaacccgttaagaaaaccggtacgttcggttcgggacttccggacctaacctactttcggttaccgtttccgttaaccgttaacccg

SEQ ID NO: 301651 - DNA, 640 bp, Homo sapiens
  misc_feature: GZ8MTXP01DW0WQ.8.28.C06.1.454.CMB.2.raw
  modified_base (199)..(199): a, c, t, g, unknown or other
  misc_feature (199)..(199): n is a, c, g, or t
  modified_base (205)..(205): a, c, t, g, unknown or other
  misc_feature (205)..(205): n is a, c, g, or t
tcagctcgcgtgtccacgaccggtgctcgatttagagctcacgtattggggtttggggggaggaactgctcagttaggacccagacggaaccatggaagccccagcgcagcttctcttcctcctgctactctggctcccagagatcattggagaagtggtgatgacacagtctccggtcaccctgtcttgtttttccgngggganagagccacctctcctgtgcggccagtcagagcgttaggacgtaacttagcctggtatcgagcagaggcctggccaggcctccagacctcctcattctttggcctacctttaacgacgggccaggtcggaactccccgagccgtaggttcaggcggctaggtcgggtctggggtacctttcggtcaacttctacaacctatacaaataacctgactaatctagaacgtactttgacttagttttattctgtacagtcagttctagggaatacgtcgtaccgttactacgttcggggacggtaacgggaccgtaagggtacggaacccttaacgaaaacggtaacgttggtacggttacttacggacccaacgttcttccgtttaacggttccttttaaccgaacctttccccgttacccgtcccttaagttcccgg

SEQ ID NO: 301652 - DNA, 794 bp, Homo sapiens
  misc_feature: GZ8MTXP01D96R7.8.28.C06.1.454.CMB.2.raw
  modified_base (198)..(198): a, c, t, g, unknown or other
  misc_feature (198)..(198): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctcccagagatcattggagaagtggtgatgacacagtctccggtcaccctgttcttgttttccgnggggagagacgcccacctctcctgtcgccggccagtcaggagtcggttaggacgtaattagcctaggtatcgagcaggaggcctggccaggcctcccagtacctcctactattccgtttggacccgttacctttaaaccggcggggtaccctaaggtacgggtaaaccttcccccgaaggtacccgtaagggtttccaacgggtccggtacgtacggggttcggggttacggtacgggggttacccttttccggttaacctaccttccgtacctaacctaactaacctaaacttaacccgtgtaactaaacgttctacggtaaccgttacttttacggtacctttaagtttttactttccgtagttaccagtccgtaagttccgtaaggggtaaacgtccggttacgggttaccccgtttacggttaccggtttacccgggggaaggggtaaaccgggaacccggtaaacgggtacggtaaaccccgtaacgtaaaaaccggtcgttcgggtcggttaccggtccgaaccttaaccgttcttcggttaacccgttaccttccttaccgttccccgttccccgtcgttaacttccgg

SEQ ID NO: 301653 - DNA, 546 bp, Homo sapiens
  misc_feature: GZ8MTXP01DW9SR.8.28.C06.1.454.CMB.2.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (283)..(283): a, c, t, g, unknown or other
  misc_feature (283)..(283): n is a, c, g, or t
  modified_base (286)..(286): a, c, t, g, unknown or other
  misc_feature (286)..(286): n is a, c, g, or t
  modified_base (297)..(297): a, c, t, g, unknown or other
  misc_feature (297)..(297): n is a, c, g, or t
  modified_base (320)..(320): a, c, t, g, unknown or other
  misc_feature (320)..(320): n is a, c, g, or t
  modified_base (327)..(327): a, c, t, g, unknown or other
  misc_feature (327)..(327): n is a, c, g, or t
  modified_base (398)..(398): a, c, t, g, unknown or other
  misc_feature (398)..(398): n is a, c, g, or t
  modified_base (402)..(402): a, c, t, g, unknown or other
  misc_feature (402)..(402): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctccagagatcattggagaagtggtgatgacacagtctccggtcacctgtcttgtttttccngggganagagccacctctctgtgcgcagtcagagcgttaagacgtaattagcctaggtatcagcagagcctggccagctccagactcnatnttgctcttaanggcagtgatccagcagtcagcgnagtggtntgggtacttcgtaacactctcaaccatacaaataacctgacaagtctaggactactttgctagtttattcngtanagatagtagtaggaagtacgtcgtcgtacgtacgtcggacgggaacggaacggtaacggtacggtaacgtaacgaaacgaaacgttagtcgttcgtacgtacaccgttcttctcttcttctctccttccctccttaacgtaacg

SEQ ID NO: 301654 - DNA, 630 bp, Homo sapiens
  misc_feature: GZ8MTXP01DHRK5.8.28.C06.1.454.CMB.2.raw
  modified_base (198)..(198): a, c, t, g, unknown or other
  misc_feature (198)..(198): n is a, c, g, or t
  modified_base (431)..(431): a, c, t, g, unknown or other
  misc_feature (431)..(431): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgnggggagagagcccaccctctcctgtcgcggcagtcagagtcgttaggacgtaacttagcctggtatcagcagagcctggccaggctccagacctcctcatctttcggctacctttaagcgggccaggtcggaactcccaagcctaggttcaggcggctaggtggtctgggtacttcgtcactctacacatacaaatacctgacaatctagacgtcttgcttagttttacttcngtacagtctagtctaggggtaacgtacgttcggtccgttacgtaccggtttcggggacgggtaaacgggtaacccgtaaggggttaccggaaacccgttaacgaaaacggtacgttgggtacggacgttacgaccttaaccttagttccgttaaggttaccttcgtaccttcccgttaccccgtcttaacgttaaccgg

SEQ ID NO: 301655 - DNA, 630 bp, Homo sapiens
  misc_feature: GZ8MTXP01A8H49.8.28.C06.1.454.CMB.2.raw
  modified_base (171)..(171): a, c, t, g, unknown or other
  misc_feature (171)..(171): n is a, c, g, or t
  modified_base (209)..(209): a, c, t, g, unknown or other
  misc_feature (209)..(209): n is a, c, g, or t
  modified_base (215)..(215): a, c, t, g, unknown or other
  misc_feature (215)..(215): n is a, c, g, or t
tcagctcgcgtgtccacgaccggtgctcgatttagagctcacgtattggggtttggggagagctctggggaggaactgctcagttaggacccagacggaaccatggaagccccagcgcagcttctcttcctcctgctactctggctcccagagatcattggagaagtggtnatgacacagtctccggtcaccctgtcttgtttttccgngggganagacgccaccctctcctgtcgcggccagtcagagtcgttaggactaattagcctggtatcagcaggacggcctggccaggcctaccagacctcctcattcgtttggctacctttaacgcgggccaggtcgaactcccagccgtaggttcaggcggacaggtcgggtctgggtacttcgtcacgtctcactatactaatacctgacaactctacgacgttactttacgtacttagtttactttcgtacgtacggtagtctacgtccgtagtaacgtacgttcggtaccgttccgtacggtttcgggacgggtacgggaaccgtaacgggttacggtaacccgttacgaaaccggtacgttacggcgggttcgtaacggaccgtaaccgtactccggttcttccgttcgttaacccg

SEQ ID NO: 301656 - DNA, 705 bp, Homo sapiens
  misc_feature: GZ8MTXP01BU97H.8.28.C06.1.454.CMB.2.raw
  modified_base (210)..(210): a, c, t, g, unknown or other
  misc_feature (210)..(210): n is a, c, g, or t
  modified_base (216)..(216): a, c, t, g, unknown or other
  misc_feature (216)..(216): n is a, c, g, or t
tcagctcgcgtgtccacgaccggtgctcgatttagagctcacgtattggggtttggggagagctctgggggaggaactgctcagttaggacccagacggaaccatggaagccccagcgcagcttctcttcctcctgctactctggctccagagatcattggagaagtggtgatgacacagtctccggtcacccttgtcttgtttttccgngggganagacgcccacctctccgtgtcgccggccagtcagagtcgttaggacgtaaacttgccgtggtatcagcagcggctggccaggcctcccagtacctcctactacttcgtttacggccgtaccgtttaaacgcgggtacccgaggtacggaaaccttccccggagtacccgtaagggttccgaacgggtccgggtacgtacgggggttcgggttaccgttgggggtacccttttccgggttacccaaccgttcctaaccccaaactaactacctaaactaacctagtactaacttcgtacgtacgttactttgtaccttagttttacttcgttagtcgtagtcgtacgttacgtcgtaaacgtcgttacggtcccgttacgttaccggttaccgggacgggtaacgggtaacggtaaggttaccggtaaccgttacgtaaacgtcgttaggttcgactcgctaacgtacttcgttcgtctttcctaacccg

SEQ ID NO: 301657 - DNA, 594 bp, Homo sapiens
  misc_feature: GZ8MTXP01EGVSX.8.28.C06.1.454.CMB.2.raw
  modified_base (194)..(194): a, c, t, g, unknown or other
  misc_feature (194)..(194): n is a, c, g, or t
  modified_base (309)..(309): a, c, t, g, unknown or other
  misc_feature (309)..(309): n is a, c, g, or t
  modified_base (341)..(341): a, c, t, g, unknown or other
  misc_feature (341)..(341): n is a, c, g, or t
  modified_base (348)..(348): a, c, t, g, unknown or other
  misc_feature (348)..(348): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgttttccnggggagagacgccaccctctcctgtgcggccagtcagagcgttaggacgaacttagctggtatcagcagaggcctggccaggctccagactcctcatctttggctacctttaagngggccagtcgaactcccagccaggtcagcganggtggtntgggacttcgtacactctcgacctatacaaatacctgacaatctgacgtattgcttagtttatttctgtcagtatagtctagggtaaacgtcgtcggtcccgttactaccgtttccgggacggggtaacgggaccgtaagggttagggtaaccctaaccgaaacgtaaccgttagggtacgggttccgtacgtccacgttcttcgtcgttcttcctacttcccgttaccccgtccgttaacgtccg

SEQ ID NO: 301658 - DNA, 837 bp, Homo sapiens
  misc_feature: GZ8MTXP01BT40H.8.28.C06.1.454.CMB.2.raw
  modified_base (198)..(198): a, c, t, g, unknown or other
  misc_feature (198)..(198): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctccagagatcattggagaagtggtgatgacacagtctccggtcaccctgttcttgtttttccgnggggagagacgcccacctctcctggtcgcggccagtcagagtcgttaggactaacttagctggtatcagcagaggcctggccaggcctcccagtacctcctactacttcgtttggccgtaccctttaaacgacggggtcctaaggtcgggtaaactccccgaacggccgtaagggttccaagggccgggtacgtaacggggttcgggggttaccgttacggggggtaacccttttccggtttaacccacccgtttcccgttaccaaaccccgttaaacttaacccgtaaaaacttaaaccccgttcgaaaccctaaacgttcccgttacggtaaacccgtttacgtttttacggttaaaccgttttaacgggtttttttaaactttttccgttacgggtttaccaaacgtcccgtaaaggtttcccgtaagggggtaaacggttaaccgttcggggtaccccgttttaccgtaccggtttccggggacggggaaacgggtaccgtaaacggggtacgtaaccctaacgaaaaccggtaacgttcggtcgggttaccttacggaccttaaccgttcgttaccgtttcggttccctttaaccttcccgttaccccgttaccccgtccttaacgtttcccgg

SEQ ID NO: 301659 - DNA, 706 bp, Homo sapiens
  misc_feature: GZ8MTXP01DENM7.8.28.C06.1.454.CMB.2.raw
  modified_base (209)..(209): a, c, t, g, unknown or other
  misc_feature (209)..(209): n is a, c, g, or t
  modified_base (215)..(215): a, c, t, g, unknown or other
  misc_feature (215)..(215): n is a, c, g, or t
  modified_base (493)..(493): a, c, t, g, unknown or other
  misc_feature (493)..(493): n is a, c, g, or t
  modified_base (503)..(503): a, c, t, g, unknown or other
  misc_feature (503)..(503): n is a, c, g, or t
tcagctcgcgtgtccacgaccggtgctcgatttagagctcacgtattgggtttggggagagctctggggaggaactgctcagttaggacccagacggaaccatggaagccccagcgcagcttctccttcctcctgctactctggctcccagagatcattggagaagtggtgatgacacagtcctccggtcacctgtcttgtttttccgngggganagacgcctaccctctcctgtcgccggccagtcaggagtcggttaaggaccgtaacttagccgtggtatcgagcaggacggcctggccacggtccctaccccgagtacccttccctctacgtttccgtttacgggcccttacccgttttaaacggcccgggtccctaagggtacggtaaacctcccgacgtcccgtaaggttccgaggccgtacgtagggtcgggttcgtcggggtacctttccggtacccactttcaccaactatacaacttaaccgngactaacgtntacgacgtttctgtacttagtttactttcgtacgttacgagtaccgtagtacgtaggaacgtccggttcggtacccgttacgtccgggttacggcgggtaaccggtaacgtagggttaccgacccgttaaacgaaacgtaacgttggttaccgttcgtaacgccgtaaccgttcgttccgttcgtttaaccgttccgtaaccg

SEQ ID NO: 301660 - DNA, 693 bp, Homo sapiens
  misc_feature: GZ8MTXP01CHLM0.8.28.C06.1.454.CMB.2.raw
  modified_base (198)..(198): a, c, t, g, unknown or other
  misc_feature (198)..(198): n is a, c, g, or t
  modified_base (204)..(204): a, c, t, g, unknown or other
  misc_feature (204)..(204): n is a, c, g, or t
  modified_base (484)..(484): a, c, t, g, unknown or other
  misc_feature (484)..(484): n is a, c, g, or t
  modified_base (656)..(656): a, c, t, g, unknown or other
  misc_feature (656)..(656): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctccagagatcattggagaagtggtgatgacacagtctccggtcaccctgttcttgtttttccgngggganagacgccacctctcctgtgcggcagtcagagtcgttaggactaacttagcctaggtactcagacgaggacggccgtacggccgacgggccctacccgagtacctccctcctagtttcgtttacgggcccgttaccttttaaacggacgggggtaccaaggttcggtaactaccccgaggcccgtaagggttccgaagggccggtacgtacggggttcggggtcgtcggggtacctttccggttaaccaccttccacctaacctatacaaacttaccgtanactaatcgtacgtaacgttacttctatttagttttacttctcggtatacgatacgttacgaggggtaacgtcggtaccgttacgttacgtcggttccggggacggaaaccgggtaccgtaacgggtaccgtaccaacggtaaacgtacgttggtaacggctaccgcacgttnttcgttgttacctctcctccgttacctcttaacgtcg

SEQ ID NO: 301661 - DNA, 651 bp, Homo sapiens
  misc_feature: GZ8MTXP01AQYAK.8.28.C06.1.454.CMB.2.raw
  modified_base (198)..(198): a, c, t, g, unknown or other
  misc_feature (198)..(198): n is a, c, g, or t
  modified_base (204)..(204): a, c, t, g, unknown or other
  misc_feature (204)..(204): n is a, c, g, or t
  modified_base (427)..(427): a, c, t, g, unknown or other
  misc_feature (427)..(427): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgngggganagacgccaccctctcctgtcgacggccagtcagagcgttaaggactaacttaggccttggtatcgagcaggagcctggccaggcctccgagtacctccgtcattctttcggcgtacctttaacgcgggcctagtcggaactcccgagccgtaaggttcaggcggtctaggtgggtactggggtactttcggtacctactcgtccaactactacaaactacctnactatctacgtactacttcgtacgttagtttcttcgtgtactacgtacgtacgtactaacggggtacgtacggttcgtaccgtttacgtaccggttcggggacgggtaacgggtaaccgtacgggttacgaacccgtaacgaaacggtcgttcgggtcgttccgtacgccttacgttcgttcgttcttccttaaccgtccttcccgttcccgtaacgttcgtcg

SEQ ID NO: 301662 - DNA, 796 bp, Homo sapiens
  misc_feature: GZ8MTXP01EICE8.8.28.C06.1.454.CMB.2.raw
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctccagagatcattggagaagtggtgatgacacagtctccggtcaccctgttcttgttttccgngggganagacgccacctctcctgtgcgcagtcagagtcgttagactaattgcgtggtatcgagcaggacggcctgggcctaggccctacccgaagtacctcctctaacgtttccgtttacgggcccgttacccgtttaaacggcggggtacccctaaagggtacggtaacctcccccgaaaggtcccggtaaggttaccgacggtcggtacgtaggggttcggggtacgtacggggttacctttccggtaaccacttccgtaccaacctactaaccgtaaaacttaccgtgtaacctaacttcgtaacggtacgttactttcggacttttaagttttactttcacggtaccaggtccttaaagttccgtaagggggtaaacgttccgggttacggttaccccgtttaacggtacccggtttaccgggggaacggggttaaaccgggaaccggttaaacgggttacccgaaacccgttaaacgggaaaaccgttacggttcgggttacgaccggttaccgaaccttaaacgttctttccgggttaacgttacctttaacctaacccgtttccccggttaccccgtaagttaaccgtccggg

SEQ ID NO: 301663 - DNA, 594 bp, Homo sapiens
  misc_feature: GZ8MTXP01C5RUN.8.28.C06.1.454.CMB.2.raw
  modified_base (197)..(197): a, c, t, g, unknown or other
  misc_feature (197)..(197): n is a, c, g, or t
  modified_base (285)..(285): a, c, t, g, unknown or other
  misc_feature (285)..(285): n is a, c, g, or t
  modified_base (306)..(306): a, c, t, g, unknown or other
  misc_feature (306)..(306): n is a, c, g, or t
  modified_base (385)..(385): a, c, t, g, unknown or other
  misc_feature (385)..(385): n is a, c, g, or t
  modified_base (404)..(404): a, c, t, g, unknown or other
  misc_feature (404)..(404): n is a, c, g, or t
  modified_base (412)..(412): a, c, t, g, unknown or other
  misc_feature (412)..(412): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgttcttgtttttccnggggagagagccaccctctcctgtgcggcagtcagagcgttagacgaacttagctggtatcagcagagctggcaggctccagactccncatctttggcgtcctttaacnggccagtgaatcccagccaggttcagcgcaggtcggtctgggacttcgtcactctacacatacaatacctgacaattcngactcttgctagtttattntcgtcagnagtctaggaaacgcgttcggccgttactaaccgtttcgggacggggtaacgggacccgtaaaggggtacgggaacccttaacgaaaaacggtaaccggttggtccggccttcgggcttaaaccgttcgttcccttaaggtttaccttcctaacggttccttacccccggtcaacgtttcccg

SEQ ID NO: 301664 - DNA, 727 bp, Homo sapiens
  misc_feature: GZ8MTXP01COTB2.8.28.C06.1.454.CMB.2.raw
  modified_base (198)..(198): a, c, t, g, unknown or other
  misc_feature (198)..(198): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgttcttgtttttccgnggggagagacgccaccctctcctgtgcggcagtcgagagcgttaggacgtaacttcgcctaggtatcgagcgagacggcctggccaggcctccagactcctctacttcgtttgggccctaccgtttaaacggcgggggtaccctaggtacgggtaaacctccccggaacggtacccggtaaggttcgaacgggtccggtacgtaacgggttcgggggtcgttgggggtacccttttcggttaacccacttcctaccaaaccctagttaaccaaacttaaccctggaactaactcgtacggtacgttactttcgtacgtttaagtttttacttcgttacgtacgtacgtacttaggtaccgttaaggggtaaacggtaccgtttcgggtccccgtttaaccgtaccgggtttaccggggacggggtaacgggaaccgtaaggggtaccggaaacctacggaaaacgtacgttggtacgcgtacgcaccttagttccttaagtccttctacgttccttaccgcgttctcgg

SEQ ID NO: 301665 - DNA, 560 bp, Homo sapiens
  misc_feature: GZ8MTXP01D2QPL.8.28.C06.1.454.CMB.2.raw
  modified_base (209)..(209): a, c, t, g, unknown or other
  misc_feature (209)..(209): n is a, c, g, or t
  modified_base (215)..(215): a, c, t, g, unknown or other
  misc_feature (215)..(215): n is a, c, g, or t
  modified_base (249)..(249): a, c, t, g, unknown or other
  misc_feature (249)..(249): n is a, c, g, or t
  modified_base (533)..(533): a, c, t, g, unknown or other
  misc_feature (533)..(533): n is a, c, g, or t
  modified_base (549)..(549): a, c, t, g, unknown or other
  misc_feature (549)..(549): n is a, c, g, or t
  modified_base (555)..(555): a, c, t, g, unknown or other
  misc_feature (555)..(555): n is a, c, g, or t
tcagctcgcgtgtccacgaccggtgctcgatttagagctcacgtattggggtttggggagagctctgggggaggaactgctcagttaggacccagacggaaccatggaagccccagcgcagcttctcttcctcctgctactctggctccagagatcattggagaagtggtgatgacacagtctccggtcaccctgtcttgtttttccgngggganagacgccaccctctcctgtgccggcagtcagagngttaggacaacttagcctggtatcagcagacgcctggccaggcctccagacctcctcattctttggctacctttaaacgacggggcctaggtggaactcccgagccgtaaggttcagcggcaggtcgggtctgggacttcgtcactctacacatactaaactaacctgactaatctacgacgtaactttgactatttattctgtcagctagtctagaagactggtccgtctacgtttcgggacggtagggaacgaaggttgggaaccttacgaaacgacttggngcgtgcaaccatcttntccttntaacc

SEQ ID NO: 301666 - DNA, 788 bp, Homo sapiens
  misc_feature: GZ8MTXP01AG2NJ.8.28.C06.1.454.CMB.2.raw
  modified_base (203)..(203): a, c, t, g, unknown or other
  misc_feature (203)..(203): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtcctccggtcaccctgtcttgtttttccggggganagacgccacctctcctgtcgcgcagtcagagtcgttagacgtaacttgcctggtactcgagcgaggacggcctgggacccagggtccctacccgaacgtaccttcctactacgtttccgtttcggacccgttacccgtttaaacggacgggggtccctaaggttacgggtaaaccttccccggaaggtaccccgttaggggttaccgaacggggtccgggtacgtacgggggttcgggttacgttcgggggtaccctttcgttaccaccgttctaccaacctataccaaacttacctgaactacttcgtacggtaccttacgtttgactttacgttttacttcgtcggtacacgtacgtacgttacgtaacgggtaacgtcggttccgggttacccgtttcggtttaaccggttcgggggaaccggggtaaccggggtaaccgtaaacgggggttccgtaaacccgttaacggaaaaccggtacggttcgggtaacgttccgtacggtaacccttccgtttaacgttccggttaacgtttcccgttaaccgttccttccccggtttaccccgcttaaccgttcgg

SEQ ID NO: 301667 - DNA, 746 bp, Homo sapiens
  misc_feature: GZ8MTXP01CH2KB.8.28.C06.1.454.CMB.2.raw
  modified_base (197)..(197): a, c, t, g, unknown or other
  misc_feature (197)..(197): n is a, c, g, or t
  modified_base (203)..(203): a, c, t, g, unknown or other
  misc_feature (203)..(203): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctccagagatcattgggagaagtggtgatgacacagtctccggtcaccctgtcttgtttttccgngggganagagccacctctcctgtgcgcagtcagagtcgttaaggacgtaacttacgcctggtatcagcagaggcctggccaggcctcccagacctcctcacttcgtttggccgtacctttaacgacggggccaaggtcggaactccccgagaccgtagggttacaggccgggtactagggtcggggttcgtcgggggtacctttcggttaaccacttcctacaaacctataccgaaacttaaccctgaactaaacttcgtacgtaacgttactttacggtactttaagtttttaactttcgtaacgttcacgtacgtacgtttacgtaaggggtaacgttacggttccgggttacccgtttacgttaccgggtttaccgggggacggggtaaccgggggtaaaccgtaaacggggttaccggtaaaccccgttaacggtaaaaccgtaccggttagggtaaccgggttccgttacggcccttaaccgttacttccgttaacgtcctttaaccgaacctttcccgttaccccgaacccttaacgttcccg

SEQ ID NO: 301668 - DNA, 665 bp, Homo sapiens
  misc_feature: GZ8MTXP01EP0KM.8.28.C06.1.454.CMB.2.raw
  modified_base (210)..(210): a, c, t, g, unknown or other
  misc_feature (210)..(210): n is a, c, g, or t
  modified_base (216)..(216): a, c, t, g, unknown or other
  misc_feature (216)..(216): n is a, c, g, or t
  modified_base (240)..(240): a, c, t, g, unknown or other
  misc_feature (240)..(240): n is a, c, g, or t
  modified_base (278)..(278): a, c, t, g, unknown or other
  misc_feature (278)..(278): n is a, c, g, or t
  modified_base (289)..(289): a, c, t, g, unknown or other
  misc_feature (289)..(289): n is a, c, g, or t
  modified_base (474)..(474): a, c, t, g, unknown or other
  misc_feature (474)..(474): n is a, c, g, or t
tcagctcgcgtgtccacgaccggtgctcgatttagagctcacgtattggggtttgggggagagctctgggggaggaactgctcagttaggacccagacggaaccatggaagccccagcgcagcttctcttcctcctgctactctggcctccagagatcattggagaagtggtgatgacacagtctccggtcaccctgtcttgttttccgngggganagacgccacctctcctgtcgcgcngtcagagtcgtaaggactaactgccgtggtactacaanaggacgtccgnggccaggcctccccagtaccctcctctacttccgtttcggaccgttaacccgtttaacggacggggtaccctaaggtacggaaacctcccccgaaggtcccgtaagggttcccgacgggtcggacgtagggtcgggtacgtcgggttaacctttcgtaccactcctacaccataccaaacgtacngactatctagtacgttactttgctttaagtttcttctagtcaggggctagtctaggaacgtcgtcggtccttacgtacggttcggggacgacgggaccgtaagggttacccgactaaaccggaaacgtacggtcggttacgttcgttacgaacctacctgttcgtacttccttaacgttccgttaaccccg

SEQ ID NO: 301669 - DNA, 617 bp, Homo sapiens
  misc_feature: GZ8MTXP01ATIAS.8.28.C06.1.454.CMB.2.raw
  modified_base (212)..(212): a, c, t, g, unknown or other
  misc_feature (212)..(212): n is a, c, g, or t
  modified_base (218)..(218): a, c, t, g, unknown or other
  misc_feature (218)..(218): n is a, c, g, or t
  modified_base (226)..(226): a, c, t, g, unknown or other
  misc_feature (226)..(226): n is a, c, g, or t
  modified_base (244)..(244): a, c, t, g, unknown or other
  misc_feature (244)..(244): n is a, c, g, or t
  modified_base (247)..(247): a, c, t, g, unknown or other
  misc_feature (247)..(247): n is a, c, g, or t
  modified_base (265)..(266): a, c, t, g, unknown or other
  misc_feature (265)..(266): n is a, c, g, or t
  modified_base (269)..(269): a, c, t, g, unknown or other
  misc_feature (269)..(269): n is a, c, g, or t
  modified_base (272)..(272): a, c, t, g, unknown or other
  misc_feature (272)..(272): n is a, c, g, or t
  modified_base (275)..(275): a, c, t, g, unknown or other
  misc_feature (275)..(275): n is a, c, g, or t
  modified_base (278)..(278): a, c, t, g, unknown or other
  misc_feature (278)..(278): n is a, c, g, or t
  modified_base (283)..(284): a, c, t, g, unknown or other
  misc_feature (283)..(284): n is a, c, g, or t
  modified_base (288)..(288): a, c, t, g, unknown or other
  misc_feature (288)..(288): n is a, c, g, or t
  modified_base (290)..(290): a, c, t, g, unknown or other
  misc_feature (290)..(290): n is a, c, g, or t
  modified_base (292)..(292): a, c, t, g, unknown or other
  misc_feature (292)..(292): n is a, c, g, or t
  modified_base (302)..(302): a, c, t, g, unknown or other
  misc_feature (302)..(302): n is a, c, g, or t
  modified_base (307)..(307): a, c, t, g, unknown or other
  misc_feature (307)..(307): n is a, c, g, or t
  modified_base (324)..(324): a, c, t, g, unknown or other
  misc_feature (324)..(324): n is a, c, g, or t
  modified_base (328)..(328): a, c, t, g, unknown or other
  misc_feature (328)..(328): n is a, c, g, or t
tcagctcgcgtgtccacgaccggtgctcgatttagagctcacgtattggggtttgggggagagctctgggggaggaactgctcagttaggacccagacggaaccatggaagccccagcgcagcttctccttcctcctgctactctggctcccagagatcagttggagaagtggtgatgacacagtctccggtcaccctgttcttgttttcgngggganagcgcccncctctctgtcgcgcagtnagngtgtagactaactgctgnnagnagngcngcngctcnnctcntntntgctactagngcagngactccagtcgagtcgngcgnaggtggtcgtggtcttcgtcactctacactatacaaagtactcactactcgtagtacgttactttcgtagttattttattcgttacgtacacggtatacttccggtaaggtaaccgttccgggttccggttaccgtttacccggttacggtcccggggggtaacgggtaaaccggggaaccgtaaacgggggttaccctaaaccgaaaggttaaacccggtaacggttccgggttagttccgtaacggtaccaaccttacgtttcggttacttccttcctttaaccccg

SEQ ID NO: 301670 - DNA, 591 bp, Homo sapiens
  misc_feature: GZ8MTXP01C5M3C.8.28.C06.1.454.CMB.2.raw
  modified_base (207)..(207): a, c, t, g, unknown or other
  misc_feature (207)..(207): n is a, c, g, or t
  modified_base (213)..(213): a, c, t, g, unknown or other
  misc_feature (213)..(213): n is a, c, g, or t
  modified_base (313)..(313): a, c, t, g, unknown or other
  misc_feature (313)..(313): n is a, c, g, or t
  modified_base (322)..(322): a, c, t, g, unknown or other
  misc_feature (322)..(322): n is a, c, g, or t
  modified_base (350)..(350): a, c, t, g, unknown or other
  misc_feature (350)..(350): n is a, c, g, or t
  modified_base (374)..(374): a, c, t, g, unknown or other
  misc_feature (374)..(374): n is a, c, g, or t
tcagctcgcgtgtccacgaccggtgctcgatttagagctcacgtattgggtttggggagagctctgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccacctctcctgtgcggccagtcagagcgttaaggacaacttagcctggtatcagcagacggcctggccaggcctccagactcctcatctttggcnctttaacgngggccagtgaatccagccaggtcagcgnaggtggctgggacttcgtcactcncacatacaataacctgacaatcgagtaacgtactttgacttagtttacttctgtcacggtctagtctagaacgtacgttcggtaccgttcgtaaccgtttcggggacgggtaacgggtaaccgtaagggttacggtaacccaacgtaaaaccggaacgttcgggttacggccgttcggaccaaccgttaacgtccttacgggttccttcttaacccg

SEQ ID NO: 301671 - DNA, 532 bp, Homo sapiens
  misc_feature: GZ8MTXP01AZB30.8.28.C06.1.454.CMB.2.raw
  modified_base (206)..(206): a, c, t, g, unknown or other
  misc_feature (206)..(206): n is a, c, g, or t
  modified_base (212)..(212): a, c, t, g, unknown or other
  misc_feature (212)..(212): n is a, c, g, or t
  modified_base (316)..(316): a, c, t, g, unknown or other
  misc_feature (316)..(316): n is a, c, g, or t
  modified_base (394)..(394): a, c, t, g, unknown or other
  misc_feature (394)..(394): n is a, c, g, or t
  modified_base (510)..(510): a, c, t, g, unknown or other
  misc_feature (510)..(510): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacgaaacttagcctggtatcagcagagctggccaggctccagactctcatctttgcgcctttaanagggccagtggaatcccagccaggttcagcggcagtgggtctggggacttcgttcactctcaccatcaaataaacctnacaatactagacgtacttgtactattattctgtcgagcagtctagaagacgtcgtccgtctacgttcggtcggacgggaacgaacggacggacgacgaaacgaacgttagttgcgngcaacactacttctcttctaac

SEQ ID NO: 301672 - DNA, 687 bp, Homo sapiens
  misc_feature: GZ8MTXP01AJXO0.8.28.C06.1.454.CMB.2.raw
  modified_base (198)..(198): a, c, t, g, unknown or other
  misc_feature (198)..(198): n is a, c, g, or t
  modified_base (419)..(419): a, c, t, g, unknown or other
  misc_feature (419)..(419): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgnggggagagagccacctctcctgtgcgcagtcagagcgttagacgaacttagcctggtatcagccaggacggcctggccaggcctccagacctcctcattctttggcgtacctttaacgcgggccaggtcggaatcccagcctaggttcaggcggtcaggtggtctggggtacttcggtacactctcaccatacaatacctgacaattcagtacgtactttncttaacgttttattcgtagttccaagtctacggttctaacggggtaaacgccgtttcgggtaccccgtttacgttaaccggtttccggggacggggaaacgggtaaacccgtaacgggggttaccgggtaaccctaaacgggtaaaacccgtaacggttcgggttacggaccgtttacgaaccggttaacccgttaactttccgttccgggtttccctttaacaaccgttttccccgtttaccccggaacccttaaacgtttcccggg

SEQ ID NO: 301673 - DNA, 576 bp, Homo sapiens
  misc_feature: GZ8MTXP01CK8BN.8.28.C06.1.454.CMB.2.raw
  modified_base (207)..(207): a, c, t, g, unknown or other
  misc_feature (207)..(207): n is a, c, g, or t
  modified_base (213)..(213): a, c, t, g, unknown or other
  misc_feature (213)..(213): n is a, c, g, or t
  modified_base (246)..(246): a, c, t, g, unknown or other
  misc_feature (246)..(246): n is a, c, g, or t
  modified_base (326)..(326): a, c, t, g, unknown or other
  misc_feature (326)..(326): n is a, c, g, or t
  modified_base (401)..(401): a, c, t, g, unknown or other
  misc_feature (401)..(401): n is a, c, g, or t
  modified_base (418)..(418): a, c, t, g, unknown or other
  misc_feature (418)..(418): n is a, c, g, or t
  modified_base (434)..(434): a, c, t, g, unknown or other
  misc_feature (434)..(434): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctccagagatcattggagaagtggtgatgacacagtctccggtcaccctgtcttgtttttccgngggganagagcccacctctcctgtcgcggtccagtcagngcgttaaggactacttagcctggtatcagcagaggcctggcaggctcccagacctctcatcgtttggcctactttaacgngggggtcccaggtggaactccgaagccgtaggttcaggcggcagggtcgggtacgtgggactttcggtacactcncacatactaagtaaccnacatctagtactattnacttatttctctgtcgtagtctagtactagtacgtcgtcggtccgtcgtacgttcgggacgggtacggaacgtaacggcgtaaccgttaacgtaaacgtcgttcggttcgcgtaagcctaactcgttcttacgtcttcgtcc

SEQ ID NO: 301674 - DNA, 556 bp, Homo sapiens
  misc_feature: GZ8MTXP01E2R1W.8.28.C06.1.454.CMB.2.raw
  modified_base (208)..(208): a, c, t, g, unknown or other
  misc_feature (208)..(208): n is a, c, g, or t
  modified_base (214)..(214): a, c, t, g, unknown or other
  misc_feature (214)..(214): n is a, c, g, or t
  modified_base (218)..(218): a, c, t, g, unknown or other
  misc_feature (218)..(218): n is a, c, g, or t
  modified_base (526)..(526): a, c, t, g, unknown or other
  misc_feature (526)..(526): n is a, c, g, or t
tcagctcgcgtgtccacgaccggtgctcgatttagagctcacgtattgggtttgggggagagctctgggggaggaactgctcagttaggacccagacggaaccatggaagccccagcgcagcttctcttcctcctgctactctggctcccagagatcattggagaagtggtgatgacacagtctccggtcaccctgtctgtttttccngggganagancccaccctctcctgtgcggccagtcagagcgttaggacgaacttagcctggtatcagcagaggcctggccaggctccccagacctccctcatctttggccgtaccctttaaacgacgggggcccaaggtggaaactccccagcctaggttccaggcggcaggtggggtctggggactcgttcactctcaccatcaaatacctgcaatctagacgtactttgctagtttattcagtcagcagtctgaagctggccgttctacgtttcggcgggaggggaaccaagggttcggaccttacgaaaacgacnggttcgctgccaaccatcttgtcttctaac

SEQ ID NO: 301675 - DNA, 765 bp, Homo sapiens
  misc_feature: GZ8MTXP01D4XGQ.8.28.C06.1.454.CMB.2.raw
  modified_base (198)..(198): a, c, t, g, unknown or other
  misc_feature (198)..(198): n is a, c, g, or t
tcagctcgcgtgtccacgaccggtgctcgatttagagctcacgtattggggtttggggggaggaactgctcagttaggacccagacggaaccatggaagccccagcgcagcttctcttcctcctgctactctggctccagagatcattggagaagtggtgatgacacagtctccggtcaccctgttcttgttttccgnggggagagacgccacctctcctggtcgcgcagtcagagtcgttaggacgtaacttagctaggtatcagcaggcggtcctggccaggccctaccgagacctcctctacttcgtttcggaccgttacctttaaacggcggggtaccctaagggtacggtaaacctaccccgacggtaccggtaggttaccgaacgggtccgggtacgtagggggttccgggggttacgttacgggggttaccctttaccggttaaccaccttcgtaccaaccctactaacctaaactaaccgtgaactaacttcgtagtaaccgttactttcgtactttaaggtttttcttcgtcgtactaacggcttaagtacgttaagggggtaacttccggttcggtaccccgtttacgtccgggtttacgggacgggggtaaacgggaaccgtaacggggtaccggtaaaccctaacggtaaaaccggtgttcggggtaccgttacggtacgtacccttacggttcttacccggttcgttcccttaactacccgttccccgttacccgtcccttaagttccccgg

SEQ ID NO: 301676 - DNA, 669 bp, Homo sapiens
  misc_feature: GZ8MTXP01C7DZU.8.28.C06.1.454.CMB.2.raw
  modified_base (356)..(356): a, c, t, g, unknown or other
  misc_feature (356)..(356): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcacctgttcttgtttttccgtggggagagacgccaccctctcctgtgcggccagtcagagcgttaggacgaacttgcctggtatcagcgaggaggcctggccaggcctcccagacctcctcattctttggctacctttaacgagggccagtacggactcccgagccgtagttcgagcggntacgggtcgggtctggggtacttcggtacactcaccactatacaaactaactccccgatactctacggtactactttgtacgttaacgttttactttcttacgtcgaacgtctaacggttcgtaacggggtaacggttaaccggttcgggttacccggtttacgttaaccggtttccgggggacggggtaacgggaacccgtaaaggggtacgtaccgtaaaccgtaaacggtaacgttgggtcggttacgtcgaaccgttacgttcttacgtcgttcttctaccttcccgttaccctccgttaacgtttccg

SEQ ID NO: 301677 - DNA, 745 bp, Homo sapiens
  misc_feature: GZ8MTXP01BWYD6.8.28.C06.1.454.CMB.2.raw
  modified_base (200)..(200): a, c, t, g, unknown or other
  misc_feature (200)..(200): n is a, c, g, or t
  modified_base (237)..(237): a, c, t, g, unknown or other
  misc_feature (237)..(237): n is a, c, g, or t
  modified_base (239)..(239): a, c, t, g, unknown or other
  misc_feature (239)..(239): n is a, c, g, or t
  modified_base (260)..(260): a, c, t, g, unknown or other
  misc_feature (260)..(260): n is a, c, g, or t
tcagctcgcgtgtccacgaccggtgctcgatttagagctcacgtattggggtttggggggaggaactgctcagttaggacccagacggaaccatggaagccccagcgcagcttctcttcctcctgctactctggctccagagatcattggagaagtggtgatgacacagtcctccggtcacccttgtcttgtttttccgnggggagagacgccacctctcctggtgcggcagtcagngngttaggacgtactgctggtancagcaggaggcctggccaggcctcccgagacctcctctacttcgtttacggccgtaccgtttaaacgcgggaccctaaggtacggaaactccccgaacggtccgtacggtttcgaacggcggtccggtaacgggttcgggggtcgtgggggtacctttccgttaacctaaccttcctacccaaactactaccgtaaaacttaacccgagtactaactcgtacggtaacgtacctttagtccgtttaagttttactttcctggttaccaaggtctaaggttaccctagggggtaaacggttacggttccgggtacccgttttacggtaccggttttccggggaacgggggttaaccgggaaacccgtaaagggggttaccgtaaacccggttaacccgaaaaagtcggtttcgggcgttaaccttcggacccttaacgttcttcgttaacttctccttacgtcccttacccgtaacttaactccgg

SEQ ID NO: 301678 - DNA, 554 bp, Homo sapiens
  misc_feature: GZ8MTXP01C95V6.8.28.C06.1.454.CMB.2.raw
  modified_base (194)..(194): a, c, t, g, unknown or other
  misc_feature (194)..(194): n is a, c, g, or t
  modified_base (200)..(200): a, c, t, g, unknown or other
  misc_feature (200)..(200): n is a, c, g, or t
  modified_base (303)..(303): a, c, t, g, unknown or other
  misc_feature (303)..(303): n is a, c, g, or t
  modified_base (376)..(376): a, c, t, g, unknown or other
  misc_feature (376)..(376): n is a, c, g, or t
  modified_base (421)..(421): a, c, t, g, unknown or other
  misc_feature (421)..(421): n is a, c, g, or t
  modified_base (514)..(514): a, c, t, g, unknown or other
  misc_feature (514)..(514): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgttttccngggganagagccacctctcctgtgcggcagtcagagcgttagacgaacttagcctggtatcagcagagctggccaggctcccagactcctcatcttggcgtcctttaanaggccagtgaactcccagcaggttcagcggctacggtggtcgtgggacttcgttacactctcaaccatacaanaacctgactaatcttgacgtactttgactagtttatttctgtacngctaagtcgtaggaacgtactggtaccgttctacgtttcgggcggtacgggtaccgaaggttacggaccttacgaaacggtaacttggtacgngtacgcacgcttctgtctctactccgttccgtccaatccg

SEQ ID NO: 301679 - DNA, 702 bp, Homo sapiens
  misc_feature: GZ8MTXP01AQONV.8.28.C06.1.454.CMB.2.raw
  modified_base (197)..(197): a, c, t, g, unknown or other
  misc_feature (197)..(197): n is a, c, g, or t
tcagctcgcgtgtccacgaccggtgctcgatttagagctcacgtattgggtttgggggaggaactgctcagttaggacccacacggaaccatggaagccccagcgcagcttctcttcctcctgctactctggctcccagagatcattggagaagtggtgatgacacagtctccggtcaccctgtcttgtttttccgnggggagagagcccaccctctcctgtgcggccagtcagagcgttaggactaacttagcctggtatcagcagaggcctggccaggcctcccagacctcctcattcgtttggccgtacctttaaacgaggggcccaaggtcggaactcccgagccgaggttcaggcggcgaggtggggtctggggtacttcgtacactctcacctataccaaataaccgtgactaacttctacgtacgtactttggactttacggttttactttcgttacgtacgtacgtctaacgttcctaggggtaacgtaccgttgggtaccccgtttcgttaaccggtttcgggggaccgggtaaacggggtaacccgtaaacgggggttaccggtaaacccgttaaccgaaaaaccggtaacgtttcgggacgggttccgttacggaccttacccgttacttccggttcgtttaccctttaaccgtacctttccccgttaccccggtccttaacgtttcccgg

SEQ ID NO: 301680 - DNA, 601 bp, Homo sapiens
  misc_feature: GZ8MTXP01DOXBP.8.28.C06.1.454.CMB.2.raw
  modified_base (207)..(207): a, c, t, g, unknown or other
  misc_feature (207)..(207): n is a, c, g, or t
  modified_base (213)..(213): a, c, t, g, unknown or other
  misc_feature (213)..(213): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtcttgtttttccngggganagagccaccctctcctgtgcggccagtcagagcgttaggacgtaattagcctggtatcagcagacggcctggccaggcctccagacctcctctatcctttggccgtcctttaacgcgggccaggtgaactccagcctagtcagcgcaggtggctgggacttcgtcactctcacatacaaatacctgacaatctagacgttacttgcttaagtttattcgtagtcgagtctaagttctaggtaaacgtcgttcggtacccgtttcgtaccgtttcgggggaccgggtaaacgggtaaccgtaaaggggttccgggtaaacccttaacgaaaacggtaaccgttggttacggcgttcgacaaccctatccgttactttccgttctaaccg

SEQ ID NO: 301681 - DNA, 571 bp, Homo sapiens
  misc_feature: GZ8MTXP01CM1OP.8.28.C06.1.454.CMB.2.raw
  modified_base (197)..(197): a, c, t, g, unknown or other
  misc_feature (197)..(197): n is a, c, g, or t
  modified_base (203)..(203): a, c, t, g, unknown or other
  misc_feature (203)..(203): n is a, c, g, or t
  modified_base (206)..(206): a, c, t, g, unknown or other
  misc_feature (206)..(206): n is a, c, g, or t
  modified_base (214)..(214): a, c, t, g, unknown or other
  misc_feature (214)..(214): n is a, c, g, or t
  modified_base (218)..(218): a, c, t, g, unknown or other
  misc_feature (218)..(218): n is a, c, g, or t
  modified_base (257)..(258): a, c, t, g, unknown or other
  misc_feature (257)..(258): n is a, c, g, or t
  modified_base (278)..(278): a, c, t, g, unknown or other
  misc_feature (278)..(278): n is a, c, g, or t
  modified_base (283)..(283): a, c, t, g, unknown or other
  misc_feature (283)..(283): n is a, c, g, or t
  modified_base (299)..(299): a, c, t, g, unknown or other
  misc_feature (299)..(299): n is a, c, g, or t
  modified_base (404)..(404): a, c, t, g, unknown or other
  misc_feature (404)..(404): n is a, c, g, or t
  modified_base (406)..(406): a, c, t, g, unknown or other
  misc_feature (406)..(406): n is a, c, g, or t
  modified_base (408)..(408): a, c, t, g, unknown or other
  misc_feature (408)..(408): n is a, c, g, or t
  modified_base (410)..(410): a, c, t, g, unknown or other
  misc_feature (410)..(410): n is a, c, g, or t
tcagctcgcgtgtccacgaccggtgctcgatttagagctcacgtattggggtttggggggaggaactgctcagttaggacccagacggaaccatggaagccccagcgcagcttctcttcctcctgctactctggctccagagatcattggagaagtggtgatgacacagtctccggtcaccctgtctgtttttccgngggganagngccacctntccngtgcggcagtcagagcgttaggacaacttagcctggtannagcagagctgcaggctccanactcncatcttgctcttaagnggacagtgactcccagcaggtcagcgcaggtggtctggacttcgtacactctacacactacaaacgtaactgactaatccagacgtattgataagttttactttntntnanatagtactacggtaacgtacgtcgtaccgtacgtacgtcggtacggaacggtaacgtaacggtacggtaacgaacgtaaacgtaacgttaggtcgacgtacgtacacgttacttacgtaacgttacttaaccttactccgttaccctccgttaacgtaacg

SEQ ID NO: 301682 - DNA, 696 bp, Homo sapiens
  misc_feature: GZ8MTXP01B9LPG.8.28.C06.1.454.CMB.2.raw
  modified_base (198)..(198): a, c, t, g, unknown or other
  misc_feature (198)..(198): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctcccagagatcattggagaagtggtgatgacacagtctccggtcaccctgttcttgttttccgnggggagacggcctaccctctcctgtcgcgcagtcagagtcgttaggactaacttagctggtactcgagcaggacggccgtcggccgaggcctacccacgactcctcacttctttcggccgtaccctttaacggacggacccgtaggtacggaactccccgacgccgtagggttccaggccggcgtagggttcggggtcgtgggtacctttccgtctaaccgttcctcactactactaaactacctcgactactctagtacgtactttgacctttaagttttactttcgttagtacgagtcgtaggtacgttacggtaacggtacgttcggtccgtttaccgtacggtttaccggggacgggtaacgggtaaccggaaacgggtcgggtaaccgtaaaccgaaacggtaacgtcggttcggacgttcggtaacctaccttacggttccttacgttaaccttctaacttccccgtcccgttactaaccgttcgtaaccgg

SEQ ID NO: 301683 - DNA, 649 bp, Homo sapiens
  misc_feature: GZ8MTXP01CO23Q.8.28.C06.1.454.CMB.2.raw
  modified_base (209)..(209): a, c, t, g, unknown or other
  misc_feature (209)..(209): n is a, c, g, or t
  modified_base (215)..(215): a, c, t, g, unknown or other
  misc_feature (215)..(215): n is a, c, g, or t
  modified_base (269)..(270): a, c, t, g, unknown or other
  misc_feature (269)..(270): n is a, c, g, or t
  modified_base (280)..(280): a, c, t, g, unknown or other
  misc_feature (280)..(280): n is a, c, g, or t
tcagctcgcgtgtccacgaccggtgctcgatttagagctcacgtattgggtttggggagagctctggggaggaactgctcagttaggacccagacggaaccatggaacgccccagcgcagcttctcttcctcctgctactctggctcccagagatcattggagaagtggtgatgacacagtcctccggtcaccctgtcttgttttccgngggganagcgcccaccctctcctgtgcgccagtcagagtcgtaggacgaacttgctgtannagcagcgccngcacgcctccagcctctcattcgttcggctacttaagcgggcaggtgaacctccagcgtacggtcaggcgtgaggtgggtactgggtactttccggtcacgtcctaccgaactactacaaagtaccctgacaagtctacgtaccgttactttcgtactttaagttttactttcgttagtcgtacgtcgtaacgttacgtacggtaagtcccgttagggtccccgtttcgtaaccggtttccggggacgggaacgggtaaaccccgtaagggttcccgggaaacccttaaacgggtaaaaccgtcggttacgggttcgaccgttcggacccgttaacccgttcgttccgttacgttccctttaacgtccc

SEQ ID NO: 301684 - DNA, 727 bp, Homo sapiens
  misc_feature: GZ8MTXP01EO425.8.28.C06.1.454.CMB.2.raw
  modified_base (676)..(676): a, c, t, g, unknown or other
  misc_feature (676)..(676): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctccagagatcattggagaagtggtgatgacacagtctccggtctacccttgttcgtttgtttttccgtggggagagacgccctacctctcctgtgcgccagtcagagtacgtaggacgtaacttagctaggtatcagcaggacgcgtggccaggcctaccgagtacctcctactactttcgttcggccgttaccgtttaacggacgggaccgtaggtacggtaactccccgaagtccggtaggttacgacgggtccgggcgtacgggttcggggttacgtcggggttacctttccggttaacctaccgtcctaccgtaacctaactacctaaactaccgtgaactatcgtacgtaacgtactttgtacgtttagttttacgtttcgtacgtcaacgtctagttacgtacggggtaaacgttccggtcgttacccgttacgttaccgggttacggggtacgggaaccgggtaacgtaacggggttacgtaacccggtaagtaaaccggtcggttcgggtccgacgtacggtaaccttaccttnttccgttcgttccttaacctcttccccgttacccgtaacttcgttaaccgg

SEQ ID NO: 301685 - DNA, 673 bp, Homo sapiens
  misc_feature: GZ8MTXP01AZTTZ.8.28.C06.1.454.CMB.2.raw
  modified_base (211)..(211): a, c, t, g, unknown or other
  misc_feature (211)..(211): n is a, c, g, or t
  modified_base (218)..(218): a, c, t, g, unknown or other
  misc_feature (218)..(218): n is a, c, g, or t
  modified_base (283)..(283): a, c, t, g, unknown or other
  misc_feature (283)..(283): n is a, c, g, or t
  modified_base (299)..(299): a, c, t, g, unknown or other
  misc_feature (299)..(299): n is a, c, g, or t
  modified_base (365)..(365): a, c, t, g, unknown or other
  misc_feature (365)..(365): n is a, c, g, or t
  modified_base (382)..(382): a, c, t, g, unknown or other
  misc_feature (382)..(382): n is a, c, g, or t
  modified_base (430)..(430): a, c, t, g, unknown or other
  misc_feature (430)..(430): n is a, c, g, or t
tcagctcgcgtgtccacgaccggtgctcgatttagagctcacgtattggggtttggggagagctcgtgggggaggaactgctcagttaggacccagacggaaccatggaagccccagcgcagcttctcttcctcctgctactctggctcccagagatcattggagaagtggtgatgacacagtctccggtcaccctgtcttgtttttccgnggggtanacgacgccctaccctctcgtgtgccggccagtcaggagtcgttaggactaactagccgtaggtancgagcaggacggtccnggaccaggccctaccgagtacctcctacattcgttggccgtaccttacggcggcgtagtagtaccnccgagccgtcggttacngacggcgtaggtgggtcgtggtacctcgttccactctacaacctaaanacgtaaactaccgtataacctagttcgtaacgtacttattacgtacgtttagtttacttcgtacgtacgacgtacgtacgtacgtagtaacgtacgtaccggttaccgttaccgttaccggttacggtacgggtaacgggtaacggtaacggttaaccggtaaccgttaaaccgtaaacggtacgttcggttcggttacgtaacgtacgtaaccgtacgtcgttcgttccgttccgttaaccg

SEQ ID NO: 301686 - DNA, 594 bp, Homo sapiens
  misc_feature: GZ8MTXP01B3AII.8.28.C06.1.454.CMB.2.raw
  modified_base (198)..(198): a, c, t, g, unknown or other
  misc_feature (198)..(198): n is a, c, g, or t
  modified_base (267)..(267): a, c, t, g, unknown or other
  misc_feature (267)..(267): n is a, c, g, or t
  modified_base (270)..(270): a, c, t, g, unknown or other
  misc_feature (270)..(270): n is a, c, g, or t
  modified_base (276)..(276): a, c, t, g, unknown or other
  misc_feature (276)..(276): n is a, c, g, or t
  modified_base (279)..(279): a, c, t, g, unknown or other
  misc_feature (279)..(279): n is a, c, g, or t
  modified_base (283)..(283): a, c, t, g, unknown or other
  misc_feature (283)..(283): n is a, c, g, or t
  modified_base (297)..(297): a, c, t, g, unknown or other
  misc_feature (297)..(297): n is a, c, g, or t
  modified_base (305)..(305): a, c, t, g, unknown or other
  misc_feature (305)..(305): n is a, c, g, or t
  modified_base (309)..(309): a, c, t, g, unknown or other
  misc_feature (309)..(309): n is a, c, g, or t
  modified_base (318)..(318): a, c, t, g, unknown or other
  misc_feature (318)..(318): n is a, c, g, or t
  modified_base (363)..(363): a, c, t, g, unknown or other
  misc_feature (363)..(363): n is a, c, g, or t
  modified_base (372)..(372): a, c, t, g, unknown or other
  misc_feature (372)..(372): n is a, c, g, or t
  modified_base (553)..(553): a, c, t, g, unknown or other
  misc_feature (553)..(553): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgttcttggtttttccngggggagagacgccacctctcctgtgcgccagtcagagtcgttaggacgtaactgctggtatcagcagngcngcagcncanctcnatcttgctcttagnggcctagngacnccgagccgngtcaggcgcgtacggtggctgggtcttcgtacacctcacacctanacaactacngactatctacgacgtacttgtatttagtttcttactgtactagtctagtacgtaggggaactacggttccggtccgttacgtacggttcggggacgggaacgggtaccgtaagggttaccaacccgttaacgaaacggtcgttacggttcgggcttacggaccttaacccttgttccgttnttaccctttctaccttttcccggacttaacgttccgtaagg

SEQ ID NO: 301687 - DNA, 573 bp, Homo sapiens
  misc_feature: GZ8MTXP01CDKB7.8.28.C06.1.454.CMB.2.raw
  modified_base (195)..(195): a, c, t, g, unknown or other
  misc_feature (195)..(195): n is a, c, g, or t
  modified_base (236)..(236): a, c, t, g, unknown or other
  misc_feature (236)..(236): n is a, c, g, or t
  modified_base (264)..(264): a, c, t, g, unknown or other
  misc_feature (264)..(264): n is a, c, g, or t
  modified_base (267)..(267): a, c, t, g, unknown or other
  misc_feature (267)..(267): n is a, c, g, or t
  modified_base (280)..(280): a, c, t, g, unknown or other
  misc_feature (280)..(280): n is a, c, g, or t
  modified_base (285)..(285): a, c, t, g, unknown or other
  misc_feature (285)..(285): n is a, c, g, or t
  modified_base (296)..(296): a, c, t, g, unknown or other
  misc_feature (296)..(296): n is a, c, g, or t
  modified_base (351)..(351): a, c, t, g, unknown or other
  misc_feature (351)..(351): n is a, c, g, or t
  modified_base (369)..(369): a, c, t, g, unknown or other
  misc_feature (369)..(369): n is a, c, g, or t
  modified_base (388)..(388): a, c, t, g, unknown or other
  misc_feature (388)..(388): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccacctctcctgtggcggccaggtcaggagngttagacgacttagctggtatcagcagngcnggcaggctccganctctnatctttggacnctttacagggaccagtggaactcccgagcctaggttcagcgactaggtcggtacngggcttcgtacaacttcnctaaccatacgaactacgnactatccgtagacgtctttgacttagtttctgtctactacgacgtacgtacgtacggtagtacgtcgtaccgtacgtacgtacggacggacggacgtacggtacggtacgtacgtaacgtaacgttgtacgcgtcgtcgaccgttcgttcttcgtcgtaactctccgttccgtccgttaacgtcg

SEQ ID NO: 301688 - DNA, 736 bp, Homo sapiens
  misc_feature: GZ8MTXP01CO5AL.8.28.C06.1.454.CMB.2.raw
  modified_base (184)..(184): a, c, t, g, unknown or other
  misc_feature (184)..(184): n is a, c, g, or t
  modified_base (207)..(207): a, c, t, g, unknown or other
  misc_feature (207)..(207): n is a, c, g, or t
  modified_base (213)..(213): a, c, t, g, unknown or other
  misc_feature (213)..(213): n is a, c, g, or t
  modified_base (216)..(216): a, c, t, g, unknown or other
  misc_feature (216)..(216): n is a, c, g, or t
  modified_base (491)..(491): a, c, t, g, unknown or other
  misc_feature (491)..(491): n is a, c, g, or t
  modified_base (520)..(520): a, c, t, g, unknown or other
  misc_feature (520)..(520): n is a, c, g, or t
tcagctcgcgtgtccacgaccggtgctcgatttagagctcacgtattggggtttggggagagctctgggggaggaactgctcagttaggacccagacggaaccatggaagccccagcgcagcttctcttcctcctgctactctggctcccagagatcattggagaagtggtgatgacacagtcnccggtcaccctgtctgttttccngggganganccacctctcctgtcgcgcagtcagagcgttaggactacttagcctaggtatcagcaaggacggcctaggccgtaaggccctcccgaagtacctccctacacgttctttacgggccttaccctttaaggaccggggcctagggtacgtaaccctccgaacggtccctaggggttaccacgggcggcctaggggtttaccgggccgttaagggtacctttccgggtaccaccttacacccaactaactactaaactaaccctagaactaacgtacgnggtaacttacgttactacttaagtttttnttacgtacgtacggtaacgtcgtacgtacgttaggaccgtaccgtccggttacccgtttacccggtacggtttaccggggtacgggtaacggtaaccggtaaacgggttaccgtaaacccgttaaacggtaaaacccgtaacggttccgggttacgttaccgtaacggtaccctaacgttaccgttcgttaccggtttaaccttaacccggtaacc

SEQ ID NO: 301689 - DNA, 524 bp, Homo sapiens
  misc_feature: GZ8MTXP02F2UE2.8.28.C06.1.454.CMB.2.raw
  modified_base (212)..(212): a, c, t, g, unknown or other
  misc_feature (212)..(212): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtctgtttttcctgggganagagccaccctctcctgtgcggccagtcagagcgttaggacgaacttagcctggtatcagcagaggcctggccaggctcccagactcctcatctttggcgtcctttaacagggccagtggaaatcccagccaggttcagcggcagtgggtctggggacttcgtcactctcaccatcaataacctgacaatctgacgtactttgctagtttatttctgtcagcagtctagaagactggccgttcacgtttcgggcggtagggaccaaagggtcgacctacaaacgaactgtggctgcacactctgtcttctac

SEQ ID NO: 301690 - DNA, 511 bp, Homo sapiens
  misc_feature: GZ8MTXP02HMY23.8.28.C06.1.454.CMB.2.raw
  modified_base (479)..(479): a, c, t, g, unknown or other
  misc_feature (479)..(479): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctggggacttcgttcactctcacatcaataacctgcaaatctgacgactttgctagtttattctgtcagcagtctgaagtactggccgttcactttcggcggtagggaccaaggtgactcaaacgaactgnggctgcacatctgtctcactcttcccgcactc

SEQ ID NO: 301691 - DNA, 529 bp, Homo sapiens
  misc_feature: GZ8MTXP02GB193.8.28.C06.1.454.CMB.2.raw
  modified_base (201)..(201): a, c, t, g, unknown or other
  misc_feature (201)..(201): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctgggganagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgtcactctcacatcaataacctgcaatctgacgactttgctagtttattctgtcagcagtctgaagtactgggtccgttcacgtttcggggcggtacgggaccaagggtcggacctacgaaaacgaacgtggtacggctcgcaccatcctgtctcactccttccgctatc

SEQ ID NO: 301692 - DNA, 515 bp, Homo sapiens
  misc_feature: GZ8MTXP02JXUSQ.8.28.C06.1.454.CMB.2.raw
  modified_base (199)..(199): a, c, t, g, unknown or other
  misc_feature (199)..(199): n is a, c, g, or t
  modified_base (340)..(340): a, c, t, g, unknown or other
  misc_feature (340)..(340): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgttttcctgggganagagccaccctctcctgtgcggccagtcagagcgttaggacgaacttagcctggtatcagcagaggcctggccaggctcccagactcctcatctttggctcctttaacagggcccagtggaatcccagccaggtcagcggnagtggtctgggacttcgtcactctcaccatcaataacctgacaatctgacgactttgctagtttattctgtcagcagtctgaagactggccgttcactttcgggacggtagggacctaagggtgacctacgaaacgactgtcggctcgcaccgatctgtctcactctccgcatcg

SEQ ID NO: 301693 - DNA, 572 bp, Homo sapiens
  misc_feature: GZ8MTXP02IENF6.8.28.C06.1.454.CMB.2.raw
  modified_base (312)..(312): a, c, t, g, unknown or other
  misc_feature (312)..(312): n is a, c, g, or t
  modified_base (382)..(382): a, c, t, g, unknown or other
  misc_feature (382)..(382): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgttttcctggggagagagccaccctctcctgtgcggccagtcagagcgttaggacgaacttagcctggtatcagcagaggcctggccaggctcccagactcctcattctttggcgtcctttaacgngggccagtggaatcccagccaggtcagcggcagtggtctgggtacttcgtcactctcaccatcaataccnacatcagacgtacttgacttagtttacttctgtcagtctacgttctagaagtacgtcggtcccgttacgtacggtttcgggacgggtacgggtaaccgtaaggtaccggaacctaacgaaaacgtacgtggtacgtactcgacctacctatcgttcgttccttactaccttcccgttcccgacttactcg

SEQ ID NO: 301694 - DNA, 534 bp, Homo sapiens
  misc_feature: GZ8MTXP02JORPX.8.28.C06.1.454.CMB.2.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgtcactctcacatcaataacctgcaatctagacgactttgctagtttattctgtcagcagtctgaagactggtccgttcacgtttcggcggtacgggaccgaaggtacggacctacgaaacgactgtacggctacgcacgactcgtcgttctactactccttcccgcctactacg

SEQ ID NO: 301695 - DNA, 561 bp, Homo sapiens
  misc_feature: GZ8MTXP02INOW5.8.28.C06.1.454.CMB.2.raw
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggcctcccagactcctcatctttggctcctttaacagggccagtggaatcccagccaggtcagcggcaggtgggtctggggtacttcgtcactctcaccatacaaataaccctgacaaatctagacgtactttgactagtttatttctgttcagtcagtctagaagtacgttcggtccgttctacgtttcggggacgggtaacggggaccgaaaggggtcggaaccctacgaaaacggtactaggtaggatcgcaaccatctcgtcctttactac

SEQ ID NO: 301696 - DNA, 521 bp, Homo sapiens
  misc_feature: GZ8MTXP02I1QI2.8.28.C06.1.454.CMB.2.raw
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgttttcctggggagagagccaccctctcctgtgcggccagtcagagcgttaggacgaacttagcctggtatcagcagaggcctggccaggctcccagactcctcatctttggcgtcctttaacagggccagtggaatcccagccaggttcagcggcagtgggtctggggacttcgtcactctcacatcaataacctgcaatctgacgtactttgcgtttattctgtcagcagtctgaagactggccgttcacgtttcggcggagggaccgaaaggtcggaacctcgaaaacgactgtaggctgcaccatctgtcttcactccttcccgctactctg

SEQ ID NO: 301697 - DNA, 528 bp, Homo sapiens
  misc_feature: GZ8MTXP02GGXR7.8.28.C06.1.454.CMB.2.raw
  modified_base (195)..(195): a, c, t, g, unknown or other
  misc_feature (195)..(195): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtggtctgggacttcgttcactctcaccatacaatacctgacaatctgacgacttgctagttattctgtcagctagtctagaagtacgtggtccgttcacgtttcggacgggtacgggacgaaggtcggaacctacgaaaacgaactgtacgctcgcacatcgtgtctcactcctaccgccatcg

SEQ ID NO: 301698 - DNA, 588 bp, Homo sapiens
  misc_feature: GZ8MTXP02G4825.8.28.C06.1.454.CMB.2.raw
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtcttgtttttcctggggagagagccaccctctcctgtgcggccagtcagagcgttaggacgaacttagcctggtatcagcagaggcctggacaggctcccagactcctcatctttggcgtcctttaacagggccaggtggaactcccagcccaggttcagcggcaggtgggtctgggacttcgtcactctcacatcaaataacctgacaatctagacgtactttgctagttttatttctgtcagctagtcttagaacgtactgggtccgttctacgtttcgggacgggtaaggggacccgtaagggtacggaacccgttaacgaaaaccggtaacttggtacggcgttcgaccgtaccgtaattccgtcgttccttactacttccctttaccccgcctaacttccg

SEQ ID NO: 301699 - DNA, 583 bp, Homo sapiens
  misc_feature: GZ8MTXP02FV8AJ.8.28.C06.1.454.CMB.2.raw
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagacctcctcatctttggcgtcctttaacgagggccaggtcggaaactcccagccaggttcagcggcagtgggtctggggacttcgttcactctcaccatacaataacctgcaatctgacgtactttgctagttatttctgttcagctagtctagaacgactggtccgtttcgacgtttcggggacggggaacgggtaacccgaaaaggggttcggaacccgttacgaaaaccgtaaaccgttcggtggaccttcggacctaacccgtattcctcggtcctttctaaccg

SEQ ID NO: 301700 - DNA, 533 bp, Homo sapiens
  misc_feature: GZ8MTXP02JWC83.8.28.C06.1.454.CMB.2.raw
  modified_base (301)..(301): a, c, t, g, unknown or other
  misc_feature (301)..(301): n is a, c, g, or t
  modified_base (310)..(310): a, c, t, g, unknown or other
  misc_feature (310)..(310): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcncctttaacngggccagtggaactcccagccaggttcaggcggcaggtgggtctggggacttcgtcactctcaccatcaataacctgacaatctgacgtactttgctagtttattctgtcagcagtctagaagtactggccgttcacgtttcgggacgggagggaccaagggtcggacctacgaaacgaactggtcggctcgcaccatctgtcttcactccttcccgctatcg

SEQ ID NO: 301701 - DNA, 506 bp, Homo sapiens
  misc_feature: GZ8MTXP02GF7CU.8.28.C06.1.454.CMB.2.raw
  modified_base (194)..(194): a, c, t, g, unknown or other
  misc_feature (194)..(194): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccacctctcctgtgcggccagtcagagcgttaggacgaacttagcctggtatcagcagaggcctggccaggctcccagactcctcatctttggcgcctttaacagggccagtggaatcccagccaggtcagcggcagtgggtctgggacttcgtcactctcacatcaataacctgcaatctgacgactttgctagtttattctgtcagcagtctgagactggccgttcacgtttcggcggtagggaccaaggtggacctgaaacgactgtcgctgcaccatctgtcttcactctccgcactc

SEQ ID NO: 301702 - DNA, 574 bp, Homo sapiens
  misc_feature: GZ8MTXP02H0IE5.8.28.C06.1.454.CMB.2.raw
  modified_base (195)..(195): a, c, t, g, unknown or other
  misc_feature (195)..(195): n is a, c, g, or t
  modified_base (263)..(263): a, c, t, g, unknown or other
  misc_feature (263)..(263): n is a, c, g, or t
  modified_base (405)..(405): a, c, t, g, unknown or other
  misc_feature (405)..(405): n is a, c, g, or t
  modified_base (469)..(469): a, c, t, g, unknown or other
  misc_feature (469)..(469): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttccgnggggagagagcccaccctctcctgtgcggccagtcagagcgttaggacgaattgcctggatcagcagngctggccaggctcccagactcctcacttctttcggccgtacctttaaacgacggggccaggtaggaactcccgaggccaggttcaggcggcgacggtggggtctggggtactttcggtcactcctcaacactacaactaccngacaatcagacgtacttgcttagtttattctgtactagcagtctagaagtacgtggtcccgttntacgtttcggacgggtacggacgtaagggtcgtaacgtacgaaacgtaacgtgtacgcgtacgccacctactctcgtcttactacttccttaccccgctactccg

SEQ ID NO: 301703 - DNA, 538 bp, Homo sapiens
  misc_feature: GZ8MTXP02FY02Z.8.28.C06.1.454.CMB.2.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttcctggggagagagccaccctctcctgtgcggccagtcagagcgttaggacgaacttagcctggtatcagcagaggcctggccaggctcccagacctcctcatctttggcgtcctttaacagggccagtggaactcccagccaggtcaacggcaggtgggtctgggacttcgtcactctcaccatcaaactaacctgacaatctagacgtactttgctagtttattctgtcagcagtctagaagactggccttcacgtttcgggcggacgggaccaagggtcgaacctacgaaaacgactggtaggctacgcaccatctgtcttcacttccttcccgctactctag

SEQ ID NO: 301704 - DNA, 516 bp, Homo sapiens
  misc_feature: GZ8MTXP02FYGIS.8.28.C06.1.454.CMB.2.raw
  modified_base (308)..(308): a, c, t, g, unknown or other
  misc_feature (308)..(308): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttagacgacttagcctggtatcagcagaggcctggccaggctcccagactcctcatctttggcgcctttaacngggccagtggaatcccagccaggtcagcgcagtggtctgggacttcgttcactctcaccatcaataacctgcaaatctgacgactttgctagttatttctgtcagcagtctgagactgcgttctacgttcggcggacgggaccgaggtacggacgtacgaaacgaacgtagtggcgtgcacactctcgtctctactctcctctactcg

SEQ ID NO: 301705 - DNA, 557 bp, Homo sapiens
  misc_feature: GZ8MTXP02HAI4C.8.28.C06.1.454.CMB.2.raw
  modified_base (211)..(211): a, c, t, g, unknown or other
  misc_feature (211)..(211): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtctgttttcctgggganagagccaccctctcctgtgcggccagtcagagcgttaggacgaacttagcctggtatcagcagaggcctggccaggcctcccagacctcctcatctttggcgtacctttaacgagggccagtggaactcccagccaggtcagcgcagtgggtctggggacttcgtcactctcaccatcaataacctgacaatctagacgtactttgctagtttattctgtcagtctagtctagaagtactcgggtccgttcgtacgtttcgggacgggtacgggaaccgtaagggtacggaacccgtacgaaaacgtacgtggtacggctaacgccaccatcgtcgttccttctac

SEQ ID NO: 301706 - DNA, 533 bp, Homo sapiens
  misc_feature: GZ8MTXP02I7NUH.8.28.C06.1.454.CMB.2.raw
  modified_base (199)..(199): a, c, t, g, unknown or other
  misc_feature (199)..(199): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgttttcctgggganagagccaccctctcctgtgcggccagtcagagcgttaggacgaacttagcctggtatcagcagaggcctggccaggctcccagacctcctcatctttggcgtcctttaacagggccagtggaatcccagccaggttcagcggcagtgggtctgggacttcgttcactctcaccatcaataacctgcaaatctgacgtactttgctagtttatttctgtcagctagtctagaagtactggccgtttcacgtttcgggacggtacgggaccaaggtcggacctcgaaaacgtactaggtcgcgtcgcacatctgtctctactccttcccgctatcg

SEQ ID NO: 301707 - DNA, 586 bp, Homo sapiens
  misc_feature: GZ8MTXP02HQMIZ.8.28.C06.1.454.CMB.2.raw
  modified_base (266)..(266): a, c, t, g, unknown or other
  misc_feature (266)..(266): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgttttcctggggagagagccaccctctcctgtgcggccaggtcaggagcgttaggacgaacttagcctggtatcagcagnggcctggccaggctcccagactcctcattctttggcgtcctttaacgaggggccagtggaactcccagccaggttcagcggcaggtgggtctgggacttcgtcactctcaccatccaaataacctgaccaatctagacgtacttgctagtttattctgtcagctagttctaggaacgtcgtcggtccgttctaccgtttcgggacgggaacgggaccgtaaagggtcggtaaccctacgaaaacggtacgttggtacggtctcggccaaccgttactcgttaacgttccttactacgttcccttacccgtacctacgtcg

SEQ ID NO: 301708 - DNA, 563 bp, Homo sapiens
  misc_feature: GZ8MTXP02F2ZY9.8.28.C06.1.454.CMB.2.raw
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgtcctttaacagggccaggtggaaactcccagccaggttcagcggcagtgggtctggggacttcgttcactctcaccatcaaataaaccctgacaaatctagacgtactttgctagtttatttctgtcagtcaggtctagaaacgacgtggcccgtttcacgtttcgggcggaacgggtacccgtaagggtcggaacccttacgaaaaccggtaacgttggtaggctaaggccaaccatctcgtctttctac

SEQ ID NO: 301709 - DNA, 585 bp, Homo sapiens
  misc_feature: GZ8MTXP02IOEGP.8.28.C06.1.454.CMB.2.raw
  modified_base (201)..(201): a, c, t, g, unknown or other
  misc_feature (201)..(201): n is a, c, g, or t
  modified_base (311)..(311): a, c, t, g, unknown or other
  misc_feature (311)..(311): n is a, c, g, or t
  modified_base (387)..(387): a, c, t, g, unknown or other
  misc_feature (387)..(387): n is a, c, g, or t
  modified_base (395)..(395): a, c, t, g, unknown or other
  misc_feature (395)..(395): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctgggganagagccaccctctcctgtgcggccagtcagagcgttaggacgaacttagcctggtatcagcagaggcctggccaggctcccagacctcctcatctttggctcctttaacngggccagtggaatcccagccaggttcagcggcaggtgggtctggggacttcgttccactctcaccatcaaataccngacaatcngactactttgctagttttattctgtcagctagtctaggaaagtcgtgggtccctttacacgtttcggggacgggtacgggaacctaaggggttccggaaacccttaacgaaaacggaactttgggacggacttacggaccctacctagttccttgttcttacctacttccctttccccgccttaattccg

SEQ ID NO: 301710 - DNA, 549 bp, Homo sapiens
  misc_feature: GZ8MTXP02IT5W3.8.28.C06.1.454.CMB.2.raw
  modified_base (195)..(195): a, c, t, g, unknown or other
  misc_feature (195)..(195): n is a, c, g, or t
  modified_base (311)..(311): a, c, t, g, unknown or other
  misc_feature (311)..(311): n is a, c, g, or t
  modified_base (513)..(513): a, c, t, g, unknown or other
  misc_feature (513)..(513): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgcggccagtcagagcgttaggacgaacttagcctggtatcagcagaggcctggccaggctcccagacctcctcatctttggctcctttaacngggccagtggaatcccagccaggtcagcggcagtggtctggacttcgtcactctcacatcaatacctgcaatctgacgtactttgctagtttattctgtcagctagtctagaacgtactggtccgttctacgtttcgggacgggtacgggaaccaagggtacggacctacgaaaacggacgtggtcggtactggaccaaccnttccgtgtcctttacacttccttccccgcctatccg

SEQ ID NO: 301711 - DNA, 557 bp, Homo sapiens
  misc_feature: GZ8MTXP02IO40V.8.28.C06.1.454.CMB.2.raw
  modified_base (205)..(205): a, c, t, g, unknown or other
  misc_feature (205)..(205): n is a, c, g, or t
  modified_base (211)..(211): a, c, t, g, unknown or other
  misc_feature (211)..(211): n is a, c, g, or t
  modified_base (380)..(380): a, c, t, g, unknown or other
  misc_feature (380)..(380): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtctgttttccngggganagagccaccctctcctgtgcggccagtcagagcgttaggacgaacttagcctggtatcagcagaggcctggccaggctcccagactcctcatcttggcgcctttaacgagggccagtggaactcccagccaggtcagcggcaggtgggtctggggacttcggtcactcncaccatcaataacctgacaatctagacgtactttgctagtttatttctgtcagctagtctagaagtacgtggtccgttactacgtttcgggcgggtacgggtaccgaagggttcggaccgttacgaaaacgtaacgtacggtcggtctcggacaccgtacttctcgttcttactacc

SEQ ID NO: 301712 - DNA, 542 bp, Homo sapiens
  misc_feature: GZ8MTXP02G43CH.8.28.C06.1.454.CMB.2.raw
  modified_base (212)..(212): a, c, t, g, unknown or other
  misc_feature (212)..(212): n is a, c, g, or t
  modified_base (322)..(322): a, c, t, g, unknown or other
  misc_feature (322)..(322): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtctgtttttcctgggganagagccaccctctcctgtgcggccagtcagagcgttaggacgaacttagcctggtatcagcagaggcctggccaggctccccagactcctcatctttggcgcctttaacngggccagtggaatcccagcaggtcagcgcagtggtctgggacttcgtcactctcaccatcaataacctgacaatctgacgactttgctagtttatttctgtcagtcagttctagaacgactggtccgttctacgtttcgggacggacgggtacctaagggtcggaaccgtacgaaaacgtaactcggtcggactggcctaacgactactcgttcttctac

SEQ ID NO: 301713 - DNA, 578 bp, Homo sapiens
  misc_feature: GZ8MTXP02IGX1F.8.28.C06.1.454.CMB.2.raw
  modified_base (195)..(195): a, c, t, g, unknown or other
  misc_feature (195)..(195): n is a, c, g, or t
  modified_base (427)..(427): a, c, t, g, unknown or other
  misc_feature (427)..(427): n is a, c, g, or t
tcagctcgcgtgtccacgaccggtgctcgatttagagctcacgtattgggtttgggggaggaactgctcagttaggacccagacggaaccatggaagcccagcgcagcttctcttcctcctgctactctggctcccagagatcattggagaagtggtgatgacacagtctccggtcaccctgtcttgtttttccnggggagagagccaccctctcctgtgcggccagtcagagcgttaggacaacttagcctggtatcagcagaggcctggccaggcctacccacgactcctcatctttggtcgcctttaacacggccagtggaatccacgcacgttcgagcggcgacgtggtcgtggtcgttcgttcactctcacactacaactaacctacacatactacgacgtacttgtactatttatttcttntcagactacgtacgtagtagtacgtacgtcgttacgtacgttacggtacgggacgggaacggtaacggtacggtacgtaacgtaaacgtaacgtagtacgtcgtacgacgactactactcgttcttactactaccttcccgtacctactcg

SEQ ID NO: 301714 - DNA, 569 bp, Homo sapiens
  misc_feature: GZ8MTXP02JVIGX.8.28.C06.1.454.CMB.2.raw
  modified_base (201)..(201): a, c, t, g, unknown or other
  misc_feature (201)..(201): n is a, c, g, or t
  modified_base (312)..(312): a, c, t, g, unknown or other
  misc_feature (312)..(312): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctgggganagagccaccctctcctgtgcggccagtcagagcgttaggacgaacttagcctggtatcagcagaggcctggccaggctcccagactcctcatctttggcgtcctttaacgngggccagtggaactcccagccaggttcagcggcaggtgggtctgggacttcgtcactctcaccatcaataacctgacaatctagacgtactttgctagtttattctgtcagcagtctagaacgtactggccgtttcacgtttcgggcgggtaagggacccgaaagggttcggaacccttacgaaaacggtacgtggtacgggctacggaccacccgattcgtaagtcctttcacttcccttccccgtactacttccg

SEQ ID NO: 301715 - DNA, 587 bp, Homo sapiens
  misc_feature: GZ8MTXP02I8CYI.8.28.C06.1.454.CMB.2.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttattttccngggganagagccaccctctcctgtgcggccagtcagagcgttaggacgaacttagcctggtatcagcagaggcctggccaggctcccagacctcctcatctttggccgtcctttaacagggccaggtggaactccccagccaggttcagcggcaggtgggtctggggactttcgttccactctcacatccaataacctgacaatctgacgtactttgctagtttattctgtcagctagtcttagaagtactcggtccgttactacgtttcgggacggtacgggaccgaagggtcggaccttacgaaaacgtaacgtggtacggaccttacggccaaccgtattccgtaaggttccttaccgtacttccctttaccccgccctaagtttcccg

SEQ ID NO: 301716 - DNA, 556 bp, Homo sapiens
  misc_feature: GZ8MTXP02IVOIM.8.28.C06.1.454.CMB.2.raw
  modified_base (383)..(383): a, c, t, g, unknown or other
  misc_feature (383)..(383): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgtcctttaacgagggccagtggaatcccagccaggttcagcggcaggtggtctgggacttcgtcactctcacatcaataaccngacaatctgacgtactttgctagtttattctgtcagcagtctagaagtactcggtccgttctacgtttcgggacgggacggggaaccgaagggttcggacctacgaaaacgaacgtggtacggctcggaccaccgtaactctgtacttctacttcccttcccgcctacttccg

SEQ ID NO: 301717 - DNA, 639 bp, Homo sapiens
  misc_feature: GZ8MTXP02JN5BJ.8.28.C06.1.454.CMB.2.raw
  modified_base (213)..(213): a, c, t, g, unknown or other
  misc_feature (213)..(213): n is a, c, g, or t
  modified_base (363)..(363): a, c, t, g, unknown or other
  misc_feature (363)..(363): n is a, c, g, or t
tcagctcgcgtgtccacgaccggtgctcgatttagagctcacgtattgggtttggggagagctctgggggaggaactgctcagttaggacccagacggaaccatggaagcccagcgcagcttctcttcctcctgctactctggctcccagagatcattggagaagtggtgatgacacagtctccggtcaccctgtcttgttttccgtgggganagagcccaccctctcctgtgcggccagtcagagcgttaggactaacttagcctggtatcagcagaggcctggccaggctcccagacctcctcatcgtttggcgtacctttaacgagggccaggtggaaactcccagccacggttcagcgntaggtggtctggggtacttcggttcactctcacatacaataacctgacaatctagactactttgctagtttactttcgtgttacagtaccgtagttccgtaagtaaacgtacgttcggggtcccgtttacgtaaccggttttccgggggacggggtaacggggtaaccgtaagggggtcggtaaaccccgttacgaaaaaccggtaaccgtagggtacggtccgttaacggacccgaaaccttacgttaccttacggtttccttcgtttaaccccg

SEQ ID NO: 301718 - DNA, 554 bp, Homo sapiens
  misc_feature: GZ8MTXP02GQ17F.8.28.C06.1.454.CMB.2.raw
  modified_base (195)..(195): a, c, t, g, unknown or other
  misc_feature (195)..(195): n is a, c, g, or t
  modified_base (232)..(232): a, c, t, g, unknown or other
  misc_feature (232)..(232): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgcggccagtcagngcgttaggacgactagctggtatcagcagaggcctggccaggctcccagactcctcatctttggcgtcctttaacagggccagtggaatcccagccaggtcagcggcagtggtctgggacttcgttcactctcaccatacaataacctgacaatctagacgtactttgctatttatttctgtctagctagtagtagtagtacgtcggtcgttacgtacgttcggtacgggacgggaacggtaacggtacggtacgtaacgtaaacgtaacgtacgtcgtcgtacgacacctactctcgtcttactactcctcctcctactcg

SEQ ID NO: 301719 - DNA, 549 bp, Homo sapiens
  misc_feature: GZ8MTXP02G1YPN.8.28.C06.1.454.CMB.2.raw
  modified_base (199)..(199): a, c, t, g, unknown or other
  misc_feature (199)..(199): n is a, c, g, or t
  modified_base (344)..(344): a, c, t, g, unknown or other
  misc_feature (344)..(344): n is a, c, g, or t
  modified_base (518)..(518): a, c, t, g, unknown or other
  misc_feature (518)..(518): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgttttcctgggganagagccaccctctcctgtgcggccagtcagagcgttaggacgaacttagcctggtatcagcagaggcctggccaggctcccagacctcctcatctttggcgtcctttaacgagggccagtggaactcccagccaggttcagcggnaggtgggtctgggacttcgtcactctcacatcaataacctgcaatctgactacttgctagtttattctgtcagcagtctagaagactggccgtttacacgtttcgggacgggtacgggaaccgtaagggtcggaaccctacgaaaaccgtaacgtggtacggctcgcaaccgtntcgtgtcttacacttcctcccgccttactcg

SEQ ID NO: 301720 - DNA, 523 bp, Homo sapiens
  misc_feature: GZ8MTXP02HHXOP.8.28.C06.1.454.CMB.2.raw
  modified_base (339)..(339): a, c, t, g, unknown or other
  misc_feature (339)..(339): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgttttcctggggagagagccaccctctcctgtgcggccagtcagagcgttaggacgaacttagcctggtatcagcagaggcctggccaggctcccagactcctcatctttggcgcctttacagggccagtggaatcccagccaggtcagcggnagtgggctgggacttcgtcactctcaccatcaataacctgcaaatctgacgtactttgctagtttattctgtcagcagtctagaagtactggccgttcacgtttcgggcggagggaccaagggtcgacctcgaaaacgactgtacggctacgcaccatctgtcttcacttcttcccgctactcg

SEQ ID NO: 301721 - DNA, 530 bp, Homo sapiens
  misc_feature: GZ8MTXP02FUNU0.8.28.C06.1.454.CMB.2.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttcctggggagagagccaccctctcctgtgcggccagtcagagcgttaggacgaacttagcctggtatcagcagaggcctggccaggctcccagactcctcatctttggcgtcctttaacgagggccagtggaactccccagccaggttcagcggcagtgggtctgggacttcgtcactctcacatcaataacctgacaatctagacgtactttgctagtttatttctgttcagcagtctgaagtactggtccgttcacgtttcgggacggagggaccaagggtggacctacaaaacgtactgcgctcgcaccatctgtcttcactccttccgcctatc

SEQ ID NO: 301722 - DNA, 559 bp, Homo sapiens
  misc_feature: GZ8MTXP02GRJ2U.8.28.C06.1.454.CMB.2.raw
  modified_base (211)..(211): a, c, t, g, unknown or other
  misc_feature (211)..(211): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtctgttttcctgggganagagccaccctctcctgtgcggccagtcagagcgttaggacgaacttagcctggtatcagcagaggcctggccaggctcccagactcctcatctttggcgtcctttaacagggccagtggaaatccagccaggttcagcgcagtggtctggggacttcgtcactctcaccatacaaataaccctgacaaatctagacgtactttgactagtttatttctgttcagtcagtctagaaacgtacgtggtccgtttcacgttttccgggacgggacggggtaacccgaagggttcggaaccttacgaaaacgtacctagtcggctcggacaccatcctagtccttactacg

SEQ ID NO: 301723 - DNA, 544 bp, Homo sapiens
  misc_feature: GZ8MTXP02HXZ4Y.8.28.C06.1.454.CMB.2.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgtcctttaacagggccagtggaatcccagccaggtcagcggcagtgggtctgggacttcgttcactctcaccatccaaataacctgaccaaatctgacgactttgctagtttatttctgtcagcagtctagaagtactgggtccttctacgtttcgggacggtaagggacctaagggtcggaccttcggaaacgaacgtggtcggctcgcaccatctaagtcttacactccttcccgcctatcg

SEQ ID NO: 301724 - DNA, 540 bp, Homo sapiens
  misc_feature: GZ8MTXP02G6932.8.28.C06.1.454.CMB.2.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacgaacttagcctggtatcagcagaggcctggccaggctcccagactcctcatctttggcgtcctttaacagggccagtggaatcccagccaggtcagcggcaggtgggtctggggacttcgttcactctcacatcaataacctgacatctgacgtacttgctagtttacttctgtcagtctagtctagaacgtactggtaccgttcacgtttcggacggtacgggaccgtaaggtcggacctacgaaaacgacgtgtcggcgtcgcaccgatctgtctctactccttcccgccacttcg

SEQ ID NO: 301725 - DNA, 552 bp, Homo sapiens
  misc_feature: GZ8MTXP02HFG5I.8.28.C06.1.454.CMB.2.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgtcctttaacaggccagtggaactcccagccaggttcagcggcaggtgggtctggggacttcgttcactcctcaccatccaaataacctgaccaatctgacgtatttgctagttttattctgtcagcagtctagaagtacgtggtccgttcaccgtttcgggcgggtacgggaccgaagggtcggaaccctacgaaaacgtaacgtggtacggctgaccaccatcgtgtcttacacttcctccgtccatccg

SEQ ID NO: 301726 - DNA, 525 bp, Homo sapiens
  misc_feature: GZ8MTXP02GNDY7.8.28.C06.1.454.CMB.2.raw
  modified_base (310)..(310): a, c, t, g, unknown or other
  misc_feature (310)..(310): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacngggccagtggaatcccagccaggttcagcggcagtgggtctggggacttcggttcactctcaccatcaaataacctgacaaatctgacgtactttgctagtttattctgtcagcagtctgaagactggtccgttcacgtttcggcggtagggaccaaggtcgacctacgaaaacgactgtcggctgcacatctgtcttcactcctccgctactcg

SEQ ID NO: 301727 - DNA, 549 bp, Homo sapiens
  misc_feature: GZ8MTXP02HR7YW.8.28.C06.1.454.CMB.2.raw
  modified_base (201)..(201): a, c, t, g, unknown or other
  misc_feature (201)..(201): n is a, c, g, or t
  modified_base (382)..(382): a, c, t, g, unknown or other
  misc_feature (382)..(382): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctgggganagagccaccctctcctgtgcggccagtcagagcgttaggacgaacttagcctggtatcagcagaggcctggccaggctcccagactcctcatctttggcgtcctttaacagggccagtggaactcccagcctaggtcagcggcagtgggtctgggcttgtcactctcacatcaataacctnacaatctagacgtactttgcttagtttatttctgtcagcagtctgaaacgtctcggtccgttcacgtttcgggcgggtaggaccgaagggtcgaacctacgaaaacgtaacgtggacgtctacggccacctatcgtcgttcttactactcctttccccgctactccg

SEQ ID NO: 301728 - DNA, 598 bp, Homo sapiens
  misc_feature: GZ8MTXP02JRJ2F.8.28.C06.1.454.CMB.2.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggcctcccagacctcctcattcgtttggccgtaccctttaacgacgggccaggtcggaactccccgagccgaggttcaggcggcacggtgggtcgtggggtacttcgtcactcctacactatacaaataacctgacctaatcgtagacgtactttgacttagtttactttctgtacagctagtctagaacgtacgttcggtccgtttacacgtttccggggacgggtaacggggaacctaaggggttcgtaaccttaacgaaaacgtaacgtggtacggctcgaccacctatctgttcctacgtactcctccccgctactccg

SEQ ID NO: 301729 - DNA, 588 bp, Homo sapiens
  misc_feature: GZ8MTXP02GT71K.8.28.C06.1.454.CMB.2.raw
  modified_base (311)..(311): a, c, t, g, unknown or other
  misc_feature (311)..(311): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgtcctttaacngggccagtggaatcccagccaggttcagcggcaggtgggtctgggacttcgtcactctcacatcaataacctgacaatctgacgtactttgctagtttactttctgtcagtcagtctagaagtacgtcggtccgttcaacgtttccgggacggtacggggaccctaaggggttcggaacccttacgaaaaccggtaacgtggtacggcttacggaccaaccctaattccgtaaggttccctttactacttcccgttacccccgtcctaactttcccg

SEQ ID NO: 301730 - DNA, 602 bp, Homo sapiens
  misc_feature: GZ8MTXP02I1IHH.8.28.C06.1.454.CMB.2.raw
  modified_base (206)..(206): a, c, t, g, unknown or other
  misc_feature (206)..(206): n is a, c, g, or t
  modified_base (212)..(212): a, c, t, g, unknown or other
  misc_feature (212)..(212): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacgaacttagcctggtatcagcagaggcctggccaggcctccccagacctcctcattcgtttcggccgtaccctttaacgacggggtcccaaggtcggaaactccccgagccctaggttccaggcggctaggtcggggtctgggggtaccttcggtcacttctcaccatacaaataacctgacaatctagtacgtactttgacttagtttatttctgttcagtctagtctagaacgtacgtcggtccgttcgtacgtttcgggacgggtaacgggtaccgtaagggtacggtaaccgtacgtaaacggtaaactcggtacggctcgacaacctactcgtcgttcttactac

SEQ ID NO: 301731 - DNA, 529 bp, Homo sapiens
  misc_feature: GZ8MTXP02I3VV7.8.28.C06.1.454.CMB.2.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatccccagccaggttcagcggcagtggtctgggacttcgtcactctcaccatccaataacctgcaatctgacgtactttgctagtttatttctgtcagcagtctgaacgactgggccgtttcacgtttcggcggtagggaaccagggtacgacctcgaaaacgactagtcggctcgacaccatctgtccttcactcttcccgctactc

SEQ ID NO: 301732 - DNA, 544 bp, Homo sapiens
  misc_feature: GZ8MTXP02GDLMF.8.28.C06.1.454.CMB.2.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgtcactctcaccatcaataacctgacaaatctagacgtactttgctagtttatttctgtcagcagtctagaagtactggtccgttcaccgtttcgggacgggtaacgggacccgaagggttcggaaccctacgaaaacgtaacgtggtacggctcgcaccatctgtcttctactcctccgcatcg

SEQ ID NO: 301733 - DNA, 588 bp, Homo sapiens
  misc_feature: GZ8MTXP02GYF0T.8.28.C06.1.454.CMB.2.raw
  modified_base (212)..(212): a, c, t, g, unknown or other
  misc_feature (212)..(212): n is a, c, g, or t
  modified_base (243)..(243): a, c, t, g, unknown or other
  misc_feature (243)..(243): n is a, c, g, or t
  modified_base (399)..(399): a, c, t, g, unknown or other
  misc_feature (399)..(399): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtctgtttttcctgggganagagccaccctctcctgtgcggccagtcagngcgtagacgatagctgtatcagcagaggcctggccaggctcccagactcctcatctttggcgtcctttaacgaggggtccagtcggaaactccccgagccaggttcagcggcaggtgggtctggggacttcgtcactctcaccatacaataacctnacatctagactacttgacttagtttactttctgtctagtcgtagtacgtagaacgtacgtcggtccgttacgtaccggtttcggggacgggtaacgggtaaccgtaacgggtacggtaaccgtaacgaaaacggtacgtcggtacggtacgtaacgacctaccgtacttcgtacgttaccttacgtacc

SEQ ID NO: 301734 - DNA, 545 bp, Homo sapiens
  misc_feature: GZ8MTXP02HOWHE.8.28.C06.1.454.CMB.2.raw
  modified_base (201)..(201): a, c, t, g, unknown or other
  misc_feature (201)..(201): n is a, c, g, or t
  modified_base (291)..(291): a, c, t, g, unknown or other
  misc_feature (291)..(291): n is a, c, g, or t
  modified_base (312)..(312): a, c, t, g, unknown or other
  misc_feature (312)..(312): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctgggganagtagccaccctctcctgtgcggccagtcagagcgttaggacgaacttagcctggtatcagcagagcctggccaggctcccagactcctnatctttggcgtcctttaaacngggccagtggaatcccagccaggttcagcggcagtggggtctggggactttgtcactctcaccatacaataacctgcaaatctgacgtactttgctagtttatttctgtcagtcagtctgaagtacgtggccgttcacgtttcggcgggagggaccgaaaggtcggaacctacgaaaacgaactggtacggctcggacacctactctcgtcttcactccttcccgcctatccg

SEQ ID NO: 301735 - DNA, 572 bp, Homo sapiens
  misc_feature: GZ8MTXP02GZWVY.8.28.C06.1.454.CMB.2.raw
  modified_base (201)..(201): a, c, t, g, unknown or other
  misc_feature (201)..(201): n is a, c, g, or t
  modified_base (310)..(310): a, c, t, g, unknown or other
  misc_feature (310)..(310): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctgggganagagccaccctctcctgtgcggccagtcagagcgttaggacgaacttagcctggtatcagcagaggcctggccaggctcccagactcctcatctttggctcctttaacngggccagtggaatcccagccaggttcagcggcaggtgggtctgggacttcgtcactctcacatacaataacctgacaaatctagacgtactttgctagtttattctgtcagcagttctagaagtactcgggtccgttacgtacgtttcgggcgggtaagggaccgtaagggttcggaccttaacgaaaacgtaactggtacggtcgtacgacctaaccgacttcgtcgttacttctacttcccgtttcccgcctaacttccg

SEQ ID NO: 301736 - DNA, 705 bp, Homo sapiens
  misc_feature: GZ8MTXP02IIS9V.8.28.C06.1.454.CMB.2.raw
  modified_base (473)..(473): a, c, t, g, unknown or other
  misc_feature (473)..(473): n is a, c, g, or t
  modified_base (660)..(660): a, c, t, g, unknown or other
  misc_feature (660)..(660): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagtcgtagactaactagcgtggtatcgagcgaggacggccgtcggaccgacggtcctacccgagtacctccctactactttcgtttcggccgtttaaccgtttaacggacggggtacctagggtacggtaacctacccgacgtaccgtacggttaccgacgggcggacgtacggggttcggggtcggtacggggtacctttcgttaccaccttctaccaacctaatacctaaaactaccgtntaacctaaacttcgacggtaaacttcgtttgtaacctttagtttttacttcgttcgtacagctaaagttcgtaaaggaaacgttcgtcgggttccgttacttaccgggttcgggacgggtaacggtaaccggtaaggtccgtaacctaacgaaaacgtacgttggcggtactacgacctaaaccttnttacgttcgttacttactacctttcccgtacccgtacttacgtcg

SEQ ID NO: 301737 - DNA, 619 bp, Homo sapiens
  misc_feature: GZ8MTXP02F9APH.8.28.C06.1.454.CMB.2.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgttttcctggggagagagccaccctctcctgtgcggccagtcagagcgttaggacgaacttagcctggtatcagcagaggcctggccaggctcccagactcctcatctttggcgcctttaacgagggccagtggaatcccagccaggttcagcggcagtgggtctgggacttcgtcactctcaccatccaataacctgacaaatctagacgtactttgacttagtttatttctgttcagctaagttctagaaagtactcggtacccgttactaaccgtttcggggacggtaacgggggtaaccctaaaggggtcggtaacccgttacgaaaaaccggtaaaccgtaggttcgggaccgttacgcccgtaaaacccactttaccgttcggttcctttaccgtaactttccctttcccccgacctaactttcccg

SEQ ID NO: 301738 - DNA, 603 bp, Homo sapiens
  misc_feature: GZ8MTXP02I1KNA.8.28.C06.1.454.CMB.2.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttcctggggagagagccaccctctcctgtgcggccagtcagagcgttaggacgaacttagcctggtatcagcagagcctggccaggctccagacctcctcatctttggcgtcctttaacgagggccaggtcggaaactccccgagccctaggttcaggcggcaggtgggtctggggacttcgtcactctcacatacaactaacctgacaatcagacgtactttgacttagttttacttctgttcagtctagttccttaggaaacgttcgtacgggtcccgtttacgtaaccgtttcggggacgggtaacggggacccaaaggggtcggaaccctacgaaaacggtacgtggtcggtacctcgaccacctagttcctcgttccttactacttccctttccccgcctaattccg

SEQ ID NO: 301739 - DNA, 559 bp, Homo sapiens
  misc_feature: GZ8MTXP02GVM20.8.28.C06.1.454.CMB.2.raw
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
  modified_base (552)..(552): a, c, t, g, unknown or other
  misc_feature (552)..(552): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccngggganagagccaccctctcctgtgcggccagtcagagcgttaggacgaacttagcctggtatcagcagagcctggccaggcctcccagacctcctcattctttggccgtcctttaacgacgggccagtggaactcccgagccaggtcagcggcaggtgggtctgggacttcgtcactctcacatacaatacctgacaatctagacgtactttgcttagtttatttctgtcagctagtctagaagtcgtcggtccgttctacgtttcgggacgggtaagggaccgaagggtcggacctacgaaaacgtacgtggtacggctacgaccacctatcgtgttctacacttccctacccnctactcg

SEQ ID NO: 301740 - DNA, 567 bp, Homo sapiens
  misc_feature: GZ8MTXP02F7BPR.8.28.C06.1.454.CMB.2.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagacctcctcatctttggcgtcctttaacagggccagtggaatcccagccaggttcagcggcagtgggtctggggacttcgtcactctcaccatcaataacctgacaatctgacgactttgctagtttatttctgtcagcagttctagaaacgctcggccgttcaccgtttcgggcggacgggaccaagggttcggaaccgttacgaaaacgtaacgtggtcggactcggaccacctagttcctaacgttcctttcgacttcccgtttaccccgcctacttcccg

SEQ ID NO: 301741 - DNA, 582 bp, Homo sapiens
  misc_feature: GZ8MTXP02JG36V.8.28.C06.1.454.CMB.2.raw
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgttttcctggggagagagccaccctctcctgtgcggccagtcagagcgttaggacgaacttagcctggtatcagcagaggcctggccaggctcccagactcctcatctttggcgtcctttaacagggccaggtggaactcccagccaggttcagcggcaggtgggtctggacttcgtcactctcacctatacaataacctgactaaatctagacgtactttgcttagtttattctgtcagtctagtctaggaacgtacgtcgggtcccgttacgtacgtttccgggacgggacgggtaaccgaagggtacggaaccctacgaaaacgtacgtggtacggtactcggaccacctactcgtcgttaccttcgtacttccgtttccccgacctacttccg

SEQ ID NO: 301742 - DNA, 655 bp, Homo sapiens
  misc_feature: GZ8MTXP02FM7Q3.8.28.C06.1.454.CMB.2.raw
  modified_base (204)..(204): a, c, t, g, unknown or other
  misc_feature (204)..(204): n is a, c, g, or t
  modified_base (209)..(209): a, c, t, g, unknown or other
  misc_feature (209)..(209): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcacctgtctgttttccnggganagagccacctctcctgtgcggccagtcagagcgttaggacgtaacttagcctggtatcagcaggaggcctggccaggcctccccagacctcctctacttcgtttcggccgtaccctttaaacgacggggccctaagggttcgggaaacctccccgaacggtcccgtaacgggtttccgaagggtccgggcgtaggggttcggggttcgtcgggggtacctttccggttcaccttcctacacctactacaaacttaaccctgactaactcgtacgaccgttactttcgtacttagtttactttcgtgtactagtctaggttctagaaacgtacgttcggtccgttacgtaccggtttcggggacgggtaacgggaaccgtaagggtccggaacctacgaaacggtacgtcggtcgctcgcctaacgtacttcgtcgttccttactcc

SEQ ID NO: 301743 - DNA, 661 bp, Homo sapiens
  misc_feature: GZ8MTXP02G049T.8.28.C06.1.454.CMB.2.raw
  modified_base (195)..(195): a, c, t, g, unknown or other
  misc_feature (195)..(195): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgcggccagtcagagcgttaggacgaacttagcctggtatcagcagaggcctggccaggctcccagacctcctcatctttggcgcctttaacagggccagtggaactcccagccaggttcagcggcaggtgggtctgggacttcgttcactctcacatacaataacctgactaatctagacgtactttgcttagttttattttgactaagtcctaggttctaggaaagtaccgttggtcccgtttacgtaaccgtttccggggacgggtaacgggggtaacccgtaaagggggttccggaaacccgttaacgaaaaacccggtaaagttaccgggtaggggtccttacgggaccctaaaccccgtaagttcccctttaggttcccgttttaccgtaaaccgtttccccgtttcccccgaccttaaactttcgttaaacccggg

SEQ ID NO: 301744 - DNA, 588 bp, Homo sapiens
  misc_feature: GZ8MTXP02IFRB8.8.28.C06.1.454.CMB.2.raw
  modified_base (195)..(195): a, c, t, g, unknown or other
  misc_feature (195)..(195): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgcggccagtcagagcgttaaggacgtaacttagcctggtatcagcagaggcctggccaggctcccagacctcctcatctttggctcctttaacagggccagtggaactcccgagccaggttcagcggctaggtgggtctggggacttcgtcactctcaccatacaactaacctgacaatctgacgtactttgctagtttactttctgtcagctagtctagaaacgtcgtcgggtccttcgtacgtttcgggacgggtacgggaaccaagggttacggaccttaacgaaaacgtaacgttgacgggtcctacggcctaaccctattccgttcgttaccttacctacgttcccgttacccgacctacgtcg

SEQ ID NO: 301745 - DNA, 530 bp, Homo sapiens
  misc_feature: GZ8MTXP02HWSXX.8.28.C06.1.454.CMB.2.raw
  modified_base (322)..(322): a, c, t, g, unknown or other
  misc_feature (322)..(322): n is a, c, g, or t
  modified_base (432)..(432): a, c, t, g, unknown or other
  misc_feature (432)..(432): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtcttgtttttcctggggagagagccaccctctcctgtgcggccagtcagagcgttaggacgaacttagcctggtatcagcagaggcctggccaggctcccagacctcctcatctttggctcctttaanagggccagtggaatcccagccaggtcagcgcagtgggtctggggacttcgttcactctcacatcaaataactgacaatctagacgtacttgctagtttattctgtcagtnagtctagaagacgtggtccgttctacgtttcggcgggacgggacaagggtcggacctacgaaacgtacgtgtaggctgcactactctcgtacttctac

SEQ ID NO: 301746 - DNA, 536 bp, Homo sapiens
  misc_feature: GZ8MTXP02JB5R1.8.28.C06.1.454.CMB.2.raw
  modified_base (195)..(195): a, c, t, g, unknown or other
  misc_feature (195)..(195): n is a, c, g, or t
  modified_base (400)..(400): a, c, t, g, unknown or other
  misc_feature (400)..(400): n is a, c, g, or t
  modified_base (520)..(520): a, c, t, g, unknown or other
  misc_feature (520)..(520): n is a, c, g, or t
  modified_base (530)..(530): a, c, t, g, unknown or other
  misc_feature (530)..(530): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgcggccagtcagagcgttaggacgaacttagcctggtatcagcagaggcctggccaggctcccagacctcctcatctttggcgcctttaacagggccagtcggaatcccagccaggttcagcggcaggtgggtctgggacttcgttcactctcacatacaatacctgacaatctagacgtntttcgctagtttattctgtcagctagtctagagacgtcgggtcttacgtacgttcggacgggtacggaccagggtcgactacgaaaacgacgtgtcggctacgccacagtctgtcttacncttccgtccnctactc

SEQ ID NO: 301747 - DNA, 525 bp, Homo sapiens
  misc_feature: GZ8MTXP02I285R.8.28.C06.1.454.CMB.2.raw
  modified_base (384)..(384): a, c, t, g, unknown or other
  misc_feature (384)..(384): n is a, c, g, or t
  modified_base (402)..(402): a, c, t, g, unknown or other
  misc_feature (402)..(402): n is a, c, g, or t
  modified_base (404)..(404): a, c, t, g, unknown or other
  misc_feature (404)..(404): n is a, c, g, or t
  modified_base (412)..(412): a, c, t, g, unknown or other
  misc_feature (412)..(412): n is a, c, g, or t
  modified_base (414)..(414): a, c, t, g, unknown or other
  misc_feature (414)..(414): n is a, c, g, or t
  modified_base (418)..(418): a, c, t, g, unknown or other
  misc_feature (418)..(418): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgttttcctggggagagagccaccctctcctgtgcggccagtcagagcgttaggacgaacttagcctggtatcagcagaggcctggccaggctcccagactcctcatctttggcgtcctttaacagggccaggtggaaactcccagccaggtcagcggcagtgggtctgggacttcgtcactctcaccatcaataccngcaatctagactactttntntattattntntcanctagtctagtagtacgtcgtcgttcgtacgttcggtacggacggacgaggtagacgtacaacgacgtagtcgcgcgacacactctgtctctactcctcctcctactc

SEQ ID NO: 301748 - DNA, 628 bp, Homo sapiens
  misc_feature: GZ8MTXP02F93FV.8.28.C06.1.454.CMB.2.raw
  modified_base (195)..(195): a, c, t, g, unknown or other
  misc_feature (195)..(195): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgcggccagtcagagcgttaggacgaacttagcctggtatcagcagaggcctggccaggctcccagacctcctcatctttggcgtcctttaacagggccagtggaactcccagccaggtcagcggcaggtggtctgggacttcgtcactctcaccatacaataacctgcaaatctagacgtactttgcttagttatttctagtcagctagtctagtaagtacgtcggtaccgttctaaccgtttcgggacgggtaacggggtacccgtaaaggggtacgggtaaccctaacgtaaaaccggtaaacgttacggtggtaccgttacggacccgaacccgtaacgttaccgttaacgtttcccgtttacctaaaccgtttccccgtttaacccccgtacccttaacgttccg

SEQ ID NO: 301749 - DNA, 553 bp, Homo sapiens
  misc_feature: GZ8MTXP02ISPTX.8.28.C06.1.454.CMB.2.raw
  modified_base (313)..(313): a, c, t, g, unknown or other
  misc_feature (313)..(313): n is a, c, g, or t
  modified_base (364)..(364): a, c, t, g, unknown or other
  misc_feature (364)..(364): n is a, c, g, or t
  modified_base (546)..(546): a, c, t, g, unknown or other
  misc_feature (546)..(546): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttcctggggagagagccaccctctcctgtgcggccagtcagagcgttaggacaacttagcctggtatcagcagaggcctggccaggctcccagacctcctcatctttggcgtcctttaacgnggccagtggaatcccagccaggtcagcggcagtgggtctgggacttcgtcnctctcaccatccaataacctgacaatctgacgtactttgctagttttatttctgtcagctagtctagaacgtacttcgggtccgtttccacgtttccgggacggtacggggaaccaagggtacggacctacgaaaacgacgtaggtcggactgaccaccatctgtcttactactccgtcccnctactcg

SEQ ID NO: 301750 - DNA, 643 bp, Homo sapiens
  misc_feature: GZ8MTXP02G6671.8.28.C06.1.454.CMB.2.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacgaacttagcctggtatcagcagaggcctggccaggctcccagacctcctcatctttggccgtcctttaacgagggccaggtcggaactccccgagccaggttcagcggcaggtgggtctgggacttcgtcactctcacatcaataacctgaccaatctagacgtactttgactagttttattctgtcagtctagtctagaacgtactcgggtacccgtttactaaccgtttcggggacggggtaacggggtaacccgtaaaggggttacgggaaacccttacggaaaaaccggtaaccgttgggttacgggccttacgggaccctaaacccgtacgtttccgttaacggtttccctttaccgtaacgtttcccctttcccccggacccttaactttcccgg

SEQ ID NO: 301751 - DNA, 570 bp, Homo sapiens
  misc_feature: GZ8MTXP02INNBP.8.28.C06.1.454.CMB.2.raw
  modified_base (206)..(206): a, c, t, g, unknown or other
  misc_feature (206)..(206): n is a, c, g, or t
  modified_base (212)..(212): a, c, t, g, unknown or other
  misc_feature (212)..(212): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacgaacttagcctggtatcagcagaggcctggccaggcctcccagactcctcatctttggcgtcctttaacgagggccagtggaatcccagccaggttcagcgcaggtggtctggggacttcgtcactctcacatcaatacctgacatctagacgtacttgactagttatttctgttcagtctagttctagaagtacgtcggtccgtttcgtacgtttcgggacgggtacgggaaccgtaaggggtacggaaccgttacgaaaacggtaaccgtaggtcggactaaggacctaacctactacttcgttcctttactacc

SEQ ID NO: 301752 - DNA, 539 bp, Homo sapiens
  misc_feature: GZ8MTXP02FSU4W.8.28.C06.1.454.CMB.2.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaaacagggccagtggaatcccagccaggttcagcggcaggtgggtctggggacttcgttcactctcaccatcaataacctgcaaatctgacgactttgctagtttatttctgttcagcagtctagaagactgggtccgttacacgtttcgggacgggtaggggacccaaagggtcggaaccctacgaaaacgaactgtcggctgcaccatctgtcttcactcctcccgcatcg

SEQ ID NO: 301753 - DNA, 566 bp, Homo sapiens
  misc_feature: GZ8MTXP02HBPPT.8.28.C06.1.454.CMB.2.raw
  modified_base (206)..(206): a, c, t, g, unknown or other
  misc_feature (206)..(206): n is a, c, g, or t
  modified_base (212)..(212): a, c, t, g, unknown or other
  misc_feature (212)..(212): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacgaacttagcctggtatcagcagaggcctggccaggctcccagacctcctcatctttggcgtcctttaacgagggccaggtcggaaactcccagccaggttcagcggcaggtggtctggggactttcgtcactctcaccatacaataaccctgacaaatctagacgtactttgactatttattctgtcagctagtctagaagtacgtcggtccgttactaccgtttcggggcgggaacggggaacccgtaaggggtacggtaccgtacaaaacggtacgtacgtggcgtggacacctactctcgtcttactccg

SEQ ID NO: 301754 - DNA, 570 bp, Homo sapiens
  misc_feature: GZ8MTXP02JYIBI.8.28.C06.1.454.CMB.2.raw
  modified_base (194)..(194): a, c, t, g, unknown or other
  misc_feature (194)..(194): n is a, c, g, or t
  modified_base (200)..(200): a, c, t, g, unknown or other
  misc_feature (200)..(200): n is a, c, g, or t
  modified_base (313)..(313): a, c, t, g, unknown or other
  misc_feature (313)..(313): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgttttccngggganagagccaccctctcctgtgcggccagtcagagcgttaggacgaacttagcctggtatcagcagaggcctggccaggcctcccagacctcctcatctttggcgtcctttaacgngggccagtggaactcccagccaggtcagcggcaggtggtctggggacttcgtcactctcacctatcaataacctgacaatctagacgtactttgctagtttacttctgtcagcagtctagaagactgggtccgttacaccgtttcgggacgggtacgggaccgtaagggtcggtaaccgtacgaaaacggtaaccgtggtacggcgtcgaccacctacttccgtgttccttacacttcccgttcccgacctactccg

SEQ ID NO: 301755 - DNA, 565 bp, Homo sapiens
  misc_feature: GZ8MTXP02I5TTV.8.28.C06.1.454.CMB.2.raw
  modified_base (311)..(311): a, c, t, g, unknown or other
  misc_feature (311)..(311): n is a, c, g, or t
  modified_base (534)..(534): a, c, t, g, unknown or other
  misc_feature (534)..(534): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccacctctcctgtgcggccagtcagagcgttaggacgaacttagcctggtatcagcagaggcctggccaggctcccagacctcctcatctttggcgtcctttaacngggccagtggaatccccagccaggttcagcggcaggtgggtctgggacttcgtcactctcaccatcaataacctgacaaatctagacgtactttgctagtttactttctgttcagcagttctagaagactcgggtccgtttacaccgtttcgggacgggtaacggggaaccaagggttcgggaaccttacgaaaacggtactggttacggctacggcaacctnttctgtcttcacttccttcccgctattaccg

SEQ ID NO: 301756 - DNA, 598 bp, Homo sapiens
  misc_feature: GZ8MTXP02H01WS.8.28.C06.1.454.CMB.2.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (396)..(396): a, c, t, g, unknown or other
  misc_feature (396)..(396): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacaacttagcctggtatcagcagaggcctggccaggctcccagactcctcatctttggcgtcctttaacgacggggccaggtggaaactcccgagccaggttcaggcggcaggtggggtctggggacttcgttcactctcactatcaaattacccngacaatctgacgtactttgactagtttattctgtcagctagtctgaagtacgttcggtccgtttacgtacgtttcgggacgggtaacgggacctaaagggtacggaacccgttacgaaaacgtacgttaggtacggtacttacggaccaacctaacgtccgttcgtccttacgtacttccctttaccccgtcctaacttccg

SEQ ID NO: 301757 - DNA, 591 bp, Homo sapiens
  misc_feature: GZ8MTXP02GTBIT.8.28.C06.1.454.CMB.2.raw
  modified_base (195)..(195): a, c, t, g, unknown or other
  misc_feature (195)..(195): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgcggccagtcagagcgttaggacaacttagcctggtatcagcagaggcctggccaggcctcccagacctcctcattcgtttggccgtaccctttaaacgaggggcccaggtcggaactccccgagccctaggttcaggcggcacggtgggtctgggacttcgtcactctcacatacaatacctgacaatctagactacttgctagtttacttctgtcagctagtctagaacgtactcggtaccgttctaccgtttcgggacggtaacggggaccgtaagggttcggaacctaacgaaaacgtaacgttggtcggcttacggaccaacctattccgtgttccttacgtacttcccgtcccgtacctacttccg

SEQ ID NO: 301758 - DNA, 549 bp, Homo sapiens
  misc_feature: GZ8MTXP02JLBDG.8.28.C06.1.454.CMB.2.raw
  modified_base (194)..(194): a, c, t, g, unknown or other
  misc_feature (194)..(194): n is a, c, g, or t
  modified_base (200)..(200): a, c, t, g, unknown or other
  misc_feature (200)..(200): n is a, c, g, or t
  modified_base (529)..(529): a, c, t, g, unknown or other
  misc_feature (529)..(529): n is a, c, g, or t
  modified_base (543)..(543): a, c, t, g, unknown or other
  misc_feature (543)..(543): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgttttccngggganagagccaccctctcctgtgcggccagtcagagcgttaggacgaacttagcctggtatcagcagaggcctggccaggcctcccagacctcctcatctttggcgtcctttaacgaggggccagtcggaactcccgagccaggttcagcggcacgtgggtctgggacttcgtcactctcacatacaataacctgacaatctagacctactttgcttagtttacttctgtcagtcagtctagaacgtacgtggtcccgttactacgtttcgggacgggtacgggtaccgaagggtcggaacctacgaaacgtactggtcggactgccacatcngtctcactctcccncactcg

SEQ ID NO: 301759 - DNA, 545 bp, Homo sapiens
  misc_feature: GZ8MTXP02HM16C.8.28.C06.1.454.CMB.2.raw
  modified_base (413)..(413): a, c, t, g, unknown or other
  misc_feature (413)..(413): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggtcagcggcaggtgggtctgggacttcgtcactctcacatcaaataacctgcaaatctgacgtactttgctagtttacttntgtcagctagtctagaaacgtctggtccgtttacacgtttcgggacgggaacgggaccgaaagggtcggaacctacgaaaacgtaacgtgtacggctcgaccaccatctcgtcttcactccttcccgctatc

SEQ ID NO: 301760 - DNA, 598 bp, Homo sapiens
  misc_feature: GZ8MTXP02H3YEI.8.28.C06.1.454.CMB.2.raw
  modified_base (324)..(324): a, c, t, g, unknown or other
  misc_feature (324)..(324): n is a, c, g, or t
  modified_base (422)..(422): a, c, t, g, unknown or other
  misc_feature (422)..(422): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtcttgtttttcctggggagagagccaccctctcctgtgcggccagtcagagcgttaggacaacttagcctggtatcagcagaggcctggccaggctcccagacctcctcatcttggcctcctttaaacgngggccaggtggaaactcccgagccaggttcacggcggcaggtggggtctgggggtacctttgtccactctacaccatacaaataactgacaatcgtanacgtactttgactagtttattctagttccaagtctaagtctagtaacgactcgggttcccgttacgtaccgtttcgggacggtaacggggacctaaaaggggtcggaaacctacgaaaaccggtaacgtcggttaggacgtcggacaaacccgttactacgtcgttaccttactcg

SEQ ID NO: 301761 - DNA, 598 bp, Homo sapiens
  misc_feature: GZ8MTXP02I96LF.8.28.C06.1.454.CMB.2.raw
  modified_base (206)..(206): a, c, t, g, unknown or other
  misc_feature (206)..(206): n is a, c, g, or t
  modified_base (212)..(212): a, c, t, g, unknown or other
  misc_feature (212)..(212): n is a, c, g, or t
  modified_base (553)..(553): a, c, t, g, unknown or other
  misc_feature (553)..(553): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacaacttagcctggtatcagcagacggcctggccaggctcccagacctcctcatctttggcgtcctttaacgagggccaggtcggaaactcccgaagcctaggttcaggcggctaggtcgggtctgggggtacttcggttcaccttctcacatacaactaacctagacaactctacgacgtacttcgactagtttactttcgtgtctagtctagttcgtagtacgtacgtcggtccgtttcaccgtttcgggacgggtacgggaaccgtagggtacgaccgtacgaaacggtacgttacggnggtacctaacggaccaaccgtactaccgtcgttcgtttactaccg

SEQ ID NO: 301762 - DNA, 589 bp, Homo sapiens
  misc_feature: GZ8MTXP02GLKU9.8.28.C06.1.454.CMB.2.raw
  modified_base (196)..(196): a, c, t, g, unknown or other
  misc_feature (196)..(196): n is a, c, g, or t
  modified_base (411)..(411): a, c, t, g, unknown or other
  misc_feature (411)..(411): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccnggggagagagccacctctcctgtgcggccagtcagagcgttaggacgaacttagcctggtatcagcagaggcctggccaggcctcccagacctcctcatctttggccgtacctttaaacgagggcccaggtcggaactccccgagccgtaggttccaggcggcaggtcgggtcgtgggtaccttcgttcacttctcacctataccaaataacctnacaatctgacgtactttgctagtttattctgtcagctagtctagaaacgcgtcggtccgttctacgtttcgggacgggacgggtaaccgaagggtacggacctaacgaaaaccgtaacgtggtcggactcgacctaaccacttccgtgttccttacacttcccttcccggcctatccg

SEQ ID NO: 301763 - DNA, 566 bp, Homo sapiens
  misc_feature: GZ8MTXP02HCPS6.8.28.C06.1.454.CMB.2.raw
  modified_base (194)..(194): a, c, t, g, unknown or other
  misc_feature (194)..(194): n is a, c, g, or t
  modified_base (200)..(200): a, c, t, g, unknown or other
  misc_feature (200)..(200): n is a, c, g, or t
  modified_base (267)..(267): a, c, t, g, unknown or other
  misc_feature (267)..(267): n is a, c, g, or t
  modified_base (275)..(275): a, c, t, g, unknown or other
  misc_feature (275)..(275): n is a, c, g, or t
  modified_base (395)..(395): a, c, t, g, unknown or other
  misc_feature (395)..(395): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgttttccngggganagagccaccctctcctgtgcggccagtcagagcgttaggacgaacttagcctggtatcagcagagcngccaggcncccagactcctcatctttggcgtcctttaacagggccagtggaatcccagccaggtcagcgcagtgggtctgggacttcgtcactctcacatcaaataactgacaatctagactactttnacttatttacttctagtcagtctagtctaggaaacgtacgtcggtaccgttactacgtttcgggacgggtaacgggaaccgtaaagggtacgtaaccgtaacgaaaacgtaacgtggtacgctacgacaacctatcgttaacgtctactacttcccttacccgactactcg

SEQ ID NO: 301764 - DNA, 567 bp, Homo sapiens
  misc_feature: GZ8MTXP02G20GV.8.28.C06.1.454.CMB.2.raw
  modified_base (195)..(195): a, c, t, g, unknown or other
  misc_feature (195)..(195): n is a, c, g, or t
  modified_base (232)..(232): a, c, t, g, unknown or other
  misc_feature (232)..(232): n is a, c, g, or t
  modified_base (265)..(265): a, c, t, g, unknown or other
  misc_feature (265)..(265): n is a, c, g, or t
  modified_base (292)..(292): a, c, t, g, unknown or other
  misc_feature (292)..(292): n is a, c, g, or t
  modified_base (312)..(312): a, c, t, g, unknown or other
  misc_feature (312)..(312): n is a, c, g, or t
  modified_base (539)..(539): a, c, t, g, unknown or other
  misc_feature (539)..(539): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgcggccagtcagngcgttaggacgaacttagcctggtatcagcagnggcctggccaggctcccagacctcctnatctttggctcctttaacgngggccagtggaactcccgagccaggttcaggcggcaggtgggtctggggacttcggtcactctcaccatccaaactacctgacaaatctacgtacgtacgtttgacttagttttactttctgttcagtcctagtcttagagtactgggtacccgttctacgtttcgggacgggtacggaccgaaggtcggaccttacgaaaacgacgtggacggctacgccaccgtntctcgttctactctcctcccgctactcg

SEQ ID NO: 301765 - DNA, 556 bp, Homo sapiens
  misc_feature: GZ8MTXP02I2Y82.8.28.C06.1.454.CMB.2.raw
  modified_base (212)..(212): a, c, t, g, unknown or other
  misc_feature (212)..(212): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtctgtttttcctgggganagagccaccctctcctgtgcggccagtcagagcgttaggacgaacttagcctggtatcagcagaggcctggccaggctcccagacctcctcatctttggcgtcctttaacgagggccagtggaactccagccaggtcagcgcaggtggtctggggacttcgtcactctcaccatacaaataacctgacaatctagacgtactttgcttagtttatttctgtcagtcagtctagaagacgtcggccgttctacgtttcgggacgggtacgggaaccgtaagggtcggaacctacgaaaacgtacgtacggtcggacgtcgaccactacttctacgttcttctaac

SEQ ID NO: 301766 - DNA, 587 bp, Homo sapiens
  misc_feature: GZ8MTXP02IWH8P.8.28.C06.1.454.CMB.2.raw
  modified_base (206)..(206): a, c, t, g, unknown or other
  misc_feature (206)..(206): n is a, c, g, or t
  modified_base (212)..(212): a, c, t, g, unknown or other
  misc_feature (212)..(212): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacgaacttagcctggtatcagcagaggcctggccaggcctccccagacctcctcatctttggcgtcctttaacagggccagtggaaactcccagccaggttcagcggcaggtgggtctggggacttcgtcactctcaccatcaataaccctgacaaatctagaccgtactttgactagtttatttctgttcagtctagttctagaagtacgtcggtccgtttacgtaccgttttcggggacgggtaacggggtaaccgaaacgggtacggaacccgttaacgaaaaccgtaaccgtaggtcggtacgtggccgaacctactctacgttcttactcc

SEQ ID NO: 301767 - DNA, 630 bp, Homo sapiens
  misc_feature: GZ8MTXP02HHK47.8.28.C06.1.454.CMB.2.raw
  modified_base (194)..(194): a, c, t, g, unknown or other
  misc_feature (194)..(194): n is a, c, g, or t
  modified_base (200)..(200): a, c, t, g, unknown or other
  misc_feature (200)..(200): n is a, c, g, or t
  modified_base (312)..(312): a, c, t, g, unknown or other
  misc_feature (312)..(312): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgttttccngggganagagccaccctctcctgtgcggccagtcagagcgttaggacgaacttagcctggtatcagcagaggcctggccaggctcccagacctcctcatctttggcctcctttaacgngggccagtggaactcccagccaggttcagcggcaggtgggtctggggacttcgtcactctcaccatcaatacctgacaatctagtacgtactttgctagtttattctgtcagctagttctagaacgtacgtcgggtcccgtttactaccgtttcgggacgggtaacggggtacccgtaaaggggttccggaacccttaaccggaaaaaccggtaaaccgttcgggttacggaccgttacggacccgtaaccctaacgttccttcggtttaccctttcctaaaccgtttcccctttacccccggccttaacgtttcccg

SEQ ID NO: 301768 - DNA, 547 bp, Homo sapiens
  misc_feature: GZ8MTXP02FRB8R.8.28.C06.1.454.CMB.2.raw
  modified_base (205)..(205): a, c, t, g, unknown or other
  misc_feature (205)..(205): n is a, c, g, or t
  modified_base (211)..(211): a, c, t, g, unknown or other
  misc_feature (211)..(211): n is a, c, g, or t
  modified_base (242)..(242): a, c, t, g, unknown or other
  misc_feature (242)..(242): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtctgttttccngggganagagccaccctctcctgtgcggccagtcagngcgttaggacgaactagcctggtatcagcagaggcctggccaggctcccagactcctcatctttggcgtcctttaacagggccagtggaatcccagccaggttcagcggcaggtgggtctggggacttcggttcacgtctcaccatacaataaccctgacaatctgacgtactttgctagtttatttctgtcagcagtctagaagtacgtggccgtttcacgtttcgggcgggtaagggaccgtaagggtcggaacctacgaaaacgtacgtagtcggactcggacacctactctcgtcttctac

SEQ ID NO: 301769 - DNA, 557 bp, Homo sapiens
  misc_feature: GZ8MTXP02IVJ6M.8.28.C06.1.454.CMB.2.raw
  modified_base (202)..(202): a, c, t, g, unknown or other
  misc_feature (202)..(202): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttcctgggganagagccacctctcctgtgcggccagtcagagcgttaaggacaacttagcctggtatcagcagagcctggccaggctcccagacctcctcattctttggccgtcctttaacaggggcccaggtcggaactccccgagccaggttcaggcggcagtgggtctgggacttcgtcactctcacatcaataactgacaatctgacgtactttgcttagtttctttctgtcagcagtctagaagtctcggtcgttcgaccgtttcgggacggagggaccaagggtcggtacctacgaaaacgacgttcggtacggtctcgccacctagttctgtaccttctactcccttcccgactactcg

SEQ ID NO: 301770 - DNA, 574 bp, Homo sapiens
  misc_feature: GZ8MTXP02HNPR6.8.28.C06.1.454.CMB.2.raw
  modified_base (416)..(416): a, c, t, g, unknown or other
  misc_feature (416)..(416): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgttttcctggggagagagccaccctctcctgtgcggccagtcagagcgttaggacaacttagcctggtatcagcagagcctggccaggctccagactcctcattctttggcgtcctttaacagggccagtggaatcccagccaggttcagcggcaggtggtctgggacttcgttcactctcaccatccaaataacctgacaaatctagacgtactttgctagtttatttcngtcagcaagtctagaagtactggccgttctaccgtttcgggcggtaaggggaccaaagggttcgggaaccttacgaaaaacggtaacgtggtacgggacttcggacaaccctatctcggttcctttaactacttacctttccccgaccttaagttccg

SEQ ID NO: 301771 - DNA, 639 bp, Homo sapiens
  misc_feature: GZ8MTXP02F164P.8.28.C06.1.454.CMB.2.raw
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagacctcctcatctttggctcctttaacacgggccaggtcggaactcccagccaggttcagcgcagtggtctgggacttcgttcactctcaccatacaataacctgcaatctagactatttcgctagtttatttctgtctaggctagtctagaacgtacgtcgggtccgtttaccgtacgttttccggggacggggtaacgggggtaacccgtaaaacgggggttaccggggtaaccccgttaaaccggtaaaaaccggtaacccgtttaaggggtcgggtacccgttaacgggacccgtaaccctaaacgttcccgtttacggttccctttaccgtttaaccccg

SEQ ID NO: 301772 - DNA, 539 bp, Homo sapiens
  misc_feature: GZ8MTXP02FSI7S.8.28.C06.1.454.CMB.2.raw
  modified_base (196)..(196): a, c, t, g, unknown or other
  misc_feature (196)..(196): n is a, c, g, or t
  modified_base (312)..(312): a, c, t, g, unknown or other
  misc_feature (312)..(312): n is a, c, g, or t
  modified_base (513)..(513): a, c, t, g, unknown or other
  misc_feature (513)..(513): n is a, c, g, or t
  modified_base (532)..(532): a, c, t, g, unknown or other
  misc_feature (532)..(532): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccnggggagagagccaccctctcctgtgcggccagtcagagcgttaggacaacttagcctggtatcagcagaggcctggccaggctcccagacctcctcatctttggcgtcctttaacngggccagtggaactcccagccaggtcagcggcaggtgggtctgggacttcgtcactctcaccatcaataacctgaccaatctagacgtactttgctagtttatttctagtcagcagtcagaagactcggccgttcacgtttcgggacggacgggaccaaggtcggacctacgaaaacgtactggtcggctaggccaacctntctgtctctactcctaccnctactcg

SEQ ID NO: 301773 - DNA, 604 bp, Homo sapiens
  misc_feature: GZ8MTXP02F775S.8.28.C06.1.454.CMB.2.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacgaacttagcctggtatcagcagaggcctggccaggctcccagacctcctcatctttggcgcctttaacgagggccagtggaactccccagccaggttcagcggcagtggggtctggggacttcgtcactctcaccataccaaataaccctgactaaatccgtagacgtactttgacttagtttatttctgtcagctagtctagaagtactcgggtcccgtttctaaccgtttcggggacgggtacggggtaacccaaggggttacgggaacccttacgaaaacggtaacttgggtacggcctaggaccctaaaccgtcttcgtcgttcctttactacttcccgtttaccccacctacgtccg

SEQ ID NO: 301774 - DNA, 552 bp, Homo sapiens
  misc_feature: GZ8MTXP02FWVDC.8.28.C06.1.454.CMB.2.raw
  modified_base (310)..(310): a, c, t, g, unknown or other
  misc_feature (310)..(310): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacngggccagtggaatcccagccaggttcagcggcaggtgggtctgggacttcgtcactctcacatcaatacctgcaatctgacgtactttgctagtttatttctgtcagcagtctagaagactggccgtttcacgtttcgggacgggacgggtaccaagggttacgacctacgaaaacggactggtcgggctacggacctaaccgattccgtgttccttactacttccttccccgccacttccg

SEQ ID NO: 301775 - DNA, 598 bp, Homo sapiens
  misc_feature: GZ8MTXP02JGNXA.8.28.C06.1.454.CMB.2.raw
  modified_base (575)..(575): a, c, t, g, unknown or other
  misc_feature (575)..(575): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggcctcccagacctcctcattcgtttcggccgtaccctttaaacgacggggtcccaggtacggaaacttcccccgagccctaagggttccaggccggctaggtgggtcgtgggtactttcgtcactctcacatacaaataactgacaatctacgtacgtactttgacttagttttacttcgttcgtcagctaagttcgtaggaacgtacgttcgggtcccgtttacgtaccgtttcggggacgggtacgggaccgtaagggtcgaaccgtacgaaaacgtactggtcggctcgcaccgtntctgtctctctcctccactctcg

SEQ ID NO: 301776 - DNA, 545 bp, Homo sapiens
  misc_feature: GZ8MTXP02JZSMI.8.28.C06.1.454.CMB.2.raw
  modified_base (195)..(195): a, c, t, g, unknown or other
  misc_feature (195)..(195): n is a, c, g, or t
  modified_base (312)..(312): a, c, t, g, unknown or other
  misc_feature (312)..(312): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgcggccagtcagagcgttaggacgaacttagcctggtatcagcagaggcctggccaggctcccagactcctcatctttggcgtcctttaacgngggccagtggaactcccagccaggttcagcggcagtgggtctgggacttcgtcactctcaccatcaataacctgacaaattctagacgtactttgcttagtttatttctgtcagctagtctagaagacgttggcccgttcacgtttcggacgggagggaccgaaggtcgacctacgaaacgtactggtcggctcgccaccgatcgtgtcttcacttccttacccgcctatccg

SEQ ID NO: 301777 - DNA, 591 bp, Homo sapiens
  misc_feature: GZ8MTXP02GFSGQ.8.28.C06.1.454.CMB.2.raw
  modified_base (205)..(205): a, c, t, g, unknown or other
  misc_feature (205)..(205): n is a, c, g, or t
  modified_base (211)..(211): a, c, t, g, unknown or other
  misc_feature (211)..(211): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtctgttttccngggganagagccaccctctcctgtgcggccagtcagagcgttaggacgaactagcctggtatcagcagaggcctggccaggcctcccagacctcctcattctttggccgtccttttaaacgacggggccaaggttcggaaactccccgaagccaggttcaggcggcaggtgggtctggggacttcgttcacctctacaccatacaaactacctgacaatctagacgtacttgactagtttatttctgtacagtctagtactagaaacgtacgtcggtccgtttcaccgtttcgggacgggacggggtaaccgtaagggtacgggaacctacgaaaaccggtaacgtggtcggactcggaccaaccgtactcctcgtcctttctacc

SEQ ID NO: 301778 - DNA, 563 bp, Homo sapiens
  misc_feature: GZ8MTXP02HWGRT.8.28.C06.1.454.CMB.2.raw
  modified_base (195)..(195): a, c, t, g, unknown or other
  misc_feature (195)..(195): n is a, c, g, or t
  modified_base (398)..(398): a, c, t, g, unknown or other
  misc_feature (398)..(398): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgcggccagtcagagcgttaggacgaacttagcctggtatcagcagaggcctggccaggctcccagactcctcatctttggccgtcctttaaacagggccagtggaactcccagccaggttcagcggcaggtgggtctggggacttcggttcactctcacatacaaatacctgacaatcngacgtacttgctagtttatttctgtacagcagtctagaagtacgtggtccgttactacgtttcgggacgggtaacgggaccgaagggttcggaaccgtacgaaaacgtacgtggtcggactcggcaccgtactcgttcgtcttacacttccgtcccgctactccg

SEQ ID NO: 301779 - DNA, 517 bp, Homo sapiens
  misc_feature: GZ8MTXP02FU976.8.28.C06.1.454.CMB.2.raw
  modified_base (318)..(318): a, c, t, g, unknown or other
  misc_feature (318)..(318): n is a, c, g, or t
  modified_base (494)..(494): a, c, t, g, unknown or other
  misc_feature (494)..(494): n is a, c, g, or t
tcagctcgcgtgtccacgaccggtgctcgatttagagctcacgtattgggtttgggagagctctgggaggaactgctcagttaggacccagacggaaccatggaagccccagcgcagcttctcttcctcctgctactctggctcccagagatcattggagaagtggtgatgacacagtctccggtcaccctgtctgttttcctggggagagagccaccctctcctgtgcggccagtcagagcgttaggacgaacttagcctggtatcagcagaggcctggccaggctcccagactcctcatctttggcgcctttaacngggccagtggaatccagccaggtcagcggcagtggtctggggacttcgttcactctcaccatcaataaccctgcaatctgacgactttgctagtttatttctgtcagcagtctagaacgactggaccgtttcacgtttcggcgggtaggaccaagggtggacctcaaacgactcgnggactgcacatctcgtcttctac

SEQ ID NO: 301780 - DNA, 570 bp, Homo sapiens
  misc_feature: GZ8MTXP02GT3OI.8.28.C06.1.454.CMB.2.raw
  modified_base (195)..(195): a, c, t, g, unknown or other
  misc_feature (195)..(195): n is a, c, g, or t
  modified_base (310)..(310): a, c, t, g, unknown or other
  misc_feature (310)..(310): n is a, c, g, or t
  modified_base (386)..(386): a, c, t, g, unknown or other
  misc_feature (386)..(386): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccacctctcctgtgcggccagtcagagcgttaggacaacttagcctggtatcagcagaggcctggccaggcctcccagacctcctcatctttggctcctttaacnggggccagtggaactcccagccaggttcagcggcaggtgggtctggggacttcgttcactctcacatcaataaccngacaaatctgacgtactttgcttagtttattcgtgtcagtctagttctagaacgtacgtggtaccgttctaccgtttcgggacgggtaagggaacccgtaagggtcgggaacctacgaaaacgtaaacgtgggtacgcgtacgccaactattccgtgttcttacacttccttacccgctatccg

SEQ ID NO: 301781 - DNA, 524 bp, Homo sapiens
  misc_feature: GZ8MTXP02JYAU2.8.28.C06.1.454.CMB.2.raw
  modified_base (201)..(201): a, c, t, g, unknown or other
  misc_feature (201)..(201): n is a, c, g, or t
  modified_base (311)..(311): a, c, t, g, unknown or other
  misc_feature (311)..(311): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctgggganagagccaccctctcctgtgcggccagtcagagcgttaggacgaacttagcctggtatcagcagaggcctggccaggctcccagactcctcatctttggcgtcctttaacngggccagtggaatcccagccaggtcagcggcagtgggtctgggacttcgtcactctcaccatcaataacctgcaatctgacactttgctagtttatttctgtcagcagtctgaagactggccgttcacgtttcggcgggtaggggacccaagggtggaccctacaaaacgaactggtcggctcgcaccatctgtcttacatccttcctgccta

SEQ ID NO: 301782 - DNA, 762 bp, Homo sapiens
  misc_feature: GZ8MTXP02ICP16.8.28.C06.1.454.CMB.2.raw
  modified_base (206)..(206): a, c, t, g, unknown or other
  misc_feature (206)..(206): n is a, c, g, or t
  modified_base (212)..(212): a, c, t, g, unknown or other
  misc_feature (212)..(212): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccacctctcctgtgcggccagtcagagcgttaggacgaacttagctggtatcagcagaggcctggccaggcctcccagacctcctcattcgtttggcctaccgttttaaacgacggggtaccctaggttacggaaacctcccccgaaggcccgtaacggggtttccaacggggccgggacgtaggggtttcgggggttccgttcggggggtaacctttttccgggttcctaaccgtttcccttaccaaacccttaactaaccctaaaacttaaaacccgtcggtaacctaaacttaccgttacggtaaacccggttactttttacggaccctttaggtttttaacttttccgtttcggttacctacggtacctagttaccgttagaaacggtaccgttcgggttcccgtttacgtaacggttttccgggggacggggaacgggtaaccgtaaaggggttcgggaaacccttaaccggaaaaaccggtaacgttcgggtacggtccgtcggactaacccgtattccgttcgtttaccttactacccg

SEQ ID NO: 301783 - DNA, 540 bp, Homo sapiens
  misc_feature: GZ8MTXP02JWQY4.8.28.C06.1.454.CMB.2.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (367)..(367): a, c, t, g, unknown or other
  misc_feature (367)..(367): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacgaacttagcctggtatcagcagaggcctggccaggctcccagactcctcatctttggctcctttacaggccagtgaactcccagccaggtcagcggcagtggtctgggacttcgtcactctcacntcaatactgacatctgacgtacttgactagtttacttctgtcagtcagtctagaagactggtcccgtttatacgtttcgggacggtacggggaccctaagggtcgacctacgaaaacgtaacgtggtacggctacggccactactctcgttctctactccttcccgctactcg

SEQ ID NO: 301784 - DNA, 597 bp, Homo sapiens
  misc_feature: GZ8MTXP02FO2FO.8.28.C06.1.454.CMB.2.raw
  modified_base (388)..(388): a, c, t, g, unknown or other
  misc_feature (388)..(388): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggcctcccagacctcctcatctttggcgtcctttaacagggccagtggaatcccagccaggttcagcggcagtgggtctggggacttcgttcactctcaccatcaataacctnactaatctagacgtactttcgtcttagtttactttctgtacagctagtctaggtaacgtacgttcggtaccgttacgtaccggttcggggaccgggtaacgggaaccggtaagggtacggtaaccgtaaacgaaaacggtacgtacggtcggtactacggacctacctagttcgtcgttcttactaccttcccgttacccgcctactcg

SEQ ID NO: 301785 - DNA, 543 bp, Homo sapiens
  misc_feature: GZ8MTXP02GS0TT.8.28.C06.1.454.CMB.2.raw
  modified_base (201)..(201): a, c, t, g, unknown or other
  misc_feature (201)..(201): n is a, c, g, or t
  modified_base (313)..(313): a, c, t, g, unknown or other
  misc_feature (313)..(313): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctgggganagagccaccctctcctgtgcggccagtcagagcgttaggacgaacttagcctggtatcagcagaggcctggccaggctcccagacctcctcatctttggcgtcctttaacgngggccagtggaactcccagccaggtcagcggcaggtggtctgggacttcgtcactctcacatcaataacctgacaatctagacgtacttgctagtttattctgtcagctagtctagaagtactggtccgttcaccgtttcggcgggtaacgggaccgaaaggtcggaacctacgaaaacgtacgtgtcggctcgacacctatctcgtcttacactccttcccgctactcg

SEQ ID NO: 301786 - DNA, 550 bp, Homo sapiens
  misc_feature: GZ8MTXP02IX0ND.8.28.C06.1.454.CMB.2.raw
  modified_base (201)..(201): a, c, t, g, unknown or other
  misc_feature (201)..(201): n is a, c, g, or t
  modified_base (310)..(310): a, c, t, g, unknown or other
  misc_feature (310)..(310): n is a, c, g, or t
  modified_base (516)..(516): a, c, t, g, unknown or other
  misc_feature (516)..(516): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctgggganagagccaccctctcctgtgcggccagtcagagcgttaggacgaacttagcctggtatcagcagaggcctggccaggctcccagacctcctcatctttgcgtctttaacngggccagtgaactcccagccaggttcagcggcagtgggtctgggactttcgttcactctcaccatcaataacctgcaaatctagacgtactttgctagtttattctgtcagcagtctgaagtctggtccgttcacgtttcggacggtacgggaaccgaggtacggacttaccgaaaacgtactggtcggcttacggctaacccgtntactcgttcttactacttccgtaccgctacgtcg

SEQ ID NO: 301787 - DNA, 545 bp, Homo sapiens
  misc_feature: GZ8MTXP02FV0KP.8.28.C06.1.454.CMB.2.raw
  modified_base (310)..(310): a, c, t, g, unknown or other
  misc_feature (310)..(310): n is a, c, g, or t
  modified_base (368)..(368): a, c, t, g, unknown or other
  misc_feature (368)..(368): n is a, c, g, or t
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagacctcctcatctttggcgcctttaacngggccagtggaatcccagccaggttcagcggcagtgggtctggggacttcgtcactcncaccatcaatactgcaatctgacgactttgctagtttatttctgttcagctagtctaggaagtactcgggtccgtttcacgtttcgggacggaggggtaccaagggtcggacctacgaaaacgtacgttgcggctcggcctaccagtcctgttaccttcacttccttccgccattcg

SEQ ID NO: 301788 - DNA, 573 bp, Homo sapiens
  misc_feature: GZ8MTXP02FQTBJ.8.28.C06.1.454.CMB.2.raw
  modified_base (195)..(195): a, c, t, g, unknown or other
  misc_feature (195)..(195): n is a, c, g, or t
  modified_base (311)..(311): a, c, t, g, unknown or other
  misc_feature (311)..(311): n is a, c, g, or t
  modified_base (343)..(343): a, c, t, g, unknown or other
  misc_feature (343)..(343): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgcggccagtcagagcgttaggacgaacttagcctggtatcagcagaggcctggccaggctcccagacctcctcatctttggctcctttaacngggccagtggaactcccagccaggtcagcggnagtggtctgggacttcgtcactctcacatacaataacctgacaatctagacgtactttgcttagttatttctgtcagcagtctagaagtactggtccgttctaccgtttcgggacgggacgggtaccgaagggtacggaacctacgaaaacggtaacgtcggtacggcttacggacctaacccgtattcctcgttcctttaccacttccctttccccgacctacttcccg

SEQ ID NO: 301789 - DNA, 555 bp, Homo sapiens
  misc_feature: GZ8MTXP02HZUS9.8.28.C06.1.454.CMB.2.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (378)..(378): a, c, t, g, unknown or other
  misc_feature (378)..(378): n is a, c, g, or t
  modified_base (547)..(547): a, c, t, g, unknown or other
  misc_feature (547)..(547): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccacctctcctgtgcggccagtcagagcgttaggacaacttagcctggtatcagcagagcctggccaggctcccagactcctcatctttggctcctttaacgaggccagtgaactcccagccaggtcagcggcaggtggtctgggacttcgtcactctacactatcaataccngacaatctgacgtacttgacttagtttattctgtcagtcagttctagaagtacgttcggtccgttaccgtacgtttcgggacgggtacgggtaaccgtaagggtcggaacctacgaaaacgtacttggacggtctcgaccaactatcttcgtcttcacttcccgttccncctactcg

SEQ ID NO: 301790 - DNA, 601 bp, Homo sapiens
  misc_feature: GZ8MTXP02H26JX.8.28.C06.1.454.CMB.2.raw
  modified_base (195)..(195): a, c, t, g, unknown or other
  misc_feature (195)..(195): n is a, c, g, or t
  modified_base (403)..(403): a, c, t, g, unknown or other
  misc_feature (403)..(403): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgttttccnggggagagagccacctctcctgtgcggccagtcagagcgttaggactaacttagcctggtatcagcagaggcctggccaggcctccagacctcctcattcgtttggccgtacctttaacgacgggccaggtggaactcccaggacctaggttccaggcggcacggtgggctgggacctttcgtcactctcaacctctacaaactaccngactaatctagtacgtactttgactttagttttatttcgtagtacagtactagttctaggaacgtcgtacgggtccgtttcctacggtttccgggacgggtacgggaacgtaagggtcgaacctacgaaaacggcgttcggcgtccacggacctactactcgttaagtccttacgtacttccgttcccgactactccg

SEQ ID NO: 301791 - DNA, 583 bp, Homo sapiens
  misc_feature: GZ8MTXP02G7G6D.8.28.C06.1.454.CMB.2.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacgaacttagcctggtatcagcagaggcctggccaggcctcccagacctcctcatctttggccgtcctttaacgacgggccaggtggaactccccgagccaggtcagcggcaggtggtctgggtacttcgtcactctcacatacaatactgacaatctgacgtacttgcttagtttacttctgtcagtctagtctagacgtacgtcgggtccgttacgtaccgtttcgggacgggtacgggaccgtaaggggtcgaaccgtacgaaaacggtacgtggtcggtacgtcggacctaacctattccgtgttccttacaccttcccgttaccccgcctacttaccg

SEQ ID NO: 301792 - DNA, 565 bp, Homo sapiens
  misc_feature: GZ8MTXP02F2K3F.8.28.C06.1.454.CMB.2.raw
  modified_base (195)..(195): a, c, t, g, unknown or other
  misc_feature (195)..(195): n is a, c, g, or t
  modified_base (395)..(396): a, c, t, g, unknown or other
  misc_feature (395)..(396): n is a, c, g, or t
  modified_base (403)..(403): a, c, t, g, unknown or other
  misc_feature (403)..(403): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgcggccagtcagagcgttaggacgaacttagcctggtatcagcagaggcctggccaggcctcccagactcctcatcgtttggcgtcctttaacgagggcctaggtcggaaactccccgagccgtaaggttcagcggcaggtgggtctgggacttcgtcactctcacatacaatacnncaatctnacgtactttgctagtttattctgtcagtcagttctagaacgtacgttcggtaccgttctaaccgtttcgggacgggtaacggaccgaaggtcggaactacgaaaacgtaacgtgtacggctacggccaacgtatctgtactctacttcctccgcctattccg

SEQ ID NO: 301793 - DNA, 546 bp, Homo sapiens
  misc_feature: GZ8MTXP02I0P9S.8.28.C06.1.454.CMB.2.raw
  modified_base (311)..(311): a, c, t, g, unknown or other
  misc_feature (311)..(311): n is a, c, g, or t
  modified_base (522)..(522): a, c, t, g, unknown or other
  misc_feature (522)..(522): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctccagactcctcatctttggcgtcctttaacgngggccagtggaactcccagccaggttcagcggcaggtgggtctggggacttcgtcactctcaccatacaataacctgccaaatctgactactttgctagtttattctgtcagctagtctagaacgtcgtcgggtccgttactacgtttcgggacgggtagggaaccgtagggttacgacctacgaaaacgtacgtgtcggctcgcaaccgntctgtctcactctcccgctacgtc

SEQ ID NO: 301794 - DNA, 571 bp, Homo sapiens
  misc_feature: GZ8MTXP02I78SE.8.28.C06.1.454.CMB.2.raw
  modified_base (205)..(205): a, c, t, g, unknown or other
  misc_feature (205)..(205): n is a, c, g, or t
  modified_base (211)..(211): a, c, t, g, unknown or other
  misc_feature (211)..(211): n is a, c, g, or t
  modified_base (215)..(215): a, c, t, g, unknown or other
  misc_feature (215)..(215): n is a, c, g, or t
  modified_base (222)..(222): a, c, t, g, unknown or other
  misc_feature (222)..(222): n is a, c, g, or t
  modified_base (266)..(266): a, c, t, g, unknown or other
  misc_feature (266)..(266): n is a, c, g, or t
  modified_base (318)..(318): a, c, t, g, unknown or other
  misc_feature (318)..(318): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtctgttttccngggganaganccacctntcctgtgcggccagtcagagcgttaggacaacttagcctggtancagcagaggcctggccaggctccagactcctcatctttggcgtctttaacgngggccagtggaactccagccaggtcagcggcagtgggtctggggacttcggtcactctcactatacaataacctgacaatctagactacttgactagtttatttcttgtctaagtctagtccgttagaaacgtacgtcgggtccgtttactaccggtttacgggacgggtaacgggaccgtaaagggtacggtaacccgttaacgaaacggtaacgtacgtggactcgaccacgtactctcgtcttactaccg

SEQ ID NO: 301795 - DNA, 588 bp, Homo sapiens
  misc_feature: GZ8MTXP02FU78X.8.28.C06.1.454.CMB.2.raw
  modified_base (206)..(206): a, c, t, g, unknown or other
  misc_feature (206)..(206): n is a, c, g, or t
  modified_base (212)..(212): a, c, t, g, unknown or other
  misc_feature (212)..(212): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacgaacttagcctggtatcagcagaggcctggccaggcctcccagacctcctcattctttggccgtcctttaacgacggggccaggtcggaaactcccagccaggttcagcggcaggtggtctggggacttcgttcacgtctcaccatacaaataaccctgactaatctagacgtactttgacttagtttatttctagtcagcagttctagaaacgtcgttcgggtcccgtttcaaccgtttcggggacgggtaacgggaccgtaaagggttcggaaacccttacgaaaacgtacgtggtcggcctggaccacctagttccgttacttcttactacg

SEQ ID NO: 301796 - DNA, 606 bp, Homo sapiens
  misc_feature: GZ8MTXP02JN1AB.8.28.C06.1.454.CMB.2.raw
  modified_base (205)..(205): a, c, t, g, unknown or other
  misc_feature (205)..(205): n is a, c, g, or t
  modified_base (211)..(211): a, c, t, g, unknown or other
  misc_feature (211)..(211): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtctgttttccngggganagagccacctctcctgtgcggccagtcagagcgttaggacgaacttagcctggtatcagcagaggcctggccaggctcccagactcctcatctttggcgtcctttaacgaggggccaggtcggaaactccccgaggccaacggttcaggcggcaggtgggtctggggacttcgttcactctcaccatcaataacctgacaatctagacgactttgctagtttattctgtcagctagtctagaagtactcggtccgttctaccgtttcgggacgggtaacgggaacccgtaaaggggtacggaacccgttaaccgaaaaccggtaaccgttaggttacgggaccgttcggaccctaacccgtaacgttaccgttacggttcctttacgttaacccg

SEQ ID NO: 301797 - DNA, 530 bp, Homo sapiens
  misc_feature: GZ8MTXP02I4FX1.8.28.C06.1.454.CMB.2.raw
tcagctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgttttcctggggagagagccaccctctcctgtgcggccagtcagagcgttaggacgaacttagcctggtatcagcagaggcctggccaggctcccagactcctcatctttggcgtcctttaacgagggccagtggatcccagccaggtcagcggcagtgggtctgggacttcgtcactctcaccatcaataacctgacaatctgacgtactttgctagtttattctgtcagcagtctgaagacgtggccgttcacgtttcgggacggagggaccaaggtcgacctacgaaacgacgtgacggctcgacacctatcgtaacgtcttcactccttcccgctacgtcg

SEQ ID NO: 301798 - DNA, 586 bp, Homo sapiens
  misc_feature: GZ8MTXP02H4X56.8.28.C06.1.454.CMB.2.raw
  modified_base (267)..(267): a, c, t, g, unknown or other
  misc_feature (267)..(267): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacaacttagcctggtatcagcagagcnggccaggctccagactcctcatctttggcgtctttaacgacgggcagtggaactcccagccaggtcagcggcaggtgggtctgggacttcgtcactctcactatacaactacctgcaatctgactacttgctagttttattctgtcagcagttcagagtacgtcgggtccttcgacgtttcgggacggtaacgggaccaaggggttcgaaacccgttacgaaaacggtacgttacgggtacggtacgttacggaccacctaacgttcgttcggttaccttacctacctttcccgttacccccggtctaaacgttcccgg

SEQ ID NO: 301799 - DNA, 563 bp, Homo sapiens
  misc_feature: GZ8MTXP02HKMR2.8.28.C06.1.454.CMB.2.raw
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
  modified_base (316)..(316): a, c, t, g, unknown or other
  misc_feature (316)..(316): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccngggganagagccaccctctcctgtgcggtcagtcagagcgttaggacgaacttagcctggtatcagcagaggcctggccaggctcccagacctcctcattctttggccgtcctttaacgngggccagtggaactcccagccaggttcagcggcaggtggtctgggtacttcgtcactctacacatcaataacctgacatctgacgtactttgcttagtttatttctgtcagctagtcttagagtacgtcggtccgttacgtacgtttcgggacggtacgggaaccgtagggtacggtaacctacgaaaacggtacgtggtacggctcgacgacctatctcgtcttcacgttccttcccgactactcg

SEQ ID NO: 301800 - DNA, 575 bp, Homo sapiens
  misc_feature: GZ8MTXP02IQ9VO.8.28.C06.1.454.CMB.2.raw
  modified_base (197)..(197): a, c, t, g, unknown or other
  misc_feature (197)..(197): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgnggggagagagcccaccctctcctgtgcggccagtcagagcgttaggacgaacttagcctggtatcagcagaggcctggccaggcctcccagacctcctcattcgtttggccgtacctttaaacgacgggcccaggtcggaactccccgagccaggtcaggcggcaggtgggtctgggtacttcgtcactctcacatacaatacctgacaatctagacgtactttgtcgtttattctgtcagctagtctagaagtacgtggtccgttctacgtttccggacgggtaacgggaccgtaagggtacggaaccctacgaaaaccgtacgtggtacggctcggacaccacgttctgtcttcacttcctcccgctactccgtag

SEQ ID NO: 301801 - DNA, 566 bp, Homo sapiens
  misc_feature: GZ8MTXP02JRA57.8.28.C06.1.454.CMB.2.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (213)..(213): a, c, t, g, unknown or other
  misc_feature (213)..(213): n is a, c, g, or t
  modified_base (559)..(559): a, c, t, g, unknown or other
  misc_feature (559)..(559): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctntcctgtgcggccagtcagagcgttaggacaacttagcctggtatcagcagaggcctggccaggctcccagactcctcatctttggcgtcctttaacagggccagtcggaactcccagccaggttcagcggcaggtgggtctgggacttcgttcactctcacatacaataacctgacaaatctagacgacgtttgccttagtttactttcgttgtcagtactagtcgtagacgtacgtcggtaccgttacgtacggttcgggacgggacggacgtaggtacgtacctacgaaaacgtacgtagtcggtactacgacctactactcgtaagtctactacttccgtccnctactcg

SEQ ID NO: 301802 - DNA, 665 bp, Homo sapiens
  misc_feature: GZ8MTXP02IUKIK.8.28.C06.1.454.CMB.2.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgttttcctggggagagacgcccaccctctcctgtgcggccagtcagagcgttaggacgaacttgctggtatcagcagaggcctggccaggcctacccagtacctcctctacgttcgtttcggccgttacctttaaacgcggggaccctaggtacggaacttccccgagtccgtaggttccaggccggtctacgggtcgggtcgtgggtacctttcgttccactcctaccgtaccactacctaactacctgactaattcgtagtactacgtttgactttagttttactttcgtcgttacgacgtacgtacgttacgtaggtaacgtcgttcggtcccgtttacgacggtttcgggacgggtacggaaaccgtagggtccgtaaccgtaacgtaaaacggtacgttgggtcgtacgtcgtacctaccgtagttcgttaacgtcctttacgtacttccccgttccgtacctaagtttccgg

SEQ ID NO: 301803 - DNA, 531 bp, Homo sapiens
  misc_feature: GZ8MTXP02JGZ68.8.28.C06.1.454.CMB.2.raw
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
  modified_base (386)..(386): a, c, t, g, unknown or other
  misc_feature (386)..(386): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccngggganagagccaccctctcctgtgcggccagtcagagcgttaggacaacttagcctggtatcagcagaggcctggccaggctcccagactcctcatctttggcgtcctttaacgagggccagtggaactcccagccaggttcagcggcaggtgggtctgggacttcgtcactctcacatcaaatacctnacatctgacacttgctagtttattctgtcagctagtctagaaagcgtgccgttctacgtttcgggacggagggaccgaagggtcgacctacgaaacgaacgtggacgctcgccaccgatctgtcttcactccttcccgctactcg

SEQ ID NO: 301804 - DNA, 631 bp, Homo sapiens
  misc_feature: GZ8MTXP02HKBZO.8.28.C06.1.454.CMB.2.raw
  modified_base (313)..(313): a, c, t, g, unknown or other
  misc_feature (313)..(313): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagacctcctcatctttggcgtcctttaacgngggccaggtggaactcccagcaggttcagcggcagtgggtctgggacttcgtcactctcacatcaatacctgcaatctagacgtactttgctagtttacttctgttcagctagtcttagaacgtacgtcgggtcccgtttacgtaaccgtttcggggacgggtaaggggtaacccctaaagggggttaccggaaacccttaacgaaaaaccggtaaacggtcgggttaacgggccttacgggtacccaacccgtaattcccgttaaggttccctttaccgtacctttaccccgtttcccccggacctaactttcccgg

SEQ ID NO: 301805 - DNA, 544 bp, Homo sapiens
  misc_feature: GZ8MTXP02H2U0V.8.28.C06.1.454.CMB.2.raw
  modified_base (200)..(200): a, c, t, g, unknown or other
  misc_feature (200)..(200): n is a, c, g, or t
  modified_base (381)..(381): a, c, t, g, unknown or other
  misc_feature (381)..(381): n is a, c, g, or t
  modified_base (388)..(388): a, c, t, g, unknown or other
  misc_feature (388)..(388): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgttttcctgggganagagccaccctctcctgtgcggccagtcagagcgttaggacgaacttagcctggtatcagcagaggcctggccaggctcccagactcctcatctttggcgtcctttaacagggccagtggaactcccagccaggttcagcgcagtgggtctgggacttcgtcactctcaccatcaataccngcaatcngacgactttgctagttttattctgtcagtcagtctagaacgtacgtggcccgttcacgtttcgggcgggacgggaaccgaagggttcggaacctacgaaaacgacgttggtacggctcgccacctatcgtgtcttacacttccttcccgctactcg

SEQ ID NO: 301806 - DNA, 526 bp, Homo sapiens
  misc_feature: GZ8MTXP02G5019.8.28.C06.1.454.CMB.2.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (309)..(309): a, c, t, g, unknown or other
  misc_feature (309)..(309): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacgaacttagcctggtatcagcagagcctggccaggctcccagactcctcatctttggcgcctttaacngggccagtggaatcccagccaggttcagcggcagtgggtctgggacttcgttcactctcacatcaataacctgacaaatctgacgactttgctagtttatttctgtcagcagtctagaagactggccgttcacgtttcgggcggtagggaccaagggtcggacctacgaaaacgactggtcgctcgcaccgatctgtctcactccttcccgcactcg

SEQ ID NO: 301807 - DNA, 611 bp, Homo sapiens
  misc_feature: GZ8MTXP02JJ1WV.8.28.C06.1.454.CMB.2.raw
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
  modified_base (294)..(294): a, c, t, g, unknown or other
  misc_feature (294)..(294): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccngggganagagccaccctctcctgtgcggccagtcagagcgttaggacgaacttagcctggtatcagcagaggcctggccaggcctcccagacctcctnatcgtttggcgtcctttaacgagggccaggtcggaactccccgagtccgaggttcaggcggctagggtgggtctggggtacttcgttcactcctacacctatactaactaacctgaccaaagtctagtaccgtactttgtacttagtttactttctgtcagctagtctagtaagtactgggtcccgttactaccggtttcgggacgggtacgggacccgtaagggtacggaccttacgaaaaccggtacgttcggtacgggctacgacctaacctactcgttcgtccttactacttcccgttaccccgtactactcg

SEQ ID NO: 301808 - DNA, 660 bp, Homo sapiens
  misc_feature: GZ8MTXP02G0ZH4.8.28.C06.1.454.CMB.2.raw
  modified_base (195)..(195): a, c, t, g, unknown or other
  misc_feature (195)..(195): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgcggccagtcagagcgttaggacgaacttagcctggtatcagcagaggcctggccaggctcccagacctcctcattctttggcgtacctttaaacgacggggcccaggtcggaaacttcccccgaaggcccaaggggtttccaaggccgggactagggtggggtctggggacttttcggttacaactcctaccaaccataccaaaacttaaaccctgacctaaatctacgtacgtactttagctagtttactttctgtcagtctaaggtctagaacgtacgttcgggtccgtttacgacgttttcggggacgggtaacgggaaccgtaaggggtacgggaacccttaacgaaaaccggtaaccgtaggtacggtcgtacggaccgtaaccctattccgtggtttcctttctaacttccttcccccggtacctaacttcccg

SEQ ID NO: 301809 - DNA, 558 bp, Homo sapiens
  misc_feature: GZ8MTXP02JA7JS.8.28.C06.1.454.CMB.2.raw
  modified_base (194)..(194): a, c, t, g, unknown or other
  misc_feature (194)..(194): n is a, c, g, or t
  modified_base (200)..(200): a, c, t, g, unknown or other
  misc_feature (200)..(200): n is a, c, g, or t
  modified_base (286)..(286): a, c, t, g, unknown or other
  misc_feature (286)..(286): n is a, c, g, or t
  modified_base (303)..(303): a, c, t, g, unknown or other
  misc_feature (303)..(303): n is a, c, g, or t
  modified_base (336)..(336): a, c, t, g, unknown or other
  misc_feature (336)..(336): n is a, c, g, or t
  modified_base (378)..(378): a, c, t, g, unknown or other
  misc_feature (378)..(378): n is a, c, g, or t
  modified_base (397)..(397): a, c, t, g, unknown or other
  misc_feature (397)..(397): n is a, c, g, or t
  modified_base (509)..(509): a, c, t, g, unknown or other
  misc_feature (509)..(509): n is a, c, g, or t
  modified_base (528)..(528): a, c, t, g, unknown or other
  misc_feature (528)..(528): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgttttccngggganagagccaccctctcctgtgcggccagtcagagcgttaaggacaacttagcctggtatcagcagagcctggccaggctccagactcnatcttgctacttaacgnggaccagtaggactcccagccaggtcaggcggnaggtggtctgggtacttcgtcactctcacatacaaatacctnacaatctgacgtactttgnttatttacttctgtcagctaagtctaggaaacgtcgttcggccgtttactaacgtttcgggacgggtaacggggaaccaaaggggttcggaaacttaacgaaaacgtaacgnggtaggctacgccaacctntactgtcttactacttcctcccactactcg

SEQ ID NO: 301810 - DNA, 562 bp, Homo sapiens
  misc_feature: GZ8MTXP02IXZCM.8.28.C06.1.454.CMB.2.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagacctcctcatctttggcgtcctttaacagggccagtggaatcccagccaggttcagcggcagtgggtctgggacttcgtcactctcaccatcaataacctgacaatctgacgtactttgctagttttattctgtcagctagtctagaagtacgtcggtccgtttcacgttttcgggacgggtaaggggacccgaagggttcgggaacctacgaaaacgacgtggtcggacgtgccaaccattcgtcgttccttactacttcctttccccgctacttcg

SEQ ID NO: 301811 - DNA, 580 bp, Homo sapiens
  misc_feature: GZ8MTXP02H4P71.8.28.C06.1.454.CMB.2.raw
  modified_base (408)..(408): a, c, t, g, unknown or other
  misc_feature (408)..(408): n is a, c, g, or t
  modified_base (417)..(417): a, c, t, g, unknown or other
  misc_feature (417)..(417): n is a, c, g, or t
  modified_base (578)..(578): a, c, t, g, unknown or other
  misc_feature (578)..(578): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtcttgtttttccgtggggagagacgccaccctctcctgtgcggcagtcagagcgttaggacgtaacttagcctggtatcagcaggaggcctggccaggctccccagacctcctcattcgtttggccgtacctttaacgagggccaggtaggaactcccagccaggtcagcgcgaggtgggtctggggtactttcgtcactctcaccatctaaanactgacaancctagaacgtctttgcttagtttattctgtctagtcagtctagaacgtacgtcggtacccgttcgtaaccgtttcggggacgggaacgggtacgaacgggttcggaaccttacgaaaacgtacgtggtacgcgtaacgaccacgtactcgtctctttaccncg

SEQ ID NO: 301812 - DNA, 522 bp, Homo sapiens
  misc_feature: GZ8MTXP02ITPE1.8.28.C06.1.454.CMB.2.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctagacgactttgctagtttatttctgtcagcagtctgaagactggccgttcacgtttcggcggaggaaccgaaggtcggacctacgaaaacgacgtgtcggactgacaccatctgtcttcactctccgcactcg

SEQ ID NO: 301813 - DNA, 548 bp, Homo sapiens
  misc_feature: GZ8MTXP02G06Q5.8.28.C06.1.454.CMB.2.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacaacttagcctggtatcagcagaggcctggccaggctcccagactcctcatctttggcgtcctttaacgagggccagtggaatcccagccaggtcagcggcaggtgggtctgggacttcgtcactctccacatcaatacctgcaaatctgacgtactttgctagtttattctgtcagctagtctagagtacgtggtccgttcacgtttcgggacgggtacgggaaccgaagggtcggaacctacgaaaacgaccgtggcggtcgtacgccacctatccttgtaccttctactccttcccgctatccg

SEQ ID NO: 301814 - DNA, 612 bp, Homo sapiens
  misc_feature: GZ8MTXP02HBHW0.8.28.C06.1.454.CMB.2.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (348)..(348): a, c, t, g, unknown or other
  misc_feature (348)..(348): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgttttccngggganagagccacctctcctgtgcggccagtcagagcgttaggacgaacttagcctggtatcagcagaggcctggccaggctcccagacctcctcattctttggcgtcctttaacgacgggccagtcggaactcccagccaggtcaggcggnaggtgggtctgggacttcgtcactctcaccatcaaataacctgacaatctagacgtactttgacttagttttacttctacgttacagtctagttcctagaacggtacgtcgggtcccgtttactaaccggtttcggggacgggaagggtaccgtaagggtacggtaccctaacgaaaacggtacgttggtacggtacctcggacctaaccgtagttccgttaagttcccttacgtaccgttcccttacccggtcctaacttccg

SEQ ID NO: 301815 - DNA, 551 bp, Homo sapiens
  misc_feature: GZ8MTXP02F4UP4.8.28.C06.1.454.CMB.2.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (311)..(311): a, c, t, g, unknown or other
  misc_feature (311)..(311): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacgaacttagcctggtatcagcagaggcctggccaggctcccagactcctcatctttggcgtcctttaacngggccagtggaactcccagccaggttcagcggcagtggtctgggacttcgtcactctcacatcaataacctgacaatctgactactttgctagtttatttctgtcagctagtctagaacgtacgtcggtccgttctacgtttcgggacgggtacgggacaagggtcgaaccgtacgaaaacggtacttggacggtctacgcctactactctcgttcttactactccttcccgcctactcg

SEQ ID NO: 301816 - DNA, 558 bp, Homo sapiens
  misc_feature: GZ8MTXP02HBMUR.8.28.C06.1.454.CMB.2.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (311)..(311): a, c, t, g, unknown or other
  misc_feature (311)..(311): n is a, c, g, or t
  modified_base (346)..(346): a, c, t, g, unknown or other
  misc_feature (346)..(346): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacaacttagcctggtatcagcagaggcctggccaggctcccagacctcctcatctttggcgtcctttaacnggggccaggtggaactcccagccaggttcagcggnaggtgggtctgggacttcgtcactctcacatacaataacctgaccaatcctgacgtactttgctagtttattctgttcagctagtcttagaagtactggccgttctaccgtttcgggacgggtaggacgaagggtcggtacctacaaaacggtaacctggtacggtctaggaccaccgtattcgtcgtcttcacttccttcccgctacttcg

SEQ ID NO: 301817 - DNA, 568 bp, Homo sapiens
  misc_feature: GZ8MTXP02JAKCE.8.28.C06.1.454.CMB.2.raw
  modified_base (195)..(195): a, c, t, g, unknown or other
  misc_feature (195)..(195): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgcggccagtcagagcgttaggacgaacttagcctggtatcagcagaggcctggccaggctcccagacctcctcatctttggcgtcctttaacgagggccagtggaactcccagccaggtcagcggcagtgggtctgggacttcgtcactctcaccatacaataacctgacaaatctgacgtactttgctagtttattctgtcagcagtctagaacgtacgtggtccgtttacaccgtttcgggacgggtagggaaccgaaggggtcggaacctacgaaaacgtacgtggtcggctacggccaacccgattcgtcgttccttacacgttccctttccccgactacttccg

SEQ ID NO: 301818 - DNA, 623 bp, Homo sapiens
  misc_feature: GZ8MTXP02H59QU.8.28.C06.1.454.CMB.2.raw
  modified_base (195)..(195): a, c, t, g, unknown or other
  misc_feature (195)..(195): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgcggccagtcagagcgttaggactaacttagcctggtatcagcagagcctggccaggctccagactcctcattctttggccgtacctttaacgacggggccaggtcggaactcccgggcctaggttcaggccggacaggtcggggtcgtggggtacttcgttcacttctcaccataccaaataacctgactaatctgacgtctttgctagttttacttctgtcagctagtctaggaagtacgttcgggtcccgtttacgtaacggtttccggggacggggtaacgggtaacccgtaaaggggttccgggaaccttaacgaaaaccggtactgggtcggacttcggaccctactacgttcgtcgttaaccgttcaacttccctcccgacctacgttacgtaacgg

SEQ ID NO: 301819 - DNA, 666 bp, Homo sapiens
  misc_feature: GZ8MTXP02JI07N.8.28.C06.1.454.CMB.2.raw
  modified_base (205)..(205): a, c, t, g, unknown or other
  misc_feature (205)..(205): n is a, c, g, or t
  modified_base (211)..(211): a, c, t, g, unknown or other
  misc_feature (211)..(211): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtctgttttccngggganagagccaccctctcctgtgcggccagtcagagcgttaggacaacttagcctggtatcagcagaggcctggccaggcctccccagacctcctcactctttggcctacctttaaacgacggggtccctaaggtcgggaaacttccccgaaggcccgtacgggtttccaaggccgggtaccgtaaggggttcggggttaccgttggggggtacccttttcggttaccgtaccttccttaccaacctaataccaaacttaaacctgactaaatccgtagaaccgtacttttaggaccttaagttttatttcgtgtacctagtcgtagttctaggaaacgtcgtcggtaccgttactacgtttacgggacgggaacgggtaaccgtaagggtcggaaccctaacggaaaacgtacgtaggtcggactcggccaaccgtactcgtacgttaccttctaccg

SEQ ID NO: 301820 - DNA, 514 bp, Homo sapiens
  misc_feature: GZ8MTXP02HFUE6.8.28.C06.1.454.CMB.2.raw
  modified_base (201)..(201): a, c, t, g, unknown or other
  misc_feature (201)..(201): n is a, c, g, or t
  modified_base (376)..(376): a, c, t, g, unknown or other
  misc_feature (376)..(376): n is a, c, g, or t
  modified_base (382)..(382): a, c, t, g, unknown or other
  misc_feature (382)..(382): n is a, c, g, or t
  modified_base (389)..(389): a, c, t, g, unknown or other
  misc_feature (389)..(389): n is a, c, g, or t
  modified_base (391)..(391): a, c, t, g, unknown or other
  misc_feature (391)..(391): n is a, c, g, or t
  modified_base (401)..(401): a, c, t, g, unknown or other
  misc_feature (401)..(401): n is a, c, g, or t
  modified_base (405)..(406): a, c, t, g, unknown or other
  misc_feature (405)..(406): n is a, c, g, or t
  modified_base (410)..(410): a, c, t, g, unknown or other
  misc_feature (410)..(410): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctgggganagagccaccctctcctgtgcggccagtcagagcgttaggacgaacttagcctggtatcagcagagcctggccaggctccagactctcatctttgcgcctttaacaggcagtgaatcccagccaggtcagcggcagtgggtctggggacttgtcactctcaccatcaaataactancatctnacacttntntattattctntcannagtntgagacgtgtcgtctacgttcgtcggacggacgaaggtagacgtacaaacgaaacgtagtgcgtcgacacactactcgtcttactactacctccctaccactcg

SEQ ID NO: 301821 - DNA, 651 bp, Homo sapiens
  misc_feature: GZ8MTXP02GJ3J5.8.28.C06.1.454.CMB.2.raw
  modified_base (196)..(196): a, c, t, g, unknown or other
  misc_feature (196)..(196): n is a, c, g, or t
  modified_base (449)..(449): a, c, t, g, unknown or other
  misc_feature (449)..(449): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccnggggagagagccaccctctcctgtgcggccagtcagagcgttaggacaacttagcctggtatcagcagaggcctggccaggcctcccagacctcctcatcgtttggcgtacctttaacgagggcccaaggtcggaaactccccgagccgtaggttcaggcggcaggtcgggtcgtggggtactttcgtcactcctcaacctatacaaactaacctgacaaactctacgacgtactttgacttagtttatttcngtcagctagtctagaacgtacgtcggtccgttacacgtttcggggacggtagggaacccgtaaggggtcgaaacccgttacgaaaaccgtaacgttcggtacggtaccgttacggaccctaaaccgtaacgttcccgttaacggtttacccttaccggttaaccctttccccgtttaccccggacccttaaacgttacccgg

SEQ ID NO: 301822 - DNA, 547 bp, Homo sapiens
  misc_feature: GZ8MTXP02GRYYU.8.28.C06.1.454.CMB.2.raw
  modified_base (206)..(206): a, c, t, g, unknown or other
  misc_feature (206)..(206): n is a, c, g, or t
  modified_base (212)..(212): a, c, t, g, unknown or other
  misc_feature (212)..(212): n is a, c, g, or t
  modified_base (320)..(320): a, c, t, g, unknown or other
  misc_feature (320)..(320): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacgaacttagcctggtatcagcagaggcctggccaggctcccagactcctcatctttggctctttaacngggccagtggaatcccagccaggtcagcgcagtgggctggggacttcgtcactctcacatacaataaccctgacaatctagacgtactttgctagtttatttctgtcagcagtctagaagtctcggtccgttacgaccgtttcgggacgggtaacgggtacccgaaggggtcggaaccctacgaaaaccgtaacgtggtcggactgcacctatctcgtccttactac

SEQ ID NO: 301823 - DNA, 618 bp, Homo sapiens
  misc_feature: GZ8MTXP02INLE6.8.28.C06.1.454.CMB.2.raw
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
  modified_base (315)..(315): a, c, t, g, unknown or other
  misc_feature (315)..(315): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccngggganagagcccacctctcctgtgcggccagtcagagcgttaggacgaacttagcctggtatcagcagaggcctggccaggctcccagactcctcatcgtttggccgtcctttaacgnggggccaggtaggaactcccaggcctaggtcagcggcaggtgggtctggtacttcgtcatctacacatacaactaacctgacaaatctagacgtactttgacttagttttattctgtcagtctagtctagaacgtactggtaccttctacgtttcgggcgggtaacggggacctaaagggggttcgaaacccgttacaaaaacggtaacgttgggacgtaccgttacggaccctaaccgtacgtttcccttcggtttaccctttacgtaacgttcccctttcccccggaccttaatttcccgg

SEQ ID NO: 301824 - DNA, 552 bp, Homo sapiens
  misc_feature: GZ8MTXP02HGHT7.8.28.C06.1.454.CMB.2.raw
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccngggganagagccaccctctcctgtgcggccagtcagagcgttaggacgaacttagcctggtatcagcagaggcctggccaggctcccagacctcctcatctttggcgtacctttaaacgaggggccaggtggaactccccagccaggttcaggcggcaggtggtctgggacttcgtcactctcacatcaataacctgacaatctagacgtactttgacttagtttattcgtgtcagctaagttctagaaagtcgtcgggtccgttacacgtttcggacggagggaaccgaaggtcggaactacgaaaacgtacgtggtcggctcgcacatctgttcttacacttcctcccgcaatc

SEQ ID NO: 301825 - DNA, 536 bp, Homo sapiens
  misc_feature: GZ8MTXP02JJB5L.8.28.C06.1.454.CMB.2.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (509)..(509): a, c, t, g, unknown or other
  misc_feature (509)..(509): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacgaacttagcctggtatcagcagaggcctggccaggctcccagactcctcatctttggcgtcctttaacaggggccagtggaactccccagccaggttcagcggcagtgggtctgggacttcgtcactctcaccatcaataacctgacaatctgacactttgctagtttatttctgtcagtcagtctagaacgactggccgttcacgtttcgggacggtagggaccaagggtggacctacgaaaacgactggtcggactcgcaacctntctcgtcttcactccgtcccgctactc

SEQ ID NO: 301826 - DNA, 626 bp, Homo sapiens
  misc_feature: GZ8MTXP02GUNVK.8.28.C06.1.454.CMB.2.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (213)..(213): a, c, t, g, unknown or other
  misc_feature (213)..(213): n is a, c, g, or t
  modified_base (595)..(595): a, c, t, g, unknown or other
  misc_feature (595)..(595): n is a, c, g, or t
  modified_base (619)..(619): a, c, t, g, unknown or other
  misc_feature (619)..(619): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctntcctgtgcggccagtcagagcgttaggacgtaacttagcctggtatcagcagaggcctggccaggcctcccagacctcctcacttctttggccgtacctttaacgaggggtcccaaggtcggaactccccgaagtcccgtaggttccaagggccggcgtagggtcggggtctcggggtacctttcggttacaaccttcctccaaccctataccaaacttacccgtgacctaaatctacgacgtaactttgacttaggttttacttcgttgtacagctaagtctaggaacgtacgtcgggtcccttacgtaccgtttcgggacgggacgggtaaccaaggggttcgaacctacgaaaaccgtagtggcgtctacgccaacctntcgtcgttctactcttccctaccnctactcg

SEQ ID NO: 301827 - DNA, 598 bp, Homo sapiens
  misc_feature: GZ8MTXP02H8ERD.8.28.C06.1.454.CMB.2.raw
  modified_base (206)..(206): a, c, t, g, unknown or other
  misc_feature (206)..(206): n is a, c, g, or t
  modified_base (212)..(212): a, c, t, g, unknown or other
  misc_feature (212)..(212): n is a, c, g, or t
  modified_base (268)..(268): a, c, t, g, unknown or other
  misc_feature (268)..(268): n is a, c, g, or t
  modified_base (324)..(324): a, c, t, g, unknown or other
  misc_feature (324)..(324): n is a, c, g, or t
  modified_base (352)..(352): a, c, t, g, unknown or other
  misc_feature (352)..(352): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccacctctcctgtgcggccagtcagagcgttaggacgaacttagcctggtancagcagaggcctggccaggctccccagacctcctcatcttggcctacctttaacgngggccagtggaatccagcaggtcagcgnagtggctgggacttgtcactctcacatcaaataactgacaatctagactactttgcttagtttattcgttgtctagtctaggtctagaacgtacgttcgggtcccgtttacgtaaccgtttcggggaccggggtaacggggtaaccggtaaacgggggttacggaacccttaacgaaaaccggtaaaccgtgggttaacggcgtaacggaccaacctacgttccgtacggtttccttacgtacccg

SEQ ID NO: 301828 - DNA, 562 bp, Homo sapiens
  misc_feature: GZ8MTXP02IYDMS.8.28.C06.1.454.CMB.2.raw
  modified_base (201)..(201): a, c, t, g, unknown or other
  misc_feature (201)..(201): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctgggganagagccaccctctcctgtgcggccagtcagagcgttaggacgaacttagcctggtatcagcagaggcctggccaggctcccagacctcctcatctttggcgtcctttaacgagggccagtggaactccccagccaggttcaggcggcaggtgggtctggggacttcgttcactctcacatcaaatacctgacaatctagacgtactttgactagtttattctgtcagcagttctagacgactcggtccgttacacgtttcgggcgggtacgggaccgaagggttacggacctacgaaaacgtacgtggtcggctacggccacctactctgttcttacacttcccttcccgacctacttccg

SEQ ID NO: 301829 - DNA, 596 bp, Homo sapiens
  misc_feature: GZ8MTXP02J1CI2.8.28.C06.1.454.CMB.2.raw
  modified_base (201)..(201): a, c, t, g, unknown or other
  misc_feature (201)..(201): n is a, c, g, or t
  modified_base (291)..(291): a, c, t, g, unknown or other
  misc_feature (291)..(291): n is a, c, g, or t
  modified_base (311)..(311): a, c, t, g, unknown or other
  misc_feature (311)..(311): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctgggganagagccacccctctcctgtgcggccagtcagagcgttaggacgaacttagcctggtatcagcagaggcctggccaggctccagactcctnatctttggcgcctttaacgnggccagtgaactcccagccaggttccagcggcaggtgggtctggggacttcgttcactctcaccatcaaatacctgacaatcctgactactttgctagtttattctgtcagacaggttctaggagtactgggtccctttacacgtttccggggacggtacggggaccctaagggtcggtaaaccctacaaaacggtaactcggtacggtacgtacgaccacctaacgtacccttaaggtttcccttcctaactttcccctttcccccggaacctactttacccgg

SEQ ID NO: 301830 - DNA, 555 bp, Homo sapiens
  misc_feature: GZ8MTXP02FQ28O.8.28.C06.1.454.CMB.2.raw
  modified_base (195)..(195): a, c, t, g, unknown or other
  misc_feature (195)..(195): n is a, c, g, or t
  modified_base (310)..(310): a, c, t, g, unknown or other
  misc_feature (310)..(310): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgcggccagtcagagcgttaggacgaacttagcctggtatcagcagaggcctggccaggctcccagactcctcatctttggcgcctttaacngggccagtggaactcccagccaggtcagcgcagtggtctgggacttcgtcactctcaccatcaataacctgacaatctgacgtactttgctagtttatttctgttcagtcagtctagaacgtacgtgggtcccgtttacaccgtttcgggcgggaagggacccgaagggtcggacctacgaaaacgtaacgtggtcggctcgacctaccatctgttcttacacttcccttcccgacctacttccg

SEQ ID NO: 301831 - DNA, 603 bp, Homo sapiens
  misc_feature: GZ8MTXP02JUTU0.8.28.C06.1.454.CMB.2.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (394)..(394): a, c, t, g, unknown or other
  misc_feature (394)..(394): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacgaacttagcctggtatcagcagaggcctggccaggcctcccagacctcctcattcgtttggcctcctttaacgcgggccaggtggaactcccgagccaggttcaggcggcacggtgggtctgggactttcgtcactctcacatacaataccngacaaatctagacgtacttgactagttttattctagtacaggctaggtctaggaacgtacgtcggtccgttctacgtttcggggacggggtacgggaaccgtaaggggtcgaacccgtacgaaaaccgtagttcgggtaggtccgtaggaccctacgtacgttcctcggttaccttcgtaccttcccgtttccccgactacggttcccg

SEQ ID NO: 301832 - DNA, 597 bp, Homo sapiens
  misc_feature: GZ8MTXP02H7OME.8.28.C06.1.454.CMB.2.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (569)..(569): a, c, t, g, unknown or other
  misc_feature (569)..(569): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccacctctcctgtgcggccagtcagagcgttaggacgtaacttagcctggtatcagcagagcctggccaggcctacccagacctcctcattcgtttggccgtcctttaaacgacggggtcccaggtacggaactccccgagcccgtaggttccaggcggctaggtgggtctgggtacttcgtcactctcacatacaaatacctgactaatctagaccgtaactttcgactttagttttactttctcgttacacgctaaggttcttaggaaacgtacgttcggtaccgtttctaacgtttcggggacggtagggaacctaagggtcgaacctacgtaaaacgacgttggtacgctcgaccaactntctgtcttcacttccgtcccgctactcg

SEQ ID NO: 301833 - DNA, 591 bp, Homo sapiens
  misc_feature: GZ8MTXP02HDO6M.8.28.C06.1.454.CMB.2.raw
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccngggganagagccaccctctcctgtgcggccagtcagagcgttaggacaacttagcctggtatcagcaggaggcctggccaggcctcccagacctcctcatctttggccgtcctttaacgaggggccaggtggaactcccagccaggtcagcggcaggtggtctgggacttcgtcactctcacatcaatactgacaatctagactctttgcttagttttacttctgtcagtctagtctagaacgtactcgggtaccgttctacgtttcggggacgggtaacgggtaccgtaagggttaccgggaaccttaacgaaaacggtaccgttggtcggactcggtaccaaccgtattccgtcgttccttacctactttcccgttcccccgactacgttccg

SEQ ID NO: 301834 - DNA, 598 bp, Homo sapiens
  misc_feature: GZ8MTXP02I4I51.8.28.C06.1.454.CMB.2.raw
  modified_base (196)..(196): a, c, t, g, unknown or other
  misc_feature (196)..(196): n is a, c, g, or t
  modified_base (579)..(579): a, c, t, g, unknown or other
  misc_feature (579)..(579): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccnggggagagagccaccctctcctgtgcggccagtcagagcgttaggacgaacttagcctggtatcagcagacggcctggccaggcctcccagacctcctcattcgtttggccgtacctttaacgaggggccaggtcggaactcccgagccgtaggtcaggcggcgtacggtggggtctgggtactttcgtcactctcaaccatacaaatactgactaatctagtacgtactttcgtacttagtttattctgtcagctaagtctaggaaactcgtcggtccgtttactaccgtttcgggacggggtaacggaccgtaagggtacggacccgtaacgaaaaccgaacgtcggacggtactacggaccacctagttctcgtcttacncttccgtccctcctactcg

SEQ ID NO: 301835 - DNA, 600 bp, Homo sapiens
  misc_feature: GZ8MTXP02JCPCM.8.28.C06.1.454.CMB.2.raw
  modified_base (194)..(194): a, c, t, g, unknown or other
  misc_feature (194)..(194): n is a, c, g, or t
  modified_base (200)..(200): a, c, t, g, unknown or other
  misc_feature (200)..(200): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgttttccngggganagagccaccctctcctgtgcggccagtcagagcgttaggacgaacttagcctggtatcagcagaggcctggccaggctcccagactcctcatctttggcgtcctttaacgagggccagtggaactcccagccaggttcagcggcagtgggtctggacttcgtcactctcacatacaatactgacaatctagacgtactttgctagtttattacgtgttacagctagtctagaatacgtggtccgttacacgtttcgggaccgggaagggaccgtaaagggttacgggaacctaaccgaaaacggtaaaccgttggtaacggtcttacggaccaacccgttattccgtaacggttccctttacgtaaccgtttcccttcccccggtacccctaatttcccg

SEQ ID NO: 301836 - DNA, 587 bp, Homo sapiens
  misc_feature: GZ8MTXP02GN2OT.8.28.C06.1.454.CMB.2.raw
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
  modified_base (314)..(314): a, c, t, g, unknown or other
  misc_feature (314)..(314): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccngggganagagccaccctctcctgtgcggccagtcagagcgttaggacgaacttgcctggtatcagcagagcctggccaggcctacccagacctcctcattctttggctcctttaacgngggccaggtggaactcccgagcctagggttccaggccggcaggtcggggtctggggaccttcggttccacttccgtcaccatcaaattaacctgactatctgacgtactttgcttagtttattctgttacagctagtctagaacgtactcggccgtttacacgtttcgggacgggtaggaaccgtagggtacgtacctacgaaaacgtaacgtggtacggacttacggccaaccttatcgttgttcttactacttcctacccgtacctactcg

SEQ ID NO: 301837 - DNA, 547 bp, Homo sapiens
  misc_feature: GZ8MTXP02IEC92.8.28.C06.1.454.CMB.2.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (214)..(214): a, c, t, g, unknown or other
  misc_feature (214)..(214): n is a, c, g, or t
  modified_base (286)..(286): a, c, t, g, unknown or other
  misc_feature (286)..(286): n is a, c, g, or t
  modified_base (380)..(380): a, c, t, g, unknown or other
  misc_feature (380)..(380): n is a, c, g, or t
  modified_base (404)..(404): a, c, t, g, unknown or other
  misc_feature (404)..(404): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagcccaccctntcctgtgcggccagtcagagcgttaggacaattgcctggatcagcagagcctggccaggctccagactcctnatctttggctcctttaacaggccagtggaatcccagccaggttcagcggcagtggtcgtgggacttcgtcactctcaccataccaaataccgtnacatctgtactacttgattatttnttctgctagctagtcgtagagtcgtcggtccgttcgtaccggttcgggacgggtaacgggacgtaagggtacgaaccgtaacgaaacgtacgtggtacgcgtcgacacctatcgtcgtcctactactcctacccgactactcg

SEQ ID NO: 301838 - DNA, 575 bp, Homo sapiens
  misc_feature: GZ8MTXP02GYH03.8.28.C06.1.454.CMB.2.raw
  modified_base (206)..(206): a, c, t, g, unknown or other
  misc_feature (206)..(206): n is a, c, g, or t
  modified_base (212)..(212): a, c, t, g, unknown or other
  misc_feature (212)..(212): n is a, c, g, or t
  modified_base (276)..(276): a, c, t, g, unknown or other
  misc_feature (276)..(276): n is a, c, g, or t
  modified_base (322)..(322): a, c, t, g, unknown or other
  misc_feature (322)..(322): n is a, c, g, or t
tcagctcgcgtgtccacgaccggtgctcgatttagagctcacgtattgggtttggggagagctctggggaggaactgctcagttaggacccagacggaaccatggaggccccagcgcagcttctcttcctcctgctactctggctcccagagatcattggagaagtggtgatgacacagtctccggtcaccctgtcttgttttccngggganagagccaccctctcctgtgcggccagtcagagcgttaggacgaacttagctggtatcagcaggngcctggccaggctcccagacctcctcatctttggcgtccttaacgngggccagtggaaactcccagccacggtcagcggcaggtggtctggggtacttcgtcacttcctcaccatacaataaccctgacatctagtacgtacttgtactagtttactttcttgtacctagtacgtatcgtagaacgtacgtcggtccgttactaccgtttcgggacgggtaacgggaaccgtaaggggtacgaaccgtacgaaaacgtacgtaggtccgtagtaacgccaccactcgtcttctactacc

SEQ ID NO: 301839 - DNA, 645 bp, Homo sapiens
  misc_feature: GZ8MTXP02IYTBC.8.28.C06.1.454.CMB.2.raw
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
  modified_base (313)..(313): a, c, t, g, unknown or other
  misc_feature (313)..(313): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccngggganagagccaccctctcctgtgcggccagtcagagcgttaggacaacttgcctggtatcagcagaggcctggccaggcctcccagacctcctcatctttggcgtcctttaacgngggccaggtggaactcccgagccgtaggttcaggcggcaggtggtcgtgggtacttcgtcactctcacatacaactaactgactaatctagacgtactttgcttagtttacttcgtgtcacgtctagtcgtagaacgtccgttcgggttacccgttccgtaccggtttcgggacggggtaacggggtaaccgaacggggttaccggaaacccgtaacgtaaaaccggtaacggttcgggtacggggtccttacgggaccctaaacccgtacgttaccgttcggttaccctttcgttaccttcccgtttacccccggccttaacgtttcccgg

SEQ ID NO: 301840 - DNA, 597 bp, Homo sapiens
  misc_feature: GZ8MTXP02GN5CB.8.28.C06.1.454.CMB.2.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (313)..(313): a, c, t, g, unknown or other
  misc_feature (313)..(313): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacgaacttagcctggtatcagcagaggcctggccaggctcccagacctcctcatctttggcgtcctttaacgngggccagtggaactcccagccaggttcagcggcaggtgggtctgggacttcgttcactcctcaccatacaataacctgacaatctagactactttgacttagtttattctgttcagctagtctagaagtacgtcgggtaccgttctaacgtttccggggacgggtacggggaacccgtaaggggtacggtaacccgtaacgtaaaacggtaacgttggtacggcttacggaccaacctattccgtgttcccttactacttcccgttccccgacctacgtttccg

SEQ ID NO: 301841 - DNA, 581 bp, Homo sapiens
  misc_feature: GZ8MTXP02GC3MI.8.28.C06.1.454.CMB.2.raw
  modified_base (205)..(205): a, c, t, g, unknown or other
  misc_feature (205)..(205): n is a, c, g, or t
  modified_base (211)..(211): a, c, t, g, unknown or other
  misc_feature (211)..(211): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctccagagatcattggagaagtggtgatgacacagtctccggtcaccctgtctgtttttccngggganagagccaccctctcctgtgcggccagtcagagcgttaggacgaactagcctggtatcagcagaggcctggccaggctcccagactcctcatctttggcgtcctttaaacgacggggccaggtacggaactccccaaggccaacgggttcaacgcgggctaggtggggtctggggacttcggttcacttcctacacctatcaataaaccctgacaatctgactacttgctagtttattctgtctagcctagtctagaacgtacgtcggtaccttccgtagttcgggacgggtacggacgtaacgggtcgaaccgtaacgaaacgtacgtaggtacgcgtggaccaactacgtcctcgtaccttacgtaccc

SEQ ID NO: 301842 - DNA, 629 bp, Homo sapiens
  misc_feature: GZ8MTXP02JIIQ4.8.28.C06.1.454.CMB.2.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcattctttggcgtacctttaacgagggccagtggaaactcccagccaggttcagcggcaggtgggtctgggacttcgtcactctcaccataccaaataacctgactaactctagtacctactttgcttagttttacttcgttagttctagttacgttacgtagaacgtacgtcggtcccgttacgtacgtttcggggacggggtacgggaaccgtaagggtaccggaaccgtaacgaaaaccggtaacgtcggtcgggtaccgtacgaccgtacctacgttaccgttcgttaaccgtttacctaacgtttccccttcccggacccttactccgtaacgg

SEQ ID NO: 301843 - DNA, 618 bp, Homo sapiens
  misc_feature: GZ8MTXP02I653G.8.28.C06.1.454.CMB.2.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (213)..(213): a, c, t, g, unknown or other
  misc_feature (213)..(213): n is a, c, g, or t
  modified_base (312)..(312): a, c, t, g, unknown or other
  misc_feature (312)..(312): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctntcctgtgcggccagtcagagcgttaggacgaacttagcctggtatcagcagaggcctggccaggctcccagactcctcatctttggcgtcctttaacgngggccagtcggaactcccagccaggttcaggcggcaggtggtctgggacttcgtcactctcacatacaatacctgacaaatctagtactactttgactagtttattctgtcagtctagtctagaacgtacgtcgggtaccgttctaaccgtttcgggacggggttacgggaacccgtaagggtacggtaacccgtaacgtaaaaccggtaacgtcgggtacggaccgttacggacctaaccgtagttcccgttaaggttccctttactaccgttccctttaccccggtaccctaacgtttacccgg

SEQ ID NO: 301844 - DNA, 579 bp, Homo sapiens
  misc_feature: GZ8MTXP02J18WF.8.28.C06.1.454.CMB.2.raw
  modified_base (207)..(207): a, c, t, g, unknown or other
  misc_feature (207)..(207): n is a, c, g, or t
  modified_base (213)..(213): a, c, t, g, unknown or other
  misc_feature (213)..(213): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtctgtttttccgngggganagagccaccctctcctgtgcggccagtcagagcgttagacaacttagctggtatcagcagaggcctggccaggctaccccagacctcctcattcgtttggccgtacctttaacgagggccaggtggaactcccgagccaggtcagcgctaggtcggggtctggggtacttcgttcactcctcacctatacaaactaacctgactaatctaggaccgtactttgacttagttttattactgtcagctagtctagaacgtacgtcggacccgtttacgtacgtttcggacggggtacggtaccgaaggtacggacctaacgtaaaacgaacgtcggtacgcgtcgaccacactcgtacgttctactac

SEQ ID NO: 301845 - DNA, 611 bp, Homo sapiens
  misc_feature: GZ8MTXP02IG4J6.8.28.C06.1.454.CMB.2.raw
  modified_base (208)..(208): a, c, t, g, unknown or other
  misc_feature (208)..(208): n is a, c, g, or t
  modified_base (214)..(214): a, c, t, g, unknown or other
  misc_feature (214)..(214): n is a, c, g, or t
  modified_base (242)..(242): a, c, t, g, unknown or other
  misc_feature (242)..(242): n is a, c, g, or t
  modified_base (444)..(444): a, c, t, g, unknown or other
  misc_feature (444)..(444): n is a, c, g, or t
tcagctcgcgtgtccacgaccggtgctcgatttagagctcacgtattgggtttggggagagctctgggggaggaactgctcagttaggacccagacggaaccatggaagccccagcgcagcttctcttcctcctgctactctggctcccagagatcattggagaagtggtgatgacacagtctccggtcaccctgtcttgtttttccngggganagagccacctctcctgtgcgcagtcagngtcgtaggacgtaacttagctggtatcagcagagcctggccaggctccccgagacctcctcattcgtttggccgtacctttaaacgcgggtacctaggtacgggaactccccgaggccctaggttcaacggcggacaggttacggggtctgggggtacctttcggtacctaccttcctacacctagtactaataacccgtanactactcgtagtacgtacttgtacttatttacttcgtacgtactagtctagtacgtagtacgtacgtcgtcgttacgtacggttacgggacggtacggtacgtaggtacgacctaacgaaacgtacgtacggtacgacgtcgactactactactacgttactactac

SEQ ID NO: 301846 - DNA, 566 bp, Homo sapiens
  misc_feature: GZ8MTXP02IFE7I.8.28.C06.1.454.CMB.2.raw
  modified_base (193)..(193): a, c, t, g, unknown or other
  misc_feature (193)..(193): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctccagagatcattggagaagtggtgatgacacagtctccggtcaccctgtctgttttccngggagagagccacctctcctgtgcggccagtcagagcgttaggacgaacttagcctggtatcagcagaggcctggccaggctcccagactcctcatctttggctcctttaaacgagggccaagtggaactcccagcctaggttcagcggcaggtgggtctggggtacttcgttcactctcacatctaaatacctgacaatcctagacgtactttgctagtttattctgtcagcagtcttagaagtactggtccgttactacgtttcgggcgggtaacgggacccgaaaggggttcgaaccgtacgaaaacgaacgtggtacggcgttacggcctaacccattctgttccttcactccttcccgctaacgtccg

SEQ ID NO: 301847 - DNA, 583 bp, Homo sapiens
  misc_feature: GZ8MTXP02HRI3X.8.28.C06.1.454.CMB.2.raw
  modified_base (199)..(199): a, c, t, g, unknown or other
  misc_feature (199)..(199): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctgctcccagagatcattggagaagtggtgatgacacagtctccggtcaccctgtctgttttcctgggganagagccaccctctcctgtgcggccagtcagagcgttaggacgaacttagcctggtatcagcagaggcctggccagggcctccccagacctccctcactttccgtttggccgtaccctttaaacgaggggcccaaggtcggaaactcccgagcccgtaggttcaggcggctacggtggggtcctggggtactttcgttccactcctacaccatacaaacgtaacctgactaatctagacgtactttgctttagtttatttctgttcagtctagtctagaacgtacgttcggtccgtttctacgtttcgggacggacggggaccaagggtcgacctacgaacgacgtgacgctgacacatcgtgtcttcactcctcccgctactcg

SEQ ID NO: 301848 - DNA, 599 bp, Homo sapiens
  misc_feature: GZ8MTXP02IDNVH.8.28.C06.1.454.CMB.2.raw
  modified_base (557)..(557): a, c, t, g, unknown or other
  misc_feature (557)..(557): n is a, c, g, or t
  modified_base (574)..(574): a, c, t, g, unknown or other
  misc_feature (574)..(574): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttcctggggagagagccaccctctcctgtgcggccagtcagagcgttaggacgaacttagcctggtatcagcagaggcctggccaggcctcccagacctcctcattcgttttcggccgtaccttttaaacgacggggtcccaggtcggaaactcccccgagccctaggttccaggccggcaggttcgggtctggggtacttcgtccactctcacatacaatactgctaatctgacgtactttgcttagtttacttctgtcagtcagtctaggaacgtcgtggtccgttcgtacgtttcgggacgggtacgggaccgaagggtcgaacctacgaaaacgtacgtggtcggacgttcgacctaacctnttcgtcgttcctttacncttcccgttccccgactactttccg

SEQ ID NO: 301849 - DNA, 641 bp, Homo sapiens
  misc_feature: GZ8MTXP02HIIRH.8.28.C06.1.454.CMB.2.raw
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
  modified_base (611)..(611): a, c, t, g, unknown or other
  misc_feature (611)..(611): n is a, c, g, or t
  modified_base (617)..(617): a, c, t, g, unknown or other
  misc_feature (617)..(617): n is a, c, g, or t
  modified_base (638)..(638): a, c, t, g, unknown or other
  misc_feature (638)..(638): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccngggganagagccaccctctcctgtgcggccagtcagagcgttaggacaacttagcctggtatcagcagaggctggccaggcctcccagacctcctcattcgtttggccgtcccttttaacgacggggtcccaaggttacgggaaactcccccgaggtcccgaagggtttccaacggtccggacacggggttcggggtccgtacgggggtacctttcggtttccaccgttccttaccaacctaacgttaccaaaaccttaaccctgacctaaatccgtagaacgttactttgaccgtttagtttttactttacttacgtcgtagcgtaacggttcttaggaagtacgtcgggtccgttacgtacgtttcggacgggtaggaccgaaggtcgacctacgaaacgacgttgcgcgtcncgactntctgtctctactccttccgcntcg

SEQ ID NO: 301850 - DNA, 619 bp, Homo sapiens
  misc_feature: GZ8MTXP02H9SP8.8.28.C06.1.454.CMB.2.raw
  modified_base (194)..(194): a, c, t, g, unknown or other
  misc_feature (194)..(194): n is a, c, g, or t
  modified_base (200)..(200): a, c, t, g, unknown or other
  misc_feature (200)..(200): n is a, c, g, or t
  modified_base (397)..(397): a, c, t, g, unknown or other
  misc_feature (397)..(397): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgttttccngggganagagccaccctctcctgtgcggccagtcagagcgttaggacaacttagcctggtatcagcagaggcctggccaggcctcccagacctcctcattcgtttggccgtacctttaacgagggccaggtaggaactccccagccgtaggttcaggcggcaggtgggtctgggtacttcgtcactctcaccatacaataccngactaatctgacgtctttgcttagtttattctgttacagtctagtctaggaacgtaccgttcgggtcccgtttacgtaccgtttcggggacggggtaacggggaaccgtaaggggtaccggtaacccgtacgtaaaaacggtacgtcgggtacggtaccgtacggccctaaaccgtcttccgtcgttccttacgtacttcccttccccgtactacgtttccg

SEQ ID NO: 301851 - DNA, 610 bp, Homo sapiens
  misc_feature: GZ8MTXP02HHCEQ.8.28.C06.1.454.CMB.2.raw
  modified_base (201)..(201): a, c, t, g, unknown or other
  misc_feature (201)..(201): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctgggganagagccaccctctcctgtgcggccagtcagagcgttaggacgaacttagcctggtatcagcagaggcctggccaggcctcccagacctcctcacttcgtttggccgtacctttaaacgcggggccctaggtacgggaaactcccccgaagtcccgaagggttccaggccggcacggtcggggtccgtggggtacctttcgttccacttccgtacaacctataccaaaattaccctgactaaatctagacgtactttgacttagttttacttctagtcagctagtctaggaatacgtgggtccttctacgttcgggcggtacgggacgtaaggtcggaactaccgaaaacgacgtggtacgctcgaccacctagtcttcgtctttacacgttccttaccccgctacttcg

SEQ ID NO: 301852 - DNA, 517 bp, Homo sapiens
  misc_feature: GZ8MTXP02GAUG8.8.28.C06.1.454.CMB.2.raw
  modified_base (360)..(360): a, c, t, g, unknown or other
  misc_feature (360)..(360): n is a, c, g, or t
tcagctcgcgtgtccacgaccggtgctcgatttagagctcacgtattgggtttgggggaggaactgctcagttatgacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacgaggccagtggaatcccagccagtcagcgcagtggtctgggacttcgttcnctctcacatcaatacctgacaatctgacgtactttgctagtttatttctgtcagcagtctgaagctggccttcacgtttcggcggagggaccaagggtcggacctacgaaaacgactggtacggctcgcaccatcgtgtcttcatccttcccgctac

SEQ ID NO: 301853 - DNA, 589 bp, Homo sapiens
  misc_feature: GZ8MTXP02GARYD.8.28.C06.1.454.CMB.2.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttcctggggagagagccaccctctcctgtgcggccagtcagagcgttaggacgaacttagcctggtatcagcagaggcctggccagggctcccagactcctcatctttggcgcctttaacagggccagtggaatcccgagccaggttcagcggcagtgggtctggggacttcgtcactctcacatcaataacctgacaaatctgacgactttgctagtttatttctgtcagcagtctgaagtactagggtccgtttacaccgttttcgggacgggtaaggggtacccgaaaggggttcggaacccttacgaaaaacggaaccttagggtacggtacgttcggaccaaccctattccgtggttcctttcacttccctttaccccggaccctaatttccg

SEQ ID NO: 301854 - DNA, 776 bp, Homo sapiens
  misc_feature: GZ8MTXP02HMUCG.8.28.C06.1.454.CMB.2.raw
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccngggganagagccaccctctcctgtgcggccagtcagagcgttaggacgaacttagcctggtatcagcagaggcctggccaggcctcccagacctcctcacttcgtttggccgtacctttaaacgacggggaccctaaggtacgggaaacttcccccgaaggtcccgtaaggggtttccaacgggccggggtacgtaacggggttcgggggttccgttcgggggtacctttttccgggtttaccaaccttcccttaccaaccctaattaccctaaaacttaaccctgtaaccctaaacttccgtacggtaaccgttaacgttttcggtaccgtttaaggtttttacttttccgttggttaccacggtcctaaggttccgttaggtaaacggttaccgttcgggttacccgtttaccgtaaccggttttccgggggacgggggtaacggggaaccggtaaggggttaccggaacccgttaacggaaaaccggtaacgttacgggttacgggccttacggaccctaccgtaacgttccttaacggttccttcctacttaccctttccccgaccttacgttccg

SEQ ID NO: 301855 - DNA, 590 bp, Homo sapiens
  misc_feature: GZ8MTXP02JWYH6.8.28.C06.1.454.CMB.2.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacgaacttagcctggtatcagcagaggcctggccaggcctcccagacctcctcattctttggcgtccctttaacgagggcccaggtggaactccccgagccaggttcagcggcaggtgggtctgggactttcgtcactctcacatcaatacctgacaatctagacgtactttgactagtttattctgtcagtcagtctagacgtactcgggtccgttacacgtttccgggacggggtaacgggtacccgtaaaaggggttccggaaaccttacgaaaaccggtaaccgttgtacgggcctagaccgaacccaattcctgtccttacacttcccttacccgcctaagtccg

SEQ ID NO: 301856 - DNA, 614 bp, Homo sapiens
  misc_feature: GZ8MTXP02HCJST.8.28.C06.1.454.CMB.2.raw
  modified_base (207)..(207): a, c, t, g, unknown or other
  misc_feature (207)..(207): n is a, c, g, or t
  modified_base (213)..(213): a, c, t, g, unknown or other
  misc_feature (213)..(213): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtcttgtttttccngggganagagccacctctcctgtgcggccagtcagagcgttaggacgtaacttagcctggtatcagcagaggcctggccaggcctcccagacctcctcatctttggcgtcctttaacgagggccagtggaaactcccagccacggttcagcggcaggtggggtctggggtacttcgtcactctacacctatacaaataacctgacaaatcgtagtaccgtacttttaggacttagttttactttcgtgttactacgtctagttctaaggaaagtaccgtcggtcccgtttactaccggtttccggggacgggtaacggggtaaccgaacgggttacggaaacccttaacgaaaacggtaccgtggtacggcttcgacctaacgtactcgtacttccttactaacccg

SEQ ID NO: 301857 - DNA, 577 bp, Homo sapiens
  misc_feature: GZ8MTXP02IITRZ.8.28.C06.1.454.CMB.2.raw
  modified_base (207)..(207): a, c, t, g, unknown or other
  misc_feature (207)..(207): n is a, c, g, or t
  modified_base (213)..(213): a, c, t, g, unknown or other
  misc_feature (213)..(213): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtcttgtttttccngggganagagccacctctcctgtgcggccagtcagagcgttaggacgaacttagcctggtatcagcagaggcctggcccaggcctccccagacctcctcattctttggcgtacctttaacgagggccagtggaactcccagccaggtcagcggcaggtggtctggggtacttcggtcactcctcaccataccaataacctgacaatctagacgtactttgactagtttatttctgttacagtcaagttcgtagaaacgtacttcgggtccgtttacgtacgtttcggggacggtaacgggaccgtaagggtacggaccttaacgaaaacggactggtacggactgccacgtacttcgtcgttactctacc

SEQ ID NO: 301858 - DNA, 742 bp, Homo sapiens
  misc_feature: GZ8MTXP02IOQWW.8.28.C06.1.454.CMB.2.raw
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
  modified_base (259)..(259): a, c, t, g, unknown or other
  misc_feature (259)..(259): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccngggganagagccaccctctcctgtgcggccagtcagagcgttaggacgaacttagcctggtancagcagagcctggccaggctcccagacctcctcattccgtttcggccgtaccctttaaacgacggggaccctaggttacggaaaccttcccccgaaggtcccgtaaggggtttcccaagggccggggacctaaggggttcggggtcctacgggggtaccttttcgggtttaccaccgttccttaccaaccctacttaccgtaaacttaaccctgaaccctaaattccgtacgacgttactttggaccttagtttttactttcctggttaccagtacctagttcttagaaacgttccgtcggggtccctttactaaccggtttcggggacggggtaacggggtacccgaaaggggtccggtaaccctaacggtaaaacggtaccgttggggtacgtccgttacgggaccctaaaccccgttacgtttccgttaacgtttcccttaccgtaccctttccccgtttacccccgtaccttacgtccg

SEQ ID NO: 301859 - DNA, 678 bp, Homo sapiens
  misc_feature: GZ8MTXP02JM6LL.8.28.C06.1.454.CMB.2.raw
  modified_base (195)..(195): a, c, t, g, unknown or other
  misc_feature (195)..(195): n is a, c, g, or t
  modified_base (230)..(230): a, c, t, g, unknown or other
  misc_feature (230)..(230): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgttttccnggggagagagccacctctcctgtgcgccagtcagngcgttaggacgaacttagcctggtatcagcagacggcctggccaggcctcccagtacctcctctacttcgtttcggccgtaccctttaacgacggggtaccctaggtacggaactcccccgagtcccgtaggttccaggccggtcgaggtcggggtacgtggggtaccttcgttccactcctccactatacaactaacctgactaatctagtacgtactttgacttagttttacttcgtgtacagtctagtcgtaggaagtaccgtcggtaccgttacgtacggtttaccggggacgggtaacggggaaccgtaacggggtaccggtaaaccccgtaacggtaaaaccggtaccggttggtaccggtccgttaccggaccctaaccgtaccttccgttccggttcccttaccgtaccgttccctttacccccggacccttattcccgg

SEQ ID NO: 301860 - DNA, 648 bp, Homo sapiens
  misc_feature: GZ8MTXP02I6M15.8.28.C06.1.454.CMB.2.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgttttcctggggagagagccaccctctcctgtgcggccagtcagagcgttaggacgaacttagcctggtatcagcagaggcctggccaggcctcccagacctcctcattcgtttggcgtcctttaaacgacggggcccaggtcggaaactccccgagcccgtaggttccaggccggcagggtgggtctgggtacttcgtcactctcacatcaataactgacaatcagtacgtactttgcttagtttattctgtcagtctaggttctaggtaacgtacgtgggtacccgttactaaccggtttcgggacggggtacggaacccgtaaggggttacgaaacccgttaaccggaaaacgtaacgttcgggtacggtaccgttacggaccctaaacccgtattccgttaacggttaccctttacctaacgttcccccgtttacccccggtccctaacgtttcccg

SEQ ID NO: 301861 - DNA, 697 bp, Homo sapiens
  misc_feature: GZ8MTXP02FK3RY.8.28.C06.1.454.CMB.2.raw
  modified_base (622)..(622): a, c, t, g, unknown or other
  misc_feature (622)..(622): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagagcctggccaggctcccagacctcctcatctttggccgtcctttaacgcgggtccaggtggaactcccagcctaggttcagcggcaggtgggtctggggtacttcgttcacgtctcacctatacaaataacctgactaaatcgtacgacgtactttgacttagtttaactttcgttacgttcacgtcgtacgttacctaggtaaacgtaccgtcgggttaccccgttttacgtaaccgttttcgggggaccgggtacgggggtaaacccgtaaagggggttaccggtaacccgttaaccggaaaaaccggtaaaccgttagggtcgggtacccgttacgggacccctaaaacccggtntttaaccccgtcggttacccttttaccggaaacccttttcccggttaccccccggtacctaccgttttaacccgg

SEQ ID NO: 301862 - DNA, 637 bp, Homo sapiens
  misc_feature: GZ8MTXP02J4VNF.8.28.C06.1.454.CMB.2.raw
  modified_base (198)..(198): a, c, t, g, unknown or other
  misc_feature (198)..(198): n is a, c, g, or t
  modified_base (267)..(267): a, c, t, g, unknown or other
  misc_feature (267)..(267): n is a, c, g, or t
  modified_base (630)..(630): a, c, t, g, unknown or other
  misc_feature (630)..(630): n is a, c, g, or t
tcagctcgcgtgtccacgaccggtgctcgatttagagctcacgtattgggtttgggggaggaactgctcagttaggaccagacggaaccatggaagccccagcgcagcttctcttcctcctgctactctggctcccagagatcattggagaagtggtgatgacacagtcctccggtcaccctgttcttggtttttccnggggagagagccaccctctcctgtgcggccagtcagagcgttaaggactaacttagcctggtatcagcngaggcctggccacgggcctcccagacctcctcattctttcggccgtacctttaacgacggggccaggtaggaactcccagccgtacggttcaggcggctacggtggggtctcgggtacttcgttccactctacaactcactaacgtctacacgtactagtacgtacgttacgtcttagttacgtttacgttttcttacgtcgtacgacgtcgtacgttacggacgtaacggtccggtaccggttccgttaccggtacggttacggggacggaaaccgggtaacgggtaacggtacgtaaaccgtaactacgtacgtacgtcgcgtaccactctacttcgttctacttcctcctcccgttaccncgttacg

SEQ ID NO: 301863 - DNA, 630 bp, Homo sapiens
  misc_feature: GZ8MTXP02INWYN.8.28.C06.1.454.CMB.2.raw
  modified_base (208)..(208): a, c, t, g, unknown or other
  misc_feature (208)..(208): n is a, c, g, or t
  modified_base (215)..(215): a, c, t, g, unknown or other
  misc_feature (215)..(215): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtcttgtttttccgnggggganagagcccacctctcctgtgcggccagtcagagtcgttaggacgtaacttagcctggtatcagcaggaggcctggccaggcctccccagacctcctcattcgtttcggcgtacctttaacgacgggtcctaggtacgggaaacctccccgaaagtcccgtacggttaccgaggccgggacgtagggttcggggtcttcgggggtacctttccggttacaccttcctacaccctatactaaactaacctgactaatctagacgtactttgacttagtttatttctgtcagctagtctagaacgtctcggtccgttcgtacgtttcgggacgggtacgggaccgtaagggtcggaaccgttaacgaaaacggtacgtacggtcgtctcggacaccgtactcgttcttctacttacccg

SEQ ID NO: 301864 - DNA, 587 bp, Homo sapiens
  misc_feature: GZ8MTXP02IGCDR.8.28.C06.1.454.CMB.2.raw
  modified_base (206)..(206): a, c, t, g, unknown or other
  misc_feature (206)..(206): n is a, c, g, or t
  modified_base (212)..(212): a, c, t, g, unknown or other
  misc_feature (212)..(212): n is a, c, g, or t
  modified_base (416)..(416): a, c, t, g, unknown or other
  misc_feature (416)..(416): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggcagtcagagtcgttaggacgtaacttagcctggtatcagcagacggcctggccaggcctcccgagacctcctcattccgtttggcgtacctttaacgacgggtccaggtggaaactcccgagccaggttcagcgcaggtggtctggggtactttcgtcactcctacacatactaatacctanactatctacgtacttacttcgtacttagtttacttcgtgtacgagtactagtacgtagaacgtcgtcggtccgttacgtacggttacgggacggtacggtaacgtaggtacgaaccgtaaacgaaacgtacgtacggtcgacgtaacgaccactactcgttctcttactcg

SEQ ID NO: 301865 - DNA, 625 bp, Homo sapiens
  misc_feature: GZ8MTXP02G9O5O.8.28.C06.1.454.CMB.2.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (292)..(292): a, c, t, g, unknown or other
  misc_feature (292)..(292): n is a, c, g, or t
  modified_base (312)..(312): a, c, t, g, unknown or other
  misc_feature (312)..(312): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacgaacttagcctggtatcagcagaggcctggccaggcctcccagacctccnatctttggctcctttaacgnggccagtggaactcccagccaggtcagcggcaggtgggtctgggacttcgtcactctcacatcaactaacctgacaatctagacgtactttgacttagtttattctgtcagtcagtctagaacgtctcgggtccgttacgtaccgtttcgggaccggggtaacgggaacccgtaaaggggttaccggtaacccgttaacgaaaaaccggtaaaccgttgggtaacggtccgtacggacctaaccccgtaatttccgttaaccgttccgtttaccgtaacgtttcccctttaccccggccctaagtttaccccg

SEQ ID NO: 301866 - DNA, 601 bp, Homo sapiens
  misc_feature: GZ8MTXP02FZI54.8.28.C06.1.454.CMB.2.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacgaacttagcctggtatcagcagagcctggccaggctcccagacctcctcatctttggcgcctttaacgagggcccagtggaactcccagccaggttcagcggcagtggtctgggacttcgtcactctcacatcaataacctgcaatctgacgactttgctagtttattctgtctagctaggtctgaacgacgtcgggtccgttacaccgtttcggggacggtacggggaacccgtaaggggttcggaaccctacgaaaaccggtaaccgttggtacgggtcttcggacctaacccctaagttcccttaaggtttcctttacctaactttcccgtttaccccggaccttaactttcccgg

SEQ ID NO: 301867 - DNA, 628 bp, Homo sapiens
  misc_feature: GZ8MTXP02F95EX.8.28.C06.1.454.CMB.2.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (256)..(256): a, c, t, g, unknown or other
  misc_feature (256)..(256): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacgaactgcctggtancagcagaggcctggccaggcctcccagacctcctcattctttggctcctttaacgacggggccaggtcggaaactccccgagcccgaggttcaggcggcgaggtggggtctggggtacttcgtcactctcacatcaactaactgactaaatctagacgtatttgcttagtttatttctgtcagtctagtctaggaagtacgttcgggcccgtttactaccggtttaccgggtacggggaacggggtaaccggaacgggtacggtacccgtaaaccgtaaaacggaaaccgttaggtacggtacggttcaccgtaaccctattccgttaacgttccgttactaccttccttacccccggtccacgtttacccg

SEQ ID NO: 301868 - DNA, 579 bp, Homo sapiens
  misc_feature: GZ8MTXP02INUT5.8.28.C06.1.454.CMB.2.raw
  modified_base (196)..(196): a, c, t, g, unknown or other
  misc_feature (196)..(196): n is a, c, g, or t
  modified_base (266)..(266): a, c, t, g, unknown or other
  misc_feature (266)..(266): n is a, c, g, or t
  modified_base (400)..(400): a, c, t, g, unknown or other
  misc_feature (400)..(400): n is a, c, g, or t
  modified_base (407)..(407): a, c, t, g, unknown or other
  misc_feature (407)..(407): n is a, c, g, or t
  modified_base (542)..(542): a, c, t, g, unknown or other
  misc_feature (542)..(542): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctccagagatcattggagaagtggtgatgacacagtctccggtcaccctgtcttgtttttccgnggggagagagccaccctctcctgtgcggccagtcagagcgttaaggacgaacttgcctggtatcagcagnggcctggccaggcctcccagactcctcattcgtttggccgtacctttaaacgacggggtcccaggtcggaaactccccgagcccgtaggtcaggcgcaggtggtctggacttcgtcactctcacatacaatacnacaatcngacgtacttgacttagtttattctgtcagtcagtctagaaagtcgtcggtcccgttataccgtttcgggacgggtacgggaccgtaagggtacgaacctacgaaaacggtaacgtggtcgactcgaccaaccttntctcgttacttactaccttcccgtcccgactacgtcg

SEQ ID NO: 301869 - DNA, 585 bp, Homo sapiens
  misc_feature: GZ8MTXP02J0ZCY.8.28.C06.1.454.CMB.2.raw
  modified_base (194)..(194): a, c, t, g, unknown or other
  misc_feature (194)..(194): n is a, c, g, or t
  modified_base (200)..(200): a, c, t, g, unknown or other
  misc_feature (200)..(200): n is a, c, g, or t
  modified_base (257)..(257): a, c, t, g, unknown or other
  misc_feature (257)..(257): n is a, c, g, or t
  modified_base (407)..(407): a, c, t, g, unknown or other
  misc_feature (407)..(407): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctcccagagatcattggagaagtggtgatgacacagtctccggtcaccctgtctgttttcngggganagagccacctctcctgtcgcggccagtcagagcgttaggacgaacttagcctggtancagcagaggctggccaggctccagactcctcatcgtttcggcgtacctttaacgacggggtccaggtacggactcccgaggccgtaggttcaggtcggacgtggtgggtcgtgggtacttcggtcactctcacctatacaactaccgtanactactcgtagtactattcgtacttagtttacttcgtgtactagtactagtacgtagtacgtcgtacggtacgttacgtacggttcgggacgggacggtacggacggtacgacgtaacgtaaacgtacgtcgtcgtcgcgaccacgtgtctctctactcttcccgtccgtactactcg

SEQ ID NO: 301870 - DNA, 589 bp, Homo sapiens
  misc_feature: GZ8MTXP02GQ41V.8.28.C06.1.454.CMB.2.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacaacttagcctggtatcagcagaggcctggccaggcctcccagacctcctcatctttggcgtcctttaacgagggccagtggaactcccagccaggttcagcggcaggtggtctggggacttcgtcactctcaccatacaaataacctgacaaatctacgacgtactttgacttagtttactttctagtcagtctagttctagaagtacgtcggtcccgttacgtaccgtttcggggacgggagggtaacccgaagggtacgacccgttacgaaaacgacgtaggtcggactcggacctaaccgtatccgtgttccttactacttcccgttaccccgcctacgttccg

SEQ ID NO: 301871 - DNA, 600 bp, Homo sapiens
  misc_feature: GZ8MTXP02JO0ME.8.28.C06.1.454.CMB.2.raw
  modified_base (291)..(291): a, c, t, g, unknown or other
  misc_feature (291)..(291): n is a, c, g, or t
  modified_base (312)..(312): a, c, t, g, unknown or other
  misc_feature (312)..(312): n is a, c, g, or t
  modified_base (344)..(344): a, c, t, g, unknown or other
  misc_feature (344)..(344): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctnatctttggcgtcctttaacgngggccagtggaactcccagccaggtcagcggnaggtggtctgggacttcgtcactctcacatacaatacctgacaatctagacgtactttgcttattttacttctgtacagtctaagtctagaacgtacgtcgggtacccgtttcgtaaccgtttcggggacgggtaacgggaaccgtaacggggtacggaacccgtaacggaaaacgtacgttgggtacggccgttacggacctaaccgtacttcgttcgttccttaccgtacttccctttccccgacctacttccg

SEQ ID NO: 301872 - DNA, 563 bp, Homo sapiens
  misc_feature: GZ8MTXP02HKGSU.8.28.C06.1.454.CMB.2.raw
  modified_base (311)..(311): a, c, t, g, unknown or other
  misc_feature (311)..(311): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgtcctttaacngggccagtggaatcccagccaggtcagcggcagtggtctgggacttcgtcactctcaccataccaataacctgaccaaatctagacgtactttgctagtttattctagtcagcagttctagaagtacgtcggtaccgttctaacgtttccgggacgggtacgggaaccgtaaagggttcggaacctacgaaaacgtaacgtggtacggctacgaccactactctggtcttcacttccttcccgctacttccg

SEQ ID NO: 301873 - DNA, 617 bp, Homo sapiens
  misc_feature: GZ8MTXP02ICUCL.8.28.C06.1.454.CMB.2.raw
  modified_base (196)..(196): a, c, t, g, unknown or other
  misc_feature (196)..(196): n is a, c, g, or t
  modified_base (265)..(265): a, c, t, g, unknown or other
  misc_feature (265)..(265): n is a, c, g, or t
  modified_base (288)..(288): a, c, t, g, unknown or other
  misc_feature (288)..(288): n is a, c, g, or t
  modified_base (359)..(359): a, c, t, g, unknown or other
  misc_feature (359)..(359): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgttctgtttttccnggggagagagccaccctctcctgtgcggccagtcagagcgttaggacaacttagcctggtatcagcagnggctggccaggctccagctcctnatcttgcgtctttaacagggccagtggaactcccagccaggtcagcgcagtggtctggacttcgtcactcncacatacaataacctgacaatctagacgtactttgacttagttttactttctgtacagctagttcgtagaaacgtctacggtccgttactacggtttcgggacgggtacggtaaccgtaaggggtaccggtaaccgtaaccgtaaaaacggtaaccggttgggtacggtaccgttacggcccgaaaccgttacttaccgttcggttcccttttaccgaccttttccccggttcccccgtaacgttaacctttacccgg

SEQ ID NO: 301874 - DNA, 609 bp, Homo sapiens
  misc_feature: GZ8MTXP02GGJTG.8.28.C06.1.454.CMB.2.raw
  modified_base (207)..(207): a, c, t, g, unknown or other
  misc_feature (207)..(207): n is a, c, g, or t
  modified_base (213)..(213): a, c, t, g, unknown or other
  misc_feature (213)..(213): n is a, c, g, or t
tcagctcgcgtgtccacgaccggtgctcgatttagagctcacgtattgggtttggggagagctctggggaggaactgctcagttaggacccagacggaaccatggaagcccccagcgcagcttctcttcctcctgctactctggctcccagagatcattggagaagtggtgatgacacagtctccggtcaccctgtctgtttttccngggganagagccaccctctcctgtgcggccagtcagagcgttaggacgaacttagcctggtatcagcagaggcctggccaggctcccagactcctcatctttggcgtcctttaacgagggccaggtggaaactcccagccaggttcagcggcaggtgggtctggggtacttcgtcactctcaccatcaaataaccctgacaatctgacgtactttgctagtttattctgtcagtctagtctagaaacgtacgttgggtcccgtttacgtaccgttttcgggggacgggtaacggggaacccgtaaaggggtacggaacccgttaaccgaaaacggtaaaccgttacggtgggtaccgtaacggacctaacccgtattaccttacggttacctttcgtaaccg

SEQ ID NO: 301875 - DNA, 556 bp, Homo sapiens
  misc_feature: GZ8MTXP02FJP26.8.28.C06.1.454.CMB.2.raw
  modified_base (314)..(314): a, c, t, g, unknown or other
  misc_feature (314)..(314): n is a, c, g, or t
  modified_base (451)..(451): a, c, t, g, unknown or other
  misc_feature (451)..(451): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagacctcctcatctttggccgtcctttaacgngggccagtggaactccccagccaggttcagcggcagtgggtctggggacttcgtcactctcaccataccaataacctgacaatctgacgtactttgctagtttatttctgtcagcagtctagagactggtcccgttnaccgtttcgggcgggtaaggggaccaaagggtcggacctacgaaaacgtaactggtcggctcggacctaccatctgttccttcacttcccttcccgacctactcg

SEQ ID NO: 301876 - DNA, 644 bp, Homo sapiens
  misc_feature: GZ8MTXP02HN8FV.8.28.C06.1.454.CMB.2.raw
  modified_base (196)..(196): a, c, t, g, unknown or other
  misc_feature (196)..(196): n is a, c, g, or t
  modified_base (396)..(396): a, c, t, g, unknown or other
  misc_feature (396)..(396): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccnggggagagagccaccctctcctgtgcggccagtcagagcgttaggacgaacttagcctggtatcagcagaggcctggccaggctcccagactcctcattctttggcgtcctttaacgagggccagtggaactccccgagccgaggttcaggcggcaggtgggtcgtgggtactttcgtccactctcacatacaataaccngacatctgaactctttgcttagttttactttctagtcacgctacgttctacggtaacgtacgtcgggttacccgtttaccgtaccggtttccggggacggggtaacggggaccgtaaaggggttcgggtaacttaccgtaaccgaaaacggtaacgttacgggtcgggtactacggaccctaaccgtaacgttccgttcggtttaccctttacctaacctttccccgttacccccggtactttaaccg

SEQ ID NO: 301877 - DNA, 648 bp, Homo sapiens
  misc_feature: GZ8MTXP02HOKQA.8.28.C06.1.454.CMB.2.raw
  modified_base (197)..(197): a, c, t, g, unknown or other
  misc_feature (197)..(197): n is a, c, g, or t
  modified_base (203)..(203): a, c, t, g, unknown or other
  misc_feature (203)..(203): n is a, c, g, or t
  modified_base (266)..(266): a, c, t, g, unknown or other
  misc_feature (266)..(266): n is a, c, g, or t
  modified_base (291)..(291): a, c, t, g, unknown or other
  misc_feature (291)..(291): n is a, c, g, or t
  modified_base (411)..(411): a, c, t, g, unknown or other
  misc_feature (411)..(411): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctcccagagatcattggagaagtggtgatgacacagtctccggtcaccctgtcttgtttttccngggganagagccacctctcctgtgcggccagtcagagcgttaggactaacttagcctggtatcagcagngcctggcaggctcccagacctcctntatcgtttcggctacctttaaagcgggaccagtacggaactccccagccgtaggtcaggcggactagggtggggtctggggtacctttcgtcactctacaacctataccaaactaccgtnactatctagtactcttgtactttagtttacttcgtagtcagtactagtctaagtacgtacgtcggtccgttacgtaccggttccgggacgggtaacgggaaccgtaagggtaccgtaaacccgtaaaacgtaaaaccggttaacggtacggtcggtaccgtacgtacccgtaacctacgtttacgttaacgtttcctttaaccgtaccgttaccccgttccctaccgttaacgtccg

SEQ ID NO: 301878 - DNA, 591 bp, Homo sapiens
  misc_feature: GZ8MTXP02GIHSR.8.28.C06.1.454.CMB.2.raw
  modified_base (205)..(205): a, c, t, g, unknown or other
  misc_feature (205)..(205): n is a, c, g, or t
  modified_base (211)..(211): a, c, t, g, unknown or other
  misc_feature (211)..(211): n is a, c, g, or t
  modified_base (215)..(215): a, c, t, g, unknown or other
  misc_feature (215)..(215): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtctgttttccngggganaganccacctctcctgtgcgccagtcagagcgttaggacgtaactagcctggtatcagcaggaggcctggccaggcctcccagacctcctcattctttggctacctttaacgcgggccaggtggaactcccgagccaggtcaggcgcaggtgggtctgggacttcgtcactctcactatactaataacctgacctaatctacgacgtactttgacttagtttattctgtcagtccagttcgtagaagtacgtggtacccggtttctacggtttccgggcgggaacggggaacgtaaacgggtgggtaaccctaacgaaacgtaaaccgttggtacgggtccctggtacccaaaccgtcttcgtacgtccttacttaaccc

SEQ ID NO: 301879 - DNA, 584 bp, Homo sapiens
  misc_feature: GZ8MTXP02I658U.8.28.C06.1.454.CMB.2.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (290)..(290): a, c, t, g, unknown or other
  misc_feature (290)..(290): n is a, c, g, or t
  modified_base (415)..(415): a, c, t, g, unknown or other
  misc_feature (415)..(415): n is a, c, g, or t
  modified_base (422)..(422): a, c, t, g, unknown or other
  misc_feature (422)..(422): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaaggacgaacttagcctggtatcagcagagcctggccaggctcccagactccncatctttggcgtcctttaacagggccaggtggaactcccagccaggttcagcggcaggtgggtctgggacttcgtcactctcacatacaataacctgacaatctagacgtactttgactagtttnttcgttntacacgtctagtctagaacgtcgtcggtaccgttacgtacgttcgggacgggtaacgggaacgtaagggtacgaacctaacgaaaacggtacgttggtcggcgtacgacctaacctacgttacgttcgttaccttacctacttcccgtacccgactacgtcg

SEQ ID NO: 301880 - DNA, 766 bp, Homo sapiens
  misc_feature: GZ8MTXP02GTR82.8.28.C06.1.454.CMB.2.raw
  modified_base (206)..(206): a, c, t, g, unknown or other
  misc_feature (206)..(206): n is a, c, g, or t
  modified_base (212)..(212): a, c, t, g, unknown or other
  misc_feature (212)..(212): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcacctgtcttgttttccgngggganagacgccacctctcctgtcgcggcagtcagagcgttaggacgtaacttagcctaggtatcgagcaggacggcctggccgacggcctaccccgagacctcctactacgttcgttttcggaccgttacctttaaacggacggggtacctagggttaccgggaaaccttcccccggaaggtacccgtaacggggtttccgaacgggtccggggacgttaggggttccggggttacgttcggggggttaacctttttcccgggttacctacccgttaccttacccgaaaccttaaacttaacccgtaaaacttaaaccccgttgtaaacccgtaaacttacccgttacggtaacccgttacgttttacggtactttaacgtttttacttttacgtcggttaactacggttactacggttcgtaagtaaacggtcgttcgggtcccgtttacgtaccgggtttacggggacggggtaacggtaacggtaacggggttaccgaaccgtacgaaaacggtcgtacggtcgcgtcaccgtacacttcgtcttacttactccg

SEQ ID NO: 301881 - DNA, 584 bp, Homo sapiens
  misc_feature: GZ8MTXP02I4O2Y.8.28.C06.1.454.CMB.2.raw
  modified_base (197)..(197): a, c, t, g, unknown or other
  misc_feature (197)..(197): n is a, c, g, or t
  modified_base (555)..(555): a, c, t, g, unknown or other
  misc_feature (555)..(555): n is a, c, g, or t
  modified_base (567)..(567): a, c, t, g, unknown or other
  misc_feature (567)..(567): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgnggggagagagccaccctctcctgtgcggccagtcagagcgttaggacgaacttagcctggtatcagcagaggcctggccaggcctcccgagacctcctcactttcgtttcggccgtaccctttaaacggcgggtacctaggtacggaactccccgaggcccgtaggttcgacggcggcgaggtgggtacgtgggtactttcgtcactctccacatacaataacctgacaaactctagacgttacttgacttagtttactttctgtcagtctagtctagaacgtcgtcggtccgttctacggttcggacgggaacggacagggtcgactacgaaacgtagtggacggctacggcaactntctgtccttacncgtccttccgctactcg

SEQ ID NO: 301882 - DNA, 564 bp, Homo sapiens
  misc_feature: GZ8MTXP02F6D3G.8.28.C06.1.454.CMB.2.raw
  modified_base (196)..(196): a, c, t, g, unknown or other
  misc_feature (196)..(196): n is a, c, g, or t
  modified_base (535)..(535): a, c, t, g, unknown or other
  misc_feature (535)..(535): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccnggggagagagccaccctctcctgtgcggccagtcagagcgttaggacgaacttagcctggtatcagcagaggcctggccaggctcccagactcctcatctttggcgtcctttaaacgagggccagtggaactcccagccaggttcagcggcagtgggtctgggacttcgtcactctcaccatacaaataacctgacaaatctagacgtactttgcttagtttatttctgtcagtcagtctagaagtactggtaccgttctaaccgtttcgggacgggaaggggaacctaaggggtacggtaaccctacgaaaacgaacgtggtcggctacgccaacctntctcgttctactactcctcccgctactcg

SEQ ID NO: 301883 - DNA, 641 bp, Homo sapiens
  misc_feature: GZ8MTXP02F9CO5.8.28.C06.1.454.CMB.2.raw
  modified_base (197)..(197): a, c, t, g, unknown or other
  misc_feature (197)..(197): n is a, c, g, or t
  modified_base (203)..(203): a, c, t, g, unknown or other
  misc_feature (203)..(203): n is a, c, g, or t
  modified_base (260)..(260): a, c, t, g, unknown or other
  misc_feature (260)..(260): n is a, c, g, or t
  modified_base (292)..(292): a, c, t, g, unknown or other
  misc_feature (292)..(292): n is a, c, g, or t
  modified_base (353)..(353): a, c, t, g, unknown or other
  misc_feature (353)..(353): n is a, c, g, or t
  modified_base (404)..(404): a, c, t, g, unknown or other
  misc_feature (404)..(404): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgngggganagagcccaccctctcctgtgcggccagtcagagcgttaggacaacttagcctggtancagcaggcggctggcaggcctccagcctcctnattcgtttggcctacctttaaggcgggccaggtcgaactcccgagccgtaggtcaggcggntagggtggtctggggtactttcgtccactctaccactatacaacttaaccngaactaatctacgacgttacgtttgtactttagtttactttcgtcgtcagtctagtcgtaggaacgtacgtcgggtaccgtttacgtaccggtttacgggacgggtaacgggaaccgtaagggtaccgtaaccgtaacgtaaaacggtacgttgggtacggtcgtacgaccctaaccgtacgttcttaaccgttaccttacgtacccgtttcccgttacccgtactaacgtttccgg

SEQ ID NO: 301884 - DNA, 547 bp, Homo sapiens
  misc_feature: GZ8MTXP02F5Q6Q.8.28.C06.1.454.CMB.2.raw
  modified_base (207)..(207): a, c, t, g, unknown or other
  misc_feature (207)..(207): n is a, c, g, or t
  modified_base (213)..(213): a, c, t, g, unknown or other
  misc_feature (213)..(213): n is a, c, g, or t
  modified_base (217)..(217): a, c, t, g, unknown or other
  misc_feature (217)..(217): n is a, c, g, or t
  modified_base (429)..(429): a, c, t, g, unknown or other
  misc_feature (429)..(429): n is a, c, g, or t
tcagctcgcgtgtccacgaccggtgctcgatttagagctcacgtattggggtttggggagagctctgggggaggaactgctcagttaggacccagacggaaccatggaagccccagcgcagcttctcttcctcctgctactctggctcccagagatcattggagaagtggtgatgacacagtctccggtcaccctgtctgttttccngggganaganccacctctcctgtgcggccagtcaggagcgttaggacgaacttagcctggtatcagcagaggcctggccaggctccagctctcatcttggctccttaacgagggccaggtgaactccgagccaggtcacgcggcaggtgggtctggggtacttcggtcactctacacatacaataacctgactaatctgacttacttgcttagtttatttcngttacagtactagtctagaacgtcgtggtaccgttctacggtttcgggacgggacggtacgaaggtcggaacctacgaaacgtacgtgtcggactcgacactactctcgtctactacg

SEQ ID NO: 301885 - DNA, 759 bp, Homo sapiens
  misc_feature: GZ8MTXP02HDG9X.8.28.C06.1.454.CMB.2.raw
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccgngggganagagccaccctctcctgtgcggccagtcagagcgttaggacgtaacttagcctggtatcagcagagcctggccaggcctcccagacctcctcatttcgtttcggccgtaccctttaacgacggggtccaaggttacggaactcccccgaggccgtaggttaccacggcggcgacgggttcggggtcgtacggggtacctttccggttccaccttcctacctaaacccattaccaaaacttaccctagacctaaactcgtacgtaaccgttacttttcgaccgtttagtttttacttccgttagttcgtaagtctaaaggttcctaaggaaacgttcgttaccgggttaccgtttaccgttaaccggtttccgggggacggggtaacgggtaccggtaaacggggtaccggtaaacccgttaaaccgtaaaaacgggtaacgttggggtaccggtaccgttcggacccgtaaacccgtacttttacccgtaaccggtttcctttaaccccggttaccgtttcccccttttacccccggacctttaacggtttacccgg

SEQ ID NO: 301886 - DNA, 665 bp, Homo sapiens
  misc_feature: GZ8MTXP02GGRGZ.8.28.C06.1.454.CMB.2.raw
  modified_base (207)..(207): a, c, t, g, unknown or other
  misc_feature (207)..(207): n is a, c, g, or t
  modified_base (213)..(213): a, c, t, g, unknown or other
  misc_feature (213)..(213): n is a, c, g, or t
tcagctcgcgtgtccacgaccggtgctcgatttagagctcacgtattgggtttggggagagctctgggggaggaactgctcagttaggacccagacggaaccatggaagcccccagcgcagcttctcttcctcctgctactctggctcccagagatcattggagaagtggtgatgacacagtctccggtcaccctgtctgttttccngggganagagccacctctcctgtgcgcagtcagagcgttaggactaactagctggtatcagcagacggcctcggccaggcctacccagacctcctctattcgtttcggccgtacctttaaacgcgggacctaggtacggaaactccccgagccgtacggttcacggcggctacggtgggttcgtgggggtaccttcgttcaccttctacaccatacaaacttaacctgacaatcgtagacgtacttgacttagtttactttctgtacagtactagttactagtaaacgtcgttcgggtacccgtttacgtaccggtttacggggacgggtaacggggtaaaccgtaacggggttaccggaaacccgtaaaccggtaaaacgtaaaccggttgggtacggttaccgtaacggacccgtaaccctaagttacccgtttacggttcctttaccgtaacccg

SEQ ID NO: 301887 - DNA, 503 bp, Homo sapiens
  misc_feature: GZ8MTXP02FH8E5.8.28.C06.1.454.CMB.2.raw
  modified_base (195)..(195): a, c, t, g, unknown or other
  misc_feature (195)..(195): n is a, c, g, or t
  modified_base (200)..(200): a, c, t, g, unknown or other
  misc_feature (200)..(200): n is a, c, g, or t
  modified_base (202)..(202): a, c, t, g, unknown or other
  misc_feature (202)..(202): n is a, c, g, or t
  modified_base (307)..(307): a, c, t, g, unknown or other
  misc_feature (307)..(307): n is a, c, g, or t
  modified_base (350)..(350): a, c, t, g, unknown or other
  misc_feature (350)..(350): n is a, c, g, or t
  modified_base (366)..(366): a, c, t, g, unknown or other
  misc_feature (366)..(366): n is a, c, g, or t
  modified_base (370)..(370): a, c, t, g, unknown or other
  misc_feature (370)..(370): n is a, c, g, or t
  modified_base (428)..(428): a, c, t, g, unknown or other
  misc_feature (428)..(428): n is a, c, g, or t
  modified_base (459)..(459): a, c, t, g, unknown or other
  misc_feature (459)..(459): n is a, c, g, or t
  modified_base (476)..(476): a, c, t, g, unknown or other
  misc_feature (476)..(476): n is a, c, g, or t
  modified_base (498)..(498): a, c, t, g, unknown or other
  misc_feature (498)..(498): n is a, c, g, or t
  modified_base (500)..(500): a, c, t, g, unknown or other
  misc_feature (500)..(500): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggananagccaccctctcctgtgcggccagtcagagcgttagacgaacttgcctggatcagcagaggcctggccaggctcccagactcctcatctttggcgcctttaaacngggccagtggaatccccagccaggttcagcggtcagtgggtcngggacttcgtcactcncacntcatactgcaatctgacgtacttgctagttattctgtcagcatcagacactgccgttncgtttcggcggacggtacaagggtgacctanaaacgaactgtcgctcncacatctcgtctctctcctccncnctc

SEQ ID NO: 301888 - DNA, 564 bp, Homo sapiens
  misc_feature: GZ8MTXP02HFY7I.8.28.C06.1.454.CMB.2.raw
  modified_base (203)..(203): a, c, t, g, unknown or other
  misc_feature (203)..(203): n is a, c, g, or t
  modified_base (313)..(313): a, c, t, g, unknown or other
  misc_feature (313)..(313): n is a, c, g, or t
  modified_base (345)..(345): a, c, t, g, unknown or other
  misc_feature (345)..(345): n is a, c, g, or t
  modified_base (556)..(556): a, c, t, g, unknown or other
  misc_feature (556)..(556): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgttcttgtttttcctgggganagagccaccctctcctgtgcggccagtcagagcgttaggacgaacttagcctggtatcagcagaggctggccaggctcccagacctcctcatctttggctcctttaacgngggccagtggaactcccagccaggtcagcggnagtggtctgggacttcgtcactctcacatcaataacctgacaaatctagacgtactttgacttagttttattctgtcagctagtctagaagtacgtggtccgttactacgtttcgggacgggtaacgggaaccgtaaggggtacgacctaacgaaaacgtaacgtggtcggactcggaccaaccattctaagtcttacacttccgttcccnctaatccg

SEQ ID NO: 301889 - DNA, 708 bp, Homo sapiens
  misc_feature: GZ8MTXP02GY80V.8.28.C06.1.454.CMB.2.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgtggggagagagccaccctctcctgtgccggccagtcagagcgttaggacgtaacttagcctggtatcagcagaggcctggccaggcctcccagacctcctcattctttggcgtacctttaacgacggggccaggtcggaactccccgagcctaggttcaggcggcacggtgggtctgggtactttcgtacacgtctcacctatacaaactacctgactaaacgtctacggtaacgtacttttacgacgtttacgtttttacttttcgttcggttactaacggtcccgtaaggtttaccgttaacgggaaacggttaccgttcgggttcccgttttaccgtaaccgggttttccgggggaccggggtaacggggaaaccgttaaaggggtaccggggtaaaccctaccggtaaaacgtaaccggttggtacggtacgtacggaccctaacctacgttcgttccgttcctttaaccgttaccttcccgtttaccccgccgttaactttacccgg

SEQ ID NO: 301890 - DNA, 687 bp, Homo sapiens
  misc_feature: GZ8MTXP02IBC9N.8.28.C06.1.454.CMB.2.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (291)..(291): a, c, t, g, unknown or other
  misc_feature (291)..(291): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctccagagatcattggagaagtggtgatgacacagtctccggtcaccctgttctgtttttccngggganagagccacctctcctgtgcggccagtcagagtcgttagacgtaacttgcctggtatcagcagaggcctggcaggcctcccagacctcctnattcgtttggccgtacctttaagcgggaccaggtacggaactcccgagcccgtaggttcgacggtcggcgtacggtcggggtcgttggggtacctttcggttccacttcctacaaccacttacaaactaacctgaacctaacttcgagtacgtactttggaccttagttttacttctcgtctagactagttctaggaacgttacgttcgggtaccgtttacgtaccggtttacgggacggggtaacgggaaccgtaaggggtaccggtaaacccgttaaaccggaaaaccgtaacggttcggtacggtcccgttaacggacccgttaaacctacgttcgtttcgttaaccctttcgtaaccttttccccgtttacccccgtaccgttacgttaccg

SEQ ID NO: 301891 - DNA, 728 bp, Homo sapiens
  misc_feature: GZ8MTXP02GAKGW.8.28.C06.1.454.CMB.2.raw
  modified_base (205)..(205): a, c, t, g, unknown or other
  misc_feature (205)..(205): n is a, c, g, or t
  modified_base (211)..(211): a, c, t, g, unknown or other
  misc_feature (211)..(211): n is a, c, g, or t
  modified_base (241)..(241): a, c, t, g, unknown or other
  misc_feature (241)..(241): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtctgttttccngggganagagccacctctcctgtgcggccagtcagngcgttaggacgtaacttagcctggtatcagcagacggcctggccaggcctcccagacctcctctacttcgttttacggccgtaccgtttaacgacggggtaccctaggttacgggaaaccttccccgaaacggccgtaacggggtttccaacggggccggggtacgtaaggggttcgggggttaccgttcggggggtaccctttttcgggttacctacccgttccttacccgaaccctaattaacctaaacttaaacccttcgaactaaacttcgtcgtaaccgttactttcggtacttacgttttactttcgtcgttacgacgtcttaggtcgttaggaaacgtcgttcgggtaccgtttcgtaccggtttacgggacggggtaacggggaaccgtaacggggttacggacccgtaaacgtaaaaccggtacgttacgggtcggtacgtcggaccaaccgtacttccgtcgtttccttacctaccg

SEQ ID NO: 301892 - DNA, 652 bp, Homo sapiens
  misc_feature: GZ8MTXP02IVD5T.8.28.C06.1.454.CMB.2.raw
  modified_base (318)..(318): a, c, t, g, unknown or other
  misc_feature (318)..(318): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttacgtggggagagagccaccctctcctgtgcggccagtcagagcgttaggacgaacttagcctggtatcagcagaggcctggccaggcctcccagacctcctcatcgtttggcgtacctttaacgngggccagtcggaatccccgagccaggttcaggcggcaggtgggtctgggtacttcgttccacgtctacacctatacaaataacctgactaactctagtacgtactttgtacttagtttacttcttgttcagtactagtacgtagtaacgtacgtacgggtcccgtttaccgtacggttttccggggacggggtaacggggaaccgtaaacggggtacgggtaacccgtaacggtaaaaccggtaacgttacggtcgggtacgttacggacctaaccgtaacttccgttcgtttaccctttacctactttccccgttccccgtacctacgttccg

SEQ ID NO: 301893 - DNA, 760 bp, Homo sapiens
  misc_feature: GZ8MTXP02IBPV0.8.28.C06.1.454.CMB.2.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgttttcctggggagagagccaccctctcctgtgcggccagtcagagtcgttaggacgtaattagcctggtatcagcagagctggcaggctccagactcctcatcgtttggcgtacctttaacgacgggccaggtcggtaaactccccgagtccagggttcacggcggtacgtacggtcgggtcgttcggggtacctttcggttccaaccttcctcctaacctaattacctaaaacttaacccgtagacctaaacttcgtagtaaccgtacttttacggaccttaggtttttaacttttcgttacggttaccaaaggtccgttaacggttcgttacggtaaacggttaaacggttccggggtttacccggttaccgttaccggttttaccgggggacggggtaacgggggaaaacccgttaacgggggtaccgggtaaacccgttaaccgaaaaaccgggtaaacgtttacggggcggtaaccgtcgggtaccgtaaaacccgttacgttccttcggtttaccctttaccgtaacctttcccctttaccccccggacgtttaaacctttcccggg

SEQ ID NO: 301894 - DNA, 880 bp, Homo sapiens
  misc_feature: GZ8MTXP02GKK3M.8.28.C06.1.454.CMB.2.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacgaacttagcctggtatcagcagaggcctggccaggcctcccagacctcctcattcgtttggccgtaccttttaaacgacggggtcccaaggttacgggaaacttcccccgaaggtaccccgtaaaggggtttccgaacggggtccggggtacgtaacggggttcgggggttccgttcggggggtaaccctttttccgggtttaccctaaccttcccttacccaaaccctaacttaacccgtaaaaccttaaacccgttggaaaccctaaacttcccgttaacggtaaccgtttaaccgttttacggaccgttttaacggtttttaacttttccgttacggttaccgtaacgtaccgttaacggtttaccgttaaaggtaaaccggttaccggttaccggggttaccccggtttaccgttaacccgggtttacccgggggtaacgggggtaaccgggggtaaaacccggtaaacgggggttaccgggtaaaccccgttaaaacccggtaaaaaccggtaaaccggttacggggttccgggtaccggttaccggaacctaacccggtaactttccgttaacggtttaccctttacctaaccggtttaccccgttcccccgtaccttaaccgtttacccgg

SEQ ID NO: 301895 - DNA, 563 bp, Homo sapiens
  misc_feature: GZ8MTXP02FG1K4.8.28.C06.1.454.CMB.2.raw
  modified_base (207)..(207): a, c, t, g, unknown or other
  misc_feature (207)..(207): n is a, c, g, or t
  modified_base (213)..(213): a, c, t, g, unknown or other
  misc_feature (213)..(213): n is a, c, g, or t
  modified_base (325)..(325): a, c, t, g, unknown or other
  misc_feature (325)..(325): n is a, c, g, or t
  modified_base (357)..(357): a, c, t, g, unknown or other
  misc_feature (357)..(357): n is a, c, g, or t
  modified_base (423)..(423): a, c, t, g, unknown or other
  misc_feature (423)..(423): n is a, c, g, or t
tcagctcgcgtgtccacgaccggtgctcgatttagagctcacgtattggggtttggggagagctctggggaggaactgctcagttaggacccagacggaaccatggaagcccccagcgcagcttctcttcctcctgctactctggctcccagagatcattggagaagtggtgatgacacagtctccggtcaccctgtctgttttccngggganagagccaccctctcctgtgcggccagtcagagcgttaggacgaacttagcctggtatcagcaggaggcctggccaggcctcccagacctcctcatctttggctcctttaacngggccaggtcgaactccagccaggtcagcggnaggtgggtctggggacttcgtcactctcacatacaaactaacctgacaatctagacctactttcgnttagtttatttcgtgtcagtcagttcgtagaacgtacttcggtcccgtttctacgtttcgggacgggaacgggtacccgtaaagggtccgaacctacgaaaacgaacgtggtggtctggcacctatcctgttacctctac

SEQ ID NO: 301896 - DNA, 586 bp, Homo sapiens
  misc_feature: GZ8MTXP02F2CIV.8.28.C06.1.454.CMB.2.raw
  modified_base (311)..(311): a, c, t, g, unknown or other
  misc_feature (311)..(311): n is a, c, g, or t
  modified_base (457)..(457): a, c, t, g, unknown or other
  misc_feature (457)..(457): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgtcctttaacngggccagtggaactcccagccaggttcagcggcaggtgggtctggggactttcgtcactcctcaccatcaataacctgacaatctgacgtactttgctagtttatttctgttcagtctagtctagaacgtacgtgggtacccgttntaaccgttttcggggacggggtaacgggggaacccgaaaggggttcggaaacccttacgaaaacggtaaaccgttgggtacggctacggactacccattctcgttcttacacttccttcccgctcctag

SEQ ID NO: 301897 - DNA, 718 bp, Homo sapiens
  misc_feature: GZ8MTXP02G1VIZ.8.28.C06.1.454.CMB.2.raw
  modified_base (208)..(208): a, c, t, g, unknown or other
  misc_feature (208)..(208): n is a, c, g, or t
  modified_base (214)..(214): a, c, t, g, unknown or other
  misc_feature (214)..(214): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtcttgtttttccgngggganagacgccaccctctcctgtcgcggccagtcagagtcgttaggacgtaacttagcctggtatcgagcaggacggcctggacccgaggcctaccccgagacctccgtactacttcgtttcggacctaccgtttaacggcgggaccaaggtcggaacctcccgacgtccgtacggttcgacggtcggacgtagggttcgggttacgtcgggggttacctttcggttccctaaccgttcctaccgaacctactaacctaaacttaacccgtgaactaactcgtacgtaccgttacgtttacgtactttaagttttactttcgtagttaccgagtacgtaggttactaacggaaacgttaccggttcgggttaccgttacggttaaccggtttccgggggacggggtaacgggtaaaccggtaagggtaccgtacccgtaaacggtaaaaccggtacgtacggtcgtcgtaacgccgtaaccgtactccggtacttcctactttacccg

SEQ ID NO: 301898 - DNA, 509 bp, Homo sapiens
  misc_feature: GZ8MTXP02I671S.8.28.C06.1.454.CMB.2.raw
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
  modified_base (293)..(293): a, c, t, g, unknown or other
  misc_feature (293)..(293): n is a, c, g, or t
  modified_base (301)..(301): a, c, t, g, unknown or other
  misc_feature (301)..(301): n is a, c, g, or t
  modified_base (361)..(361): a, c, t, g, unknown or other
  misc_feature (361)..(361): n is a, c, g, or t
  modified_base (415)..(415): a, c, t, g, unknown or other
  misc_feature (415)..(415): n is a, c, g, or t
  modified_base (464)..(464): a, c, t, g, unknown or other
  misc_feature (464)..(464): n is a, c, g, or t
  modified_base (472)..(472): a, c, t, g, unknown or other
  misc_feature (472)..(472): n is a, c, g, or t
  modified_base (476)..(476): a, c, t, g, unknown or other
  misc_feature (476)..(476): n is a, c, g, or t
  modified_base (481)..(481): a, c, t, g, unknown or other
  misc_feature (481)..(481): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccngggganagagccacctctcctgtgcggccagtcagagcgttagacgactagctggatcagcagagcctggccaggctccagactctcatctttggcnctttaacnggccagtggaatcccagccaggttcagcggcagtgggtctgggcttcgtcactctcaccntacaataacctgacaatctgactactttgctattttacttctgtcagccagttnagaaagcttgggcttcactttcggggcggaggaaccaaggtgaccctanaaaaccgntggngctcncacatctcgtctctactctcctctactc

SEQ ID NO: 301899 - DNA, 681 bp, Homo sapiens
  misc_feature: GZ8MTXP02IAKXT.8.28.C06.1.454.CMB.2.raw
  modified_base (197)..(197): a, c, t, g, unknown or other
  misc_feature (197)..(197): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgttcttgtttttacnggggagagacgccaccctctcctgtcgcggccagtcagagcgttaggacgtaacttagcctggtatcagcagacggctggccaggcctcccagtacctcctcacttcgtttcggccgtacctttaacgacgggtccaggtcggaaactccccgagtcccgaagggtttcacggcggactagggtcggggtcgttggggtacctttcggttccacttccgtcaaccataccaaactaacctgactaaatctacggacgtactttggcctttagttttactttctgtacgtagtctaggttctagaaacgtccgttacggtccgtttactaccggtttcggggacggtaacggggaaccgtagggtaccgtaaccgtaaccgaaaacggtaacgttcggtacggtccgtacgaccgtaacccgtagttaccgtcggtttaccctttacctaccgtttaccccttccccggaccttaacgtttccgg

SEQ ID NO: 301900 - DNA, 626 bp, Homo sapiens
  misc_feature: GZ8MTXP02JA119.8.28.C06.1.454.CMB.2.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgttttccngggganagagccacctctcctgtgcggccagtcagagcgttaggacgaacttagcctggtatcagcagaggcctggccaggctcccagactcctcatctttggcgtcctttaacgaggccagtggaatcccagccaggttcagcggcaggtgggtctggggacttcggttcactctcacatcaataacctgacaatctgactactttgactagtttattctgtcagctagtctagaacgtacgtcggtccgttacgtaacgtttcggggacgggtaacggggaacccgtaaaggggtaccggtaacccgtacgtaaaaaccggtaaaccttgggtacggggtaccttacgggaccctaaaaccccgttacgttaccgttaacgtttaccttaccgtacccgttcccgttaccccggtacctaacgtttccg

SEQ ID NO: 301901 - DNA, 597 bp, Homo sapiens
  misc_feature: GZ8MTXP02GB012.8.28.C06.1.454.CMB.2.raw
  modified_base (198)..(198): a, c, t, g, unknown or other
  misc_feature (198)..(198): n is a, c, g, or t
  modified_base (204)..(204): a, c, t, g, unknown or other
  misc_feature (204)..(204): n is a, c, g, or t
  modified_base (269)..(269): a, c, t, g, unknown or other
  misc_feature (269)..(269): n is a, c, g, or t
  modified_base (296)..(296): a, c, t, g, unknown or other
  misc_feature (296)..(296): n is a, c, g, or t
  modified_base (311)..(311): a, c, t, g, unknown or other
  misc_feature (311)..(311): n is a, c, g, or t
  modified_base (322)..(322): a, c, t, g, unknown or other
  misc_feature (322)..(322): n is a, c, g, or t
  modified_base (392)..(392): a, c, t, g, unknown or other
  misc_feature (392)..(392): n is a, c, g, or t
  modified_base (431)..(431): a, c, t, g, unknown or other
  misc_feature (431)..(431): n is a, c, g, or t
  modified_base (558)..(558): a, c, t, g, unknown or other
  misc_feature (558)..(558): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgngggganagacgcccaccctctcctgtgcggccagtcagagtcgttaggacaacttgcctggtatcagcagnggcctggccaggcctcccagacctccnatctttgctcttagnggcagtgaacncccagccagtcagcggctaggtggtcgtgggtacctttcgtaccactcctacaacctatacaaactaccngaactaatctgtaacgtactttgacttagtttactttcncgtacagtctaaggtcaaggtaacgcgttcgggtacctttacgtaccggtttcggggacgggtaacgggaacgtagggtacgtaaccgtaacgaaaacggtacgtgggtacgacttcgacctacctnttccgtaacttcctactaccttcccgtaccactacgtcg

SEQ ID NO: 301902 - DNA, 746 bp, Homo sapiens
  misc_feature: GZ8MTXP02GD9YG.8.28.C06.1.454.CMB.2.raw
  modified_base (207)..(207): a, c, t, g, unknown or other
  misc_feature (207)..(207): n is a, c, g, or t
  modified_base (213)..(213): a, c, t, g, unknown or other
  misc_feature (213)..(213): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtcttgtttttccngggganagagccaccctctcctgtgcggccagtcagacgcgttaggacgtaatacgcctggtatcagcaggaggccctggcccaggcctccccgagtaccctcctcattccgtttacggccgtaccgtttaaacggacggggcctaggtacggaacctcccgacggtcctacgggttccgaggtccggacgtagggttcggggttcgtcgggggtacctttccggtactacgttcctacctaaccgtactactaaactaccctagacctaaagttcctacggtaccttacgttttcgtaccgtttaaagttttctttcttacggtccaacggtcgtacggttacgttaacggtaacgttaccggttcgggttcccgttttaaccgtaccgggttttaccgggggaccggggtaaacgggtacccggtaaaagggggttcccgaaaccgtttaaaccggaaaacccggttaggttacgggtcggtacgttaaccgacccgtaacgtacttaccgttcgtttaacctttccgtttaacccg

SEQ ID NO: 301903 - DNA, 585 bp, Homo sapiens
  misc_feature: GZ8MTXP02FRQJE.8.28.C06.1.454.CMB.2.raw
  modified_base (408)..(408): a, c, t, g, unknown or other
  misc_feature (408)..(408): n is a, c, g, or t
  modified_base (549)..(549): a, c, t, g, unknown or other
  misc_feature (549)..(549): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttcctggggagagagccaccctctcctgtgcggccagtcagagcgttaggacgaacttagcctggtatcagcagaggcctggccaggcctcccagacctcctcattcgtttggccgtcctttaaacgaggggcccaggtcggaactccccagcctaggttcaggcggcaggtcgggtctgggactttcgtccactctccactataccaaattaaccngacctaatctagtacgtactttggctagtttatttctgtcagtcagtctagagacgtcgtcgttactaccgtttgggacgggacgggtaacaagggtacgacctacaaaacggtacgtgtcgggacttcggaccaaccgtnttacctgttcctacacttccgtccccactacgtccg

SEQ ID NO: 301904 - DNA, 646 bp, Homo sapiens
  misc_feature: GZ8MTXP02HHRLJ.8.28.C06.1.454.CMB.2.raw
  modified_base (197)..(197): a, c, t, g, unknown or other
  misc_feature (197)..(197): n is a, c, g, or t
  modified_base (203)..(203): a, c, t, g, unknown or other
  misc_feature (203)..(203): n is a, c, g, or t
  modified_base (638)..(638): a, c, t, g, unknown or other
  misc_feature (638)..(638): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgngggganagacgcccacccttctccgtgtgccggccagtcaggagtcgttaaggaactaacttagccttggtactcagcgaggacggcctggccaggcctacccagacctcctctactttcgtttcggccgttaccgtttaaacggcgggtaccaggtacggaacctcccgagccgtaggtcgacggcggcagggtcgggtcgtcgggtactttcgtacactctaccaaccgtaataccgtaaactaccgtagacctaaactctacgtacgtactttgtaccttagttttacttcgttagtcaggtctaagtgtaagaacgtcgtcggtaccgttacgtacggttcgggacgggaaccggtaacggacggtacgaaccgtaacgaaaacgtcgtaggtcgactacgacctacgtacttcgtaacgttctactactccctccnctacgtcg

SEQ ID NO: 301905 - DNA, 597 bp, Homo sapiens
  misc_feature: GZ8MTXP02JHH7V.8.28.C06.1.454.CMB.2.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (313)..(313): a, c, t, g, unknown or other
  misc_feature (313)..(313): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacaacttagcctggtatcagcagaggcctggccaggcctcccagacctcctcatctttggctacctttaacgngggccagtggaactcccagcctaggttcagcggctaggtcgggtctggggtacttcgttccactctcacataccaaataccctgacaatctagacgtacttgtctagtttattctgtcagctagtctaggaacgtacgtacggtcccgttactacgtttccgggacgggtaacgggtaccggtaagggtacggtaacctacgtaaaaccggtaacgtgggtacggacgttcggacctaccacttcgtaacgttccttaccgtacttccctccccgactactccg

SEQ ID NO: 301906 - DNA, 786 bp, Homo sapiens
  misc_feature: GZ8MTXP02JPGYE.8.28.C06.1.454.CMB.2.raw
  modified_base (197)..(197): a, c, t, g, unknown or other
  misc_feature (197)..(197): n is a, c, g, or t
  modified_base (203)..(203): a, c, t, g, unknown or other
  misc_feature (203)..(203): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgngggganagacgcccaccctctcctggtcgccggccagtcagagcgttaaggacgtaacttagcctggtatcgagcaggacggcctggccaggcctcccgagacctcctactacgttcgtttcggccgtacctttaaacgacgggtaccaggtcggaaacctccccgagacccgtaggttaccgaggggaccggtacgtacggggttcggggtacccgttacgggggttaaccctttccggttaccaacccgtttcctaccctaaacctactaaccgtaaaaccttaaccgtcgaacctaaacttccgtacggtaccgttacgttttacggtacctttaagtttttacttcgttacgttacgacgtcttaacggttcgtaaggtaaacggttacgttccggggttacccgtttaccggttaaccggtttacgggggaccgggtaacgggggtaccccgtaaaagggggttccgtaaaaccccgttaacgaaaaccggtacggttgggttacggaccgttacggtacccgtaacctacgttccgttaacgttcctttaccaccgtttcccgtaccccgacttacgttaccg

SEQ ID NO: 301907 - DNA, 606 bp, Homo sapiens
  misc_feature: GZ8MTXP02I8PQI.8.28.C06.1.454.CMB.2.raw
  modified_base (197)..(197): a, c, t, g, unknown or other
  misc_feature (197)..(197): n is a, c, g, or t
  modified_base (203)..(203): a, c, t, g, unknown or other
  misc_feature (203)..(203): n is a, c, g, or t
  modified_base (267)..(267): a, c, t, g, unknown or other
  misc_feature (267)..(267): n is a, c, g, or t
  modified_base (478)..(478): a, c, t, g, unknown or other
  misc_feature (478)..(478): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgngggganagagccaccctctcctgtgcggccagtcagagcgttaggacgtaactagcctggtatcagcagnggcctggccaggctcccagacctcctcattcgtttggcgtacctttaacgcgggccaggtcggaaactccccgagcctaggttcaggcggacaggtcggggtcgtggggtacctttcggttaccacgttcctaccaaccctatacctaaaactaaccgtgactaactctacgtacgtactttgacttagttttacttctgtcagctagttntagaagtcgtcgggtcctttcctaacggttcggacgggaagggtaccgaagggtacgaactacgaaaacgtacgtgtcggactcggccaccagttctaacgttctacgtctccgttcccgactactcg

SEQ ID NO: 301908 - DNA, 544 bp, Homo sapiens
  misc_feature: GZ8MTXP02FFXOC.8.28.C06.1.454.CMB.2.raw
  modified_base (205)..(205): a, c, t, g, unknown or other
  misc_feature (205)..(205): n is a, c, g, or t
  modified_base (211)..(211): a, c, t, g, unknown or other
  misc_feature (211)..(211): n is a, c, g, or t
  modified_base (426)..(426): a, c, t, g, unknown or other
  misc_feature (426)..(426): n is a, c, g, or t
tcagctcgcgtgtccacgaccggtgctcgatttagagctcacgtattgggttggggagagctctggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacgaactagcctggtatcagcagaggcctggccaggctcccagactcctcatctttggcgtcctttaacagggccagtggaatcccagccaggttcagcggcagtgggtctgggactcgttcactctcaccatacaaataaacctgacaatcctgacgtactttgctagtttattntgtcagcagtctagaacgacgtggtccgttcgactttcgggcgggaacgggacctaaacggggtcggaaccgtaccgaaaacgaaccgtggtcggctgacaccatcctgtcctctacc

SEQ ID NO: 301909 - DNA, 577 bp, Homo sapiens
  misc_feature: GZ8MTXP02H1R3Y.8.28.C06.1.454.CMB.2.raw
  modified_base (196)..(196): a, c, t, g, unknown or other
  misc_feature (196)..(196): n is a, c, g, or t
  modified_base (389)..(389): a, c, t, g, unknown or other
  misc_feature (389)..(389): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgttctgtttttccnggggagagagccacctctcctgtgcggccagtcagagcgttaggactaacttgcctggtatcagcagaggcctggccaggctcccagacctcctcatctttggccgtcctttaacgagggccaggtcggaactcccgagccaggtcaggcggcagtgggtctgggacttcgtcactctcaccatacaataccngacaatctagacgtatttgcttagttttacttcttagtcagctagttctagaagtacgttcggtccgtttacgtacgtttcgggacgggtacgggaaccgtaagggtcgaacctacgaaaacgacgttggacggtcttacgacctacctagttctcgttaccttacacttcccttcccgcctactccg

SEQ ID NO: 301910 - DNA, 596 bp, Homo sapiens
  misc_feature: GZ8MTXP02IET6X.8.28.C06.1.454.CMB.2.raw
  modified_base (197)..(197): a, c, t, g, unknown or other
  misc_feature (197)..(197): n is a, c, g, or t
  modified_base (280)..(280): a, c, t, g, unknown or other
  misc_feature (280)..(280): n is a, c, g, or t
  modified_base (302)..(302): a, c, t, g, unknown or other
  misc_feature (302)..(302): n is a, c, g, or t
  modified_base (420)..(420): a, c, t, g, unknown or other
  misc_feature (420)..(420): n is a, c, g, or t
  modified_base (427)..(427): a, c, t, g, unknown or other
  misc_feature (427)..(427): n is a, c, g, or t
  modified_base (433)..(433): a, c, t, g, unknown or other
  misc_feature (433)..(433): n is a, c, g, or t
  modified_base (455)..(455): a, c, t, g, unknown or other
  misc_feature (455)..(455): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctccagagatcattggagaagtggtgatgacacagtctccggtcaccctgttcttgtttttccgnggggagagacgcccacctctcctgtgccggccagtcagagtcggttaaggacgtaacttagccgtaggtatcagcaggcgccnggccaggcctcccagcctcctntacttcgtttcggccgtacctttaaacgcggggccaggtacggaactcccgagccgtaggtccgagccggctagggtcgggtctcggggactttcgtcactctcacatacgaactacngacatcngacgtnttcgattagtttattctcgtanacgctagtcgtagagtacgtcgtaccgttcgtacgtttcgggacggtaacgggaccggtaaggtcgaacccgtaacgaaacggtaactggcgttacgcgacctactactcgttcgttctcgtactccttcccgactactcg

SEQ ID NO: 301911 - DNA, 589 bp, Homo sapiens
  misc_feature: GZ8MTXP02G1P4L.8.28.C06.1.454.CMB.2.raw
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
  modified_base (215)..(215): a, c, t, g, unknown or other
  misc_feature (215)..(215): n is a, c, g, or t
  modified_base (321)..(321): a, c, t, g, unknown or other
  misc_feature (321)..(321): n is a, c, g, or t
  modified_base (430)..(430): a, c, t, g, unknown or other
  misc_feature (430)..(430): n is a, c, g, or t
  modified_base (581)..(581): a, c, t, g, unknown or other
  misc_feature (581)..(581): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctccagagatcattggagaagtggtgatgacacagtctccggtcacctgtcttgtttttccgngggganagacgccaccctntcctgtcgcggccagtcagagcgttaaggactaattagcctggtaatcagcagaggcctggccaggcctccagacctctcattcgtttggccgtaccgtttaacgngggacctaggtacggaactcccgacgtcgtaggttcgaggcggtcaggtggtcgtcggtacttcgtcacgtctcgaactatacaactacagctaatctagacgtagttnacgttatttagttctagtcagtcgagttctaggaacgtcgttacggtcgtttaccgtagttcgggacgggaacggtacggtaagggtcgaacctaacgaaaacggtagtggtcgtactcgaccactcgtacttcgtctctactccgtaccnctactacg

SEQ ID NO: 301912 - DNA, 656 bp, Homo sapiens
  misc_feature: GZ8MTXP02GGK8A.8.28.C06.1.454.CMB.2.raw
  modified_base (207)..(207): a, c, t, g, unknown or other
  misc_feature (207)..(207): n is a, c, g, or t
  modified_base (213)..(213): a, c, t, g, unknown or other
  misc_feature (213)..(213): n is a, c, g, or t
  modified_base (217)..(217): a, c, t, g, unknown or other
  misc_feature (217)..(217): n is a, c, g, or t
  modified_base (451)..(451): a, c, t, g, unknown or other
  misc_feature (451)..(451): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtcttgttttccgngggganagcnccacctctctgtcgcgccagtcagagcgtaggaacgtaactagccgttggtatcagcaggacggccgtggccaggcctacccagacctcctctacttcgtttcggccttacccgtttaaacggacggggtcctagggttacggaacctaccccgagtaccgtacggttcgacggcggacgtaggttcgggtcgtagggggtcctttcggtccacttcctcacatacaaactacngacatctagactactttagacttaagtttctttacgtgttacagtacgtatcgtagtaaacgtcgttcggtaccgtttctacggtttaccggggacggggtaacggaaccggtaagggtaccgtaaacccgtaaacgaaaaccggtacgtcggtacggactaacgacccgtaactacggttccgttacgttacctaactttcccg

SEQ ID NO: 301913 - DNA, 625 bp, Homo sapiens
  misc_feature: GZ8MTXP02FKMRX.8.28.C06.1.454.CMB.2.raw
  modified_base (194)..(194): a, c, t, g, unknown or other
  misc_feature (194)..(194): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcacctgtctgtttttccnggggagagagccaccctctcctgtgcggccagtcagagcgttaggacgaacttagcctggtatcagcaggaggcctggccaggcctcccagacctcctcattctttcggcgtcctttaacgacgggccaggtggaactcccgagccgtaggttcgaggcggcacggtggggtctggggtacttcgtcactctcactatacaactacctgactaatctagacgtacttgacttagtttactttctgtcagctagtctagaagtacgtcgggtaccgttcgtaccgtttcgggacgggtaacgggtaaccgtaaaggggtaccggtaacccgttaacgaaaaccggtaacgttcgggtacggtaccgttacggacctaaccgtacttccgtcgttccttaccgtaccttcccgttaccccgtacctactaccg

SEQ ID NO: 301914 - DNA, 617 bp, Homo sapiens
  misc_feature: GZ8MTXP02IH4AM.8.28.C06.1.454.CMB.2.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (255)..(255): a, c, t, g, unknown or other
  misc_feature (255)..(255): n is a, c, g, or t
  modified_base (258)..(258): a, c, t, g, unknown or other
  misc_feature (258)..(258): n is a, c, g, or t
  modified_base (262)..(262): a, c, t, g, unknown or other
  misc_feature (262)..(262): n is a, c, g, or t
  modified_base (265)..(265): a, c, t, g, unknown or other
  misc_feature (265)..(265): n is a, c, g, or t
  modified_base (380)..(380): a, c, t, g, unknown or other
  misc_feature (380)..(380): n is a, c, g, or t
  modified_base (388)..(388): a, c, t, g, unknown or other
  misc_feature (388)..(388): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccacctctcctgtgcggccagtcagagcgttaggactattagcctggtancancagngcnggcagctccagactctcatctttgcgtcttagaggcagtggactcccagccgagttcaggcggctaggtcgggtctggggtactttcggttccactctcactactacaactaacnacaaactnagtactactttgactttagttttactttcgtgttccagctagttctaggtaaacgtcgtcgggttccttacgttacggtttccgggacgggtacgggtaaccgtaggggttaccggaacccttaacggaaaacgtaaccggtggttcggggtaaacccgtcgtaccgtaaccgttacgttaccttcgtttaccttacgttacccttacccgttcccgtactacgttacg

SEQ ID NO: 301915 - DNA, 722 bp, Homo sapiens
  misc_feature: GZ8MTXP02HNO3P.8.28.C06.1.454.CMB.2.raw
  modified_base (207)..(207): a, c, t, g, unknown or other
  misc_feature (207)..(207): n is a, c, g, or t
  modified_base (213)..(213): a, c, t, g, unknown or other
  misc_feature (213)..(213): n is a, c, g, or t
tcagctcgcgtgtccacgaccggtgctcgatttagagctcacgtattggggtttgggggagagctctggggaggaactgctcagttaggacccagacggaaccatggaagccccagcgcagcttctcttcctcctgctactctggctcccagagatcattggagaagtggtgatgacacagtctccggtcacctgtcttgttttcgnggggangagccacctctcctgtgccggcagtcagagcgttaggactaacgttagctaggtatcgagcgaggacggcctggaccacggcctacccgagtaccctccgttctacgtttccgttttcgggaccttaccgtttaacggacggggtaccctaaggtacggaacctccccgaggtccgtacggggttacccaaggccggtaccgtaggggttccggggttcgttacgggggtacctttcggttaccacctttccgacacctataacctaaacgtaaccctgaactacgtccttagaaccgttactttacgactttaaaggtttttactttcgttagtaccgtagtaccgtaaggttccttagaaacgttacgttccgggttacccgtttcgttaaccgggtttccggggacgggtaaacggtaacccggtagggttaccgaaccgtaaacgaaacgtacgtacgtcggtaactcggtactaaccctgttcttaccgttacctttactcccg

SEQ ID NO: 301916 - DNA, 629 bp, Homo sapiens
  misc_feature: GZ8MTXP02GTYOW.8.28.C06.1.454.CMB.2.raw
  modified_base (197)..(197): a, c, t, g, unknown or other
  misc_feature (197)..(197): n is a, c, g, or t
  modified_base (203)..(203): a, c, t, g, unknown or other
  misc_feature (203)..(203): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgngggganagagccaccctctcctgtgtggccagtcagagcgttaggacgaacttagcctggtatcagcagaggcctggccaggcctcccgagacctcctcattcgtttcggccgtacctttaacgacggggcctaggtcggaactccccgagccgtaggttcaggcggcacggtgggtctggggtacttcgtcactctcactatcaatactgacatctagactactttgacttagtttacttctgtcagtctagtctagaacgtacgtcgggttaccgttacgtaccgtttcgggacgggtaacgggtaccgtaagggtcggtaacccgtaacgaaaacggtaacgttggtacggtaccgtcggaccctaccgtacgttccgtaacgtttaccttcctactttcccgttaccccgtaccttacgtttacccgg

SEQ ID NO: 301917 - DNA, 755 bp, Homo sapiens
  misc_feature: GZ8MTXP02HBO9O.8.28.C06.1.454.CMB.2.raw
  modified_base (210)..(210): a, c, t, g, unknown or other
  misc_feature (210)..(210): n is a, c, g, or t
  modified_base (216)..(216): a, c, t, g, unknown or other
  misc_feature (216)..(216): n is a, c, g, or t
tcagctcgcgtgtccacgaccggtgctcgatttagagctcacgtattggggtttgggggagagctctgggggaggaactgctcagttaggacccagacggaaccatggaagccccagcgcagcttctcttcctcctgctactctggctcccagagatcattgggagaagtggtgatgacacagtctccggtcacctgtcttgttttccgngggganagacgccacctctcctgtcgcggccagtcagagtcgtaggactaacttgcctggtatcagcaggacggcctcggccacggcctaccccgagtaccctcctacgtacgtttccgtttgggacccttaaccgtttaaacggcccggggtacccgtaagggtaccggtaaaccgtccccgaaagggtccctaacggggttccgaacggggtccgggacggtaggggttcggggttaccgttgggggttaccttttacggtcctaccttccttaccaaacctactaacaaacttaacccgtgaacctaacgttcgtacgtaaccggttactttacgtacgtttaaagttttacttttcgtacgtttaaacgcgttactaacggttacgtaacggtaaacgtccggttcggttaccgttcggttacgggtttcggggaccgggaacgggtaaccggtaacggggtaccggtaaaccctaacggtaaaccggtaggtcggtacggtctaacgacgtacttacgtcgttccttacgtaccttcccg

SEQ ID NO: 301918 - DNA, 692 bp, Homo sapiens
  misc_feature: GZ8MTXP02IFW1R.8.28.C06.1.454.CMB.2.raw
  modified_base (270)..(270): a, c, t, g, unknown or other
  misc_feature (270)..(270): n is a, c, g, or t
  modified_base (277)..(277): a, c, t, g, unknown or other
  misc_feature (277)..(277): n is a, c, g, or t
  modified_base (299)..(299): a, c, t, g, unknown or other
  misc_feature (299)..(299): n is a, c, g, or t
tcagctcgcgtgtccacgaccggtgctcgattttagagctcacgtattggggtttgggggaggaactgctcagttaggacccagacggaaccatggaagccccagcgcagcttctcttcctcctgctactctggctcccagagatcattggagaagtggtgatgacacagtctccggtcaccctgttcttgttttttccgggggagaggacgccacccttctcctggtcgccggccagtcagagtcgttaaggactaacttgcctggtancagcagngctggccaggctccagctcctnattctttggcgtcctttaagcggccagtggaactcccgagccgaggttccaggcgcgacggtggtctggcttcgtcacgtctccacacgtactaactaaccctgacctaaattcgtagtaaccgttacctttaggacctttaaagtttttactttcgtgttaccaaggtctaacgtttccgtaaaggtaaacggttacgttccgggtcccgtttacgtacccggttttacgggggacggttaaacggggaaaccccgttaaggggtccggtaaacccgttaaccgaaaacggtaaaccgtttggaaaccggtccgttacggacccgaaacgttcttaccgttggttaaccctttcgacctttaccccggtttccccgaccttaaacgtttccg

SEQ ID NO: 301919 - DNA, 673 bp, Homo sapiens
  misc_feature: GZ8MTXP02JR0GE.8.28.C06.1.454.CMB.2.raw
  modified_base (205)..(205): a, c, t, g, unknown or other
  misc_feature (205)..(205): n is a, c, g, or t
  modified_base (211)..(211): a, c, t, g, unknown or other
  misc_feature (211)..(211): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtctgttttccngggganagacgccaccctctcctgtgcggccagtcagagcgttaggacgaacttagcctggtatcagcagacggcctggccaggcctccccagacctcctcacttcttcggcgtcctttaacgcgggccaggtcgaactcccgagccgtaggtcagcggcgacggtggggtcgtcggggtactttcgttccacttcctcctacctactacctaaacttaaccctagactaaacttccgtacggaaccttacgtttgaccgtttagttttactttcgttcgttacgacgtacgtacgttccgtaaggtaacgtacgttccgggttaccgtttacgttaccggtttccgggggaccgggtacggggtaacccgtaacggggttaccggtaaacccgttacgtaaacggtaaccgtcggtacggaccgtcggaccgaacctacgttcccgtcggttaccttacttaacccg

SEQ ID NO: 301920 - DNA, 674 bp, Homo sapiens
  misc_feature: GZ8MTXP02J03ZL.8.28.C06.1.454.CMB.2.raw
  modified_base (194)..(194): a, c, t, g, unknown or other
  misc_feature (194)..(194): n is a, c, g, or t
  modified_base (200)..(200): a, c, t, g, unknown or other
  misc_feature (200)..(200): n is a, c, g, or t
  modified_base (230)..(230): a, c, t, g, unknown or other
  misc_feature (230)..(230): n is a, c, g, or t
  modified_base (353)..(353): a, c, t, g, unknown or other
  misc_feature (353)..(353): n is a, c, g, or t
  modified_base (388)..(388): a, c, t, g, unknown or other
  misc_feature (388)..(388): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgttttccngggganagagccacctctcctgtgcggccagtcagngcgttaggacgaattagcctggtatcagcaggacgcctggccaggctcccagacctctcatcgtttggccgtcctttaacgacgggccaggtggaactcccgaagccgtaggttcaggcggtnaggtcgggtcgtgggtacttcgtcactctcacctntacaatacctgcaatctgactacttgctagtttctttactcgttacgacgtcgaacgttcgtaggtaacgtacgttcgggtacccgtttacgtaaccggtttccgggggacgggtaacgggggtaaccccgaagggggttaccggtaaacccgtaaccggtaaaaccggtaacggttcggtaccggggtacgttccggaccctaacccggtactttacccggtcgtttaacccgtttccctaaccgtttacccccgtttcccccggaccttaacgtttaccccggg

SEQ ID NO: 301921 - DNA, 633 bp, Homo sapiens
  misc_feature: GZ8MTXP02JKCTI.8.28.C06.1.454.CMB.2.raw
  modified_base (231)..(231): a, c, t, g, unknown or other
  misc_feature (231)..(231): n is a, c, g, or t
  modified_base (258)..(258): a, c, t, g, unknown or other
  misc_feature (258)..(258): n is a, c, g, or t
  modified_base (290)..(290): a, c, t, g, unknown or other
  misc_feature (290)..(290): n is a, c, g, or t
  modified_base (627)..(627): a, c, t, g, unknown or other
  misc_feature (627)..(627): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggcagtcagngcgtagacgaactagcctggtatcagnagaggcctggccaggcctacccagacctcctnacttcttggcctaccgtttaacgacggtccagtacggaactcccgagccgtaggttccacggcggtacgacgggtcggggtccgtacggggtacctttcggttacaccttcctaccaacctacttaccaaaacgttaccctgactaaactcgtacgaccgtactttgacttagttttacttcgtacgtacagccgtagttcctaggtaacgtcgtcggtaccgttacttacggttacgggacgggaacggtaccgaagggtaccgtaaccgtaacgaaaacggtacgtggtacgcgtagacccaactgttaccgtgtcctactactcctcccgaccncttacg

SEQ ID NO: 301922 - DNA, 574 bp, Homo sapiens
  misc_feature: GZ8MTXP02F3M1I.8.28.C06.1.454.CMB.2.raw
  modified_base (206)..(206): a, c, t, g, unknown or other
  misc_feature (206)..(206): n is a, c, g, or t
  modified_base (212)..(212): a, c, t, g, unknown or other
  misc_feature (212)..(212): n is a, c, g, or t
  modified_base (325)..(325): a, c, t, g, unknown or other
  misc_feature (325)..(325): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacgaacttagcctggtatcagcagaggcctggccaggcctcccagacctcctcatctttggcgtcctttaacgngggccaggtggaactccagccaggttcaggcggcaggtcggtctggggtacttcgtcactctacaccatacaataacctgacaatctgacgtacttgctagtttattctgtcagtctaagtctagaaacgcgtcggtccttacgtacgtttcgggacggggtaacggaccgtaaggggtacgaacccgtaacgaaacggtaaccgttggtcggtactggaccaactactcgttcgtaccttactacccg

SEQ ID NO: 301923 - DNA, 667 bp, Homo sapiens
  misc_feature: GZ8MTXP02JBODT.8.28.C06.1.454.CMB.2.raw
  modified_base (203)..(203): a, c, t, g, unknown or other
  misc_feature (203)..(203): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgtgggganagagcccaccctctcctgtgcggccagtcagagcgttaggacgtaacttagcctggtatcagcagaggcctggccaggcctcccagacctcctcattcgtttcggccgtacctttaacgacggggtcccaggtacggaaactccccgaggtcccgtagggttccaacgggcggccgaggggttcggggtccgttcggggtacctttcgttaccacgttcctacaacctactactaaataacccgtgactaaatcgtaggactacgtttgacttagttttacttcgtagtacagtctacgtctagtaaacgtcgtcggtaccgtttcctacggtttcggggacggtacggggaccgtaaggtaccggtaaccgtaaccgtaaaacgtaaccgttgggtcgtaccgttacgaccctaaaccgtcttacgtcgttacttaccgactttcccgtacccgtctaactcg

SEQ ID NO: 301924 - DNA, 556 bp, Homo sapiens
  misc_feature: GZ8MTXP02FN2Q4.8.28.C06.1.454.CMB.2.raw
  modified_base (207)..(207): a, c, t, g, unknown or other
  misc_feature (207)..(207): n is a, c, g, or t
  modified_base (213)..(213): a, c, t, g, unknown or other
  misc_feature (213)..(213): n is a, c, g, or t
  modified_base (394)..(394): a, c, t, g, unknown or other
  misc_feature (394)..(394): n is a, c, g, or t
tcagctcgcgtgtccacgaccggtgctcgatttagagctcacgtattgggtttggggagagctctggggaggaactgctcagttaggacccagacggaaccatggaagcccccagcgcagcttctcttcctcctgctactctggctcccagagatcattggagaagtggtgatgacacagtctccggtcaccctgtctgtttttccngggganagagccaccctctcctgtgcggccagtcagagcgttaggacgaacttagcctggtatcagcagaggcctggccaggcctcccagacctcctcatctttggcgtccttaacgagggccaggtggaactccagccaggttcagcgcagtggtctgggacttcgtcactctcacatcaataccngacaatctagactattcgctagtttatttctgtctagctagtctagaacgtactcggtccgtttctacgtttcgggcgggaacgggtaccgaagggtcggaaccgtacgaaacgtaacgtcggtacggacgtcgacaccgtacgttctcgtaccttctaccg

SEQ ID NO: 301925 - DNA, 634 bp, Homo sapiens
  misc_feature: GZ8MTXP02F5GRR.8.28.C06.1.454.CMB.2.raw
  modified_base (206)..(206): a, c, t, g, unknown or other
  misc_feature (206)..(206): n is a, c, g, or t
  modified_base (212)..(212): a, c, t, g, unknown or other
  misc_feature (212)..(212): n is a, c, g, or t
  modified_base (243)..(243): a, c, t, g, unknown or other
  misc_feature (243)..(243): n is a, c, g, or t
tcagctcgcgtgtccacgaccggtgctcgatttagagctcacgtattggggtttggggagagctctggggaggaactgctcagttaggacccagacggaaccatggaagcccccagcgcagcttctcttcctcctgctactctggctcccagagatcattggagaagtggtgatgacacagtctcggtcaccctgtctgttttccngggganagagccaccctctcctgtgcggccagtcagngcgttaggactaacttagcctggtatcagcagaggcctggccaggcctccagactcctcatcgttcggctccttaacgacgggcctaggtggaaactcccgagcctaggttcaggtcggacaggtgggtctggggtacttcggtcaccgtctacacctatacaaactaccctgactaatcgtacgacgtactttgacttagtttctttactgtacagtctagtcgtagaacgtcgtcggtaccgtttactacgtttacgggacgggtaacgggtaaccgtaaacggggttccggaaacccgttaacggaaaaccggtaaccgttgggtaccgggttaccgttaacggaccctaccgtaacggttccttacggtttacccttctttaccccg

SEQ ID NO: 301926 - DNA, 587 bp, Homo sapiens
  misc_feature: GZ8MTXP02FL7HF.8.28.C06.1.454.CMB.2.raw
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtctgttttcctggggagagagccaccctctcctgtgcggccagtcagagcgttaggacgaacttagcctggtatcagcagaggcctggccaggcctcccagactcctcatctttggctcctttaacgagggccagtggaactcccagccaggttcagcgcaggtgggtctggggtacttcgttcactctcaccatacaaataacctgactaaatctagaccgtactttgacttagtttatttctgtcacgtctagtctagaaacgtcgtcggtaccgttcgtacgtttcggggacgggaacgggtaaccgaagggtcggtaacctacgaaaacggtaccgttaggacggcgttaacggacctaaccgtacttccggtactttcctacttaccg

SEQ ID NO: 301927 - DNA, 815 bp, Homo sapiens
  misc_feature: GZ8MTXP02H77FC.8.28.C06.1.454.CMB.2.raw
  modified_base (207)..(207): a, c, t, g, unknown or other
  misc_feature (207)..(207): n is a, c, g, or t
  modified_base (213)..(213): a, c, t, g, unknown or other
  misc_feature (213)..(213): n is a, c, g, or t
  modified_base (218)..(218): a, c, t, g, unknown or other
  misc_feature (218)..(218): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtcttgttttccgngggganagacnccacctctcctgtcgcggcagtcagagtcgttaggacgtaacttagcctggtatcagcaggaggcctggccaggcctcccgagacctcctctattccgtttcggctacccgtttaaacgacggggtcctaaggtacggaaacctccccgaagtacccgtacggttaccacgggtccgggacgtacggggttcggggtccgttgggggttaaccctttttccgggttaccctacccgttacccgttccctaaaaccccgtaacttaaacccgtaaaaccgttaaacccttcggaaccctaaaacttcccgtttaaccgggtaaccggtttaaacctttttacgggaacctttaagtttttaacgttttccttaacggtttccgaacggtaccgttaacgggttcgttaacggtaaaacgttcgggttcgggtttcccggtttaccggttaccggtttaccgggggacggggttaaaacggggaaccggtaacgggggttacggtaaacccgtaaaccggtaaaacggtaacgttccgggttaggaccgttaaccggacctaaaccgttcgttccgttacgtttcctttaaccgtcccg

SEQ ID NO: 301928 - DNA, 666 bp, Homo sapiens
  misc_feature: GZ8MTXP02HYUMZ.8.28.C06.1.454.CMB.2.raw
  modified_base (208)..(208): a, c, t, g, unknown or other
  misc_feature (208)..(208): n is a, c, g, or t
  modified_base (214)..(214): a, c, t, g, unknown or other
  misc_feature (214)..(214): n is a, c, g, or t
  modified_base (242)..(242): a, c, t, g, unknown or other
  misc_feature (242)..(242): n is a, c, g, or t
tcagctcgcgtgtccacgaccggtgctcgatttagagctcacgtattgggtttggggagagctctggggaggaactgctcagttaggacccagacggaaccatggaagcccccagcgcagcttctcttcctcctgctactctggctcccagagatcattggagaagtggtgatgacacagtctccggtcaccctgtcttgtttttccngggganagagccacctctcctgtgcgcagtcagngtcgttaggactaacttagcctggtatcagcagaggcctggccgaggctccagactcctcatcgttggccgtacctttaaacgacggggtcctaggtacggaaactccccaggacctacggttccaacggcggcgtaggggttcggggtcgttcgggggtacctttcggttcctaccgttcctccaacctaactaccaaaactaacccttacgactaactacgttcgaacgttactttacgtctttagttttactttacgtcgttacacggtactaggtaccgttagaaacgttcgtacggttacccgtttcggtaccgttttacgggggacgggtaacgggtaaccgaacggggttcggaacccttaaacgaaacggtaacgtcggtacgcgtcgacaccgtactcgttacgtctttactccc

SEQ ID NO: 301929 - DNA, 739 bp, Homo sapiens
  misc_feature: GZ8MTXP02FVWXT.8.28.C06.1.454.CMB.2.raw
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgtggggagagacgcccaccctctcctgtcgccggccagtcagagcgttaggacgaacttagcctggtatcagcaggacggcctggcccaggcctacccagaccttccctctactttcgttttcgggccgttacccgtttaaacgacggggtaccctaagggtacgggaaacctccccgaggcccgtaagggtttccgaacggtcgggaccgtaggggtttcggggttccgtaggggtaccttttccggttaccaccttcctaccaacctataacctaaaactaccttagacctaaacttcgttacgaaccgttaacgtttcgacgtttaagttttacttttccgttacgttacgaacgtcgttaacggtcctttaagggaaacgttccggtacgggttacccgtttacgttaacccggtttccgggggacgggtaacgggaaccggtaacgggtacggaacccgttaacgaaaacggtaacgtggtaccgcgtacgacctacgtacttcgtcgttcttactcttaccctttccgacctataccg

SEQ ID NO: 301930 - DNA, 615 bp, Homo sapiens
  misc_feature: GZ8MTXP02FH3AI.8.28.C06.1.454.CMB.2.raw
  modified_base (196)..(196): a, c, t, g, unknown or other
  misc_feature (196)..(196): n is a, c, g, or t
  modified_base (291)..(291): a, c, t, g, unknown or other
  misc_feature (291)..(291): n is a, c, g, or t
  modified_base (314)..(314): a, c, t, g, unknown or other
  misc_feature (314)..(314): n is a, c, g, or t
  modified_base (396)..(396): a, c, t, g, unknown or other
  misc_feature (396)..(396): n is a, c, g, or t
  modified_base (435)..(435): a, c, t, g, unknown or other
  misc_feature (435)..(435): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccnggggagagacgccaccctctcctgtgcggccagtcagagcgttaggacgacttagcctggtatcagcagagcctggccaggctcccagactcctnattctttggcgtcctttaaacgngggacctaggtcggaactcccgagccaggttcaggcggcaggtgggtctgggtacttcgtcacgttctcaccatacaatacngactaaatctagacgtatttgacttagtttactttcgtntcagtctaggttacaggtaacgtacgtcgggtaccgttcgtaccgtttcggggacgggtaacggggtactaacggggtcgggtaacctaacgtaaaaccgtaaccgtggggttacgaccgttacgacccgacctaattccgtgttaccttacacgtttcccttacccggcctacttaccg

SEQ ID NO: 301931 - DNA, 591 bp, Homo sapiens
  misc_feature: GZ8MTXP02FKJ51.8.28.C06.1.454.CMB.2.raw
  modified_base (197)..(197): a, c, t, g, unknown or other
  misc_feature (197)..(197): n is a, c, g, or t
  modified_base (368)..(368): a, c, t, g, unknown or other
  misc_feature (368)..(368): n is a, c, g, or t
  modified_base (396)..(396): a, c, t, g, unknown or other
  misc_feature (396)..(396): n is a, c, g, or t
  modified_base (402)..(402): a, c, t, g, unknown or other
  misc_feature (402)..(402): n is a, c, g, or t
  modified_base (411)..(411): a, c, t, g, unknown or other
  misc_feature (411)..(411): n is a, c, g, or t
  modified_base (426)..(426): a, c, t, g, unknown or other
  misc_feature (426)..(426): n is a, c, g, or t
  modified_base (441)..(441): a, c, t, g, unknown or other
  misc_feature (441)..(441): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgnggggagagacgccaccctctcctgtgccggccagtcagagcgttaaggacgtaacttgcctggtatcagcaggacggcctggccaggcctcccagacctcctcacttcgtttggccgttacctttaaacgacgggccaggtacggaactcccgagccgtaggtcaggcggnacgggtggtctgggtacttcgtcactcncactanacaactacnactatcagactattnactttagttactttntgtacagctagtctagagtacgtcggtacctacgtcgttcgggacggacggtacgagggtacgactaacgaaacgtagttgacggtctacgacctaactcgttaccgtaagttcccttactacgtttcccctacccggtctaacgttccg

SEQ ID NO: 301932 - DNA, 617 bp, Homo sapiens
  misc_feature: GZ8MTXP02GM8BZ.8.28.C06.1.454.CMB.2.raw
  modified_base (197)..(197): a, c, t, g, unknown or other
  misc_feature (197)..(197): n is a, c, g, or t
  modified_base (426)..(426): a, c, t, g, unknown or other
  misc_feature (426)..(426): n is a, c, g, or t
  modified_base (609)..(609): a, c, t, g, unknown or other
  misc_feature (609)..(609): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgnggggagagagccacctctcctgtgcggccagtcagagcgttaggacgaacttagcctggtatcagcagaggcctggccaggcctcccagacctcctcatcgtttcggcgtaccctttaaacgaggggcccaggtcggaactccccgagcccgtaaggttcacggcgggcgagggttggggtcgtcggggtactttcggttccacttcctacacctatacaaactaaccnactaatcgtagtactactttcgacttagtttactttctgtacagtacctagttcgtagtaacgtcgtcgggtccgttacgtaccgtttcggggacggtaacggggaacgtaacgggtacgacctaacgaaaccggtatggtcgacgtcgaccactatcgtgttcctactacttcccgttaccncctactcg

SEQ ID NO: 301933 - DNA, 530 bp, Homo sapiens
  misc_feature: GZ8MTXP02IUDMC.8.28.C06.1.454.CMB.2.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (310)..(310): a, c, t, g, unknown or other
  misc_feature (310)..(310): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacgaacttagcctggtatcagcagagcctggccaggctcccagactcctcatctttggcgcctttaacgngggccagtggaactcccagccaggttcagcggcagtgggtctgggacttcgtcactctcaccatcaataacctgcaatctgacgactttgctagtttattctgtcagcagtctgaagtactggccgttcacgtttcggacggagggaccaagggtcgacctcgaaaacgactggtacggctacggctaccgatctgtcttcgactccttcccgctactcg

SEQ ID NO: 301934 - DNA, 738 bp, Homo sapiens
  misc_feature: GZ8MTXP02IFTAX.8.28.C06.1.454.CMB.2.raw
  modified_base (213)..(213): a, c, t, g, unknown or other
  misc_feature (213)..(213): n is a, c, g, or t
tcagctcgcgtgtccacgaccggtgctcgatttagagctcacgtattggggtttggggagagctctggggaggaactgctcagttaggacccagacggaaccatggaagccccagcgcagcttctcttcctcctgctactctggctcccagagatcattggagaagtggtgatgacacagtctccggtcaccctgtctgtttttccggggganagagccacctctcctgtgcggccagtcagagtcgttaggacgtaacttagcctggtatcagcagaggcctggaccaggcctaccccagacctcctctatctttcggcgtaccctttaacgagggaccctaggtggaaacctcccgagtacccacgggtttaccaaggtccggacgtaacggttggggtacccgttagggggtaccttttcggtccctaaccttcccttaccaaacctatacctaaataacccttagactaaattaccgtgtaaccgttaactttcggtaaccttagtttttaactttcgtttcggtttaacctacggtacgtacgttacgtaacggtaacgtacggttaccggttaccgtttaccggttaccggtttaccgggggacggggtaaccggggtaaccggtaacgggttaccggtaaacccgttaaaccgtaaaaccggtaccgttacgggtacgtaccgttaaccggaccctaaccgtacgttacgttccgtttaccttacgtaccg

SEQ ID NO: 301935 - DNA, 566 bp, Homo sapiens
  misc_feature: GZ8MTXP02I7H7J.8.28.C06.1.454.CMB.2.raw
  modified_base (196)..(196): a, c, t, g, unknown or other
  misc_feature (196)..(196): n is a, c, g, or t
  modified_base (323)..(323): a, c, t, g, unknown or other
  misc_feature (323)..(323): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccnggggagagagccaccctctcctgtgcggccagtcagagcgttaggacgaacttagcctggtatcagcagacggcctggccaggcctcccagacctccgtcactttcgtttggccgtcctttaaacgnggggtcccaggtggaactccccgagccgtaggttcacggcggtcaggggtcgggtctggggtacttcgttcactctcactactacaataacctgactaactctgacgtattgcttagtttactttctgtcagctagtctagacgtacgtcggtaccgtttctacgttcgggcggtacggaccgaaggtcgactacaaacggtactggcgcgcacgacatctgtctcactcctaccgctactcg

SEQ ID NO: 301936 - DNA, 688 bp, Homo sapiens
  misc_feature: GZ8MTXP02JPC2E.8.28.C06.1.454.CMB.2.raw
  modified_base (205)..(205): a, c, t, g, unknown or other
  misc_feature (205)..(205): n is a, c, g, or t
  modified_base (211)..(211): a, c, t, g, unknown or other
  misc_feature (211)..(211): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtctgttttccngggganagagccaccctctcctgtgcggccagtcagagcggttaggacgaacttagcctggtatcagcaggaggcctggccaggcctccccagacctcctcattctttggcgtcctttaacgacggggcctaggtcggaaactccccgaggtccgtacgggttccagggtccggacgtagggtcggggttctgggggtacctttcggttccacgtctaccacctatactaaactaaaccctacgtactaactccgtacgtaccgtactttacgtacttagtttactttctgttactagtctagtcgtagaacgtacgttcggtaccgtttcgtaccgtttcggggacgggtaacggggtaaccgtaacggggtaccggtacccgtaaaccggtaaaaccggtaaccgtacgggttacgggtacgttaacggacccgtaaacccgtacgttacgtttaccggtttaccgtttacgtttaacccg

SEQ ID NO: 301937 - DNA, 669 bp, Homo sapiens
  misc_feature: GZ8MTXP02H3282.8.28.C06.1.454.CMB.2.raw
  modified_base (193)..(193): a, c, t, g, unknown or other
  misc_feature (193)..(193): n is a, c, g, or t
  modified_base (199)..(199): a, c, t, g, unknown or other
  misc_feature (199)..(199): n is a, c, g, or t
  modified_base (210)..(210): a, c, t, g, unknown or other
  misc_feature (210)..(210): n is a, c, g, or t
tcagctcgcgtgtccacgaccggtgctcgatttagagctcacgtattgggtttgggggaggaactgctcagttaggacccagacggaaccatggaagcccagcgcagcttctcttcctcctgctactctggctcccagagatcattggagaagtggtgatgacacagtctccggtcaccctgtctgttttccngggganagagccacctntcctgtgcggccagtcagagcgttaggactaacttagcctggtatcagcagacgctggccaggctcccagacctctcattcgtttcggcgtacctttaacgacggggtcccaagtacggaaacttcccccgaaagtcccgaagggtttccaggccgggtctacggtggggtcctagggggtaccctttcggttaccactcctacaccattaccaaacttacctgactaaagttctacggactacgtttcgactttaagttttcttacgttagtacaagtctaagtccgttagaacgtccgtggtcccgtttacctaaccggtttcgggtacgggaacgggtaacccgtaaagggtaccggaaccgttaaccgaaaacggaccgttggtcgggacctacggaccacccttaagtcgttaacggtttacttacgtacttacccgttcccgacctacttccg

SEQ ID NO: 301938 - DNA, 561 bp, Homo sapiens
  misc_feature: GZ8MTXP02HPY8R.8.28.C06.1.454.CMB.2.raw
  modified_base (308)..(308): a, c, t, g, unknown or other
  misc_feature (308)..(308): n is a, c, g, or t
  modified_base (554)..(554): a, c, t, g, unknown or other
  misc_feature (554)..(554): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccacctctcctgtgcggccagtcagagcgttaggacgaacttgcctggtatcagcagagcctggcaggctcccagactcctcatctttcggctcctttaacgnggccagtggaatcccagccaggttcagcggcaggtggtctgggacttcgttcactctcaccatacaaataaccgtgaccaaatctagtaccgtaactttgacttagttttatttcttgtcagctaagtctagaagtactggtccgtttacacgttttcgggacgggaacgggaccgaaagggtcggaacctacgaaacgaacgttgacggctacgcaacctatcctgtcttactactcctttcccnctactcg

SEQ ID NO: 301939 - DNA, 550 bp, Homo sapiens
  misc_feature: GZ8MTXP02HYNMT.8.28.C06.1.454.CMB.2.raw
  modified_base (151)..(151): a, c, t, g, unknown or other
  misc_feature (151)..(151): n is a, c, g, or t
  modified_base (193)..(193): a, c, t, g, unknown or other
  misc_feature (193)..(193): n is a, c, g, or t
  modified_base (198)..(198): a, c, t, g, unknown or other
  misc_feature (198)..(198): n is a, c, g, or t
  modified_base (202)..(202): a, c, t, g, unknown or other
  misc_feature (202)..(202): n is a, c, g, or t
  modified_base (209)..(209): a, c, t, g, unknown or other
  misc_feature (209)..(209): n is a, c, g, or t
  modified_base (281)..(281): a, c, t, g, unknown or other
  misc_feature (281)..(281): n is a, c, g, or t
  modified_base (375)..(375): a, c, t, g, unknown or other
  misc_feature (375)..(375): n is a, c, g, or t
  modified_base (390)..(390): a, c, t, g, unknown or other
  misc_feature (390)..(390): n is a, c, g, or t
  modified_base (401)..(401): a, c, t, g, unknown or other
  misc_feature (401)..(401): n is a, c, g, or t
  modified_base (403)..(403): a, c, t, g, unknown or other
  misc_feature (403)..(403): n is a, c, g, or t
  modified_base (408)..(408): a, c, t, g, unknown or other
  misc_feature (408)..(408): n is a, c, g, or t
  modified_base (415)..(415): a, c, t, g, unknown or other
  misc_feature (415)..(415): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctccagagatcattgganaagtggtgatgacacagtctccggtcacctgtctgttttccnggganaganccacctntcctgtgcggcagtcagagcgttaggactaacttgcctggtatcagcagagcctggccaggctccagactcncatctttggcgtccttaagacgggcagtggaatcccgagccaggtcaggcgcagtggtctgggacttcgttcactctcaacatacaaataccgnacatcagactactgnttagtttactntntacanactagtnagaagtcgtcggtaccgttcgtacgttcgggacggacggtaacgtaggtacgaacctaacgtaaaacggtacgtggtcgacgtacgacctaacgtactcgtaacgtctacgtacttcccgtacccgactacgtcg

SEQ ID NO: 301940 - DNA, 663 bp, Homo sapiens
  misc_feature: GZ8MTXP02JU0HQ.8.28.C06.1.454.CMB.2.raw
  modified_base (199)..(199): a, c, t, g, unknown or other
  misc_feature (199)..(199): n is a, c, g, or t
  modified_base (205)..(205): a, c, t, g, unknown or other
  misc_feature (205)..(205): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctcccagagatcattgggagaagtggtgattgacacagtctccggtcaccctgtctgtttttccgngggganagacgccacctctcctggtggcggtccagtcaggagcgttaggacaacttgcctggtatcagcaggtagcctggccaggcctacccagtacctcgtcattcgtttggccgtacctttaacgacgggtccaggtcggaactcccgaggccgtaggttcaggcggcgaggtcgggtctggggtacttcggtacactcctcactatacaatactgactaatctagactacttgcttagtttattctacgtacctagtactaggttctaggtaaacgtacgtcggtaccgttacgttacgttaccgggacgggtaaccgggtaacgtaaacggggtcggtaaaacccgtacgtaaaaacccggtgttacggttaacggcgttacggtaccaaaaccgtacgttccgtaacggttaacctttcgtaaccggttccccttaacccggtccgttaacgttacccg

SEQ ID NO: 301941 - DNA, 695 bp, Homo sapiens
  misc_feature: GZ8MTXP02G76BG.8.28.C06.1.454.CMB.2.raw
  modified_base (197)..(197): a, c, t, g, unknown or other
  misc_feature (197)..(197): n is a, c, g, or t
  modified_base (203)..(203): a, c, t, g, unknown or other
  misc_feature (203)..(203): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgngggganagacgccaccctctcctggtcgcggccagtcagagtcgttaggacgtacttagctggtatcgagcaggaggcctggccagggcctcccgagtacctcctcagttctttggccgtacctttaaaggcggcctagtacggaactccccgaggtccgtacggttacgacggtccggcgtaggggttcggggtcgttcggggtacctttccggttcaccgttcctacacctaataccaaacttacctagacctaaagttctacgtacgttacgtttacgtcgtttaaacgtttttattccccgttagtacccgtagtaccgtagttaccggttaggaaacgtacggttccgggttcccggtttacgtaccgggtttacgggacgggggtaacgggaccggtaacggggttacgaccgttaaccgaaaacggtaccgtggtacggcgtcgacccacgtacgtcgtcgttcttactctccctttacccgactacttcg

SEQ ID NO: 301942 - DNA, 644 bp, Homo sapiens
  misc_feature: GZ8MTXP02JGOMU.8.28.C06.1.454.CMB.2.raw
  modified_base (197)..(197): a, c, t, g, unknown or other
  misc_feature (197)..(197): n is a, c, g, or t
  modified_base (203)..(203): a, c, t, g, unknown or other
  misc_feature (203)..(203): n is a, c, g, or t
  modified_base (215)..(215): a, c, t, g, unknown or other
  misc_feature (215)..(215): n is a, c, g, or t
  modified_base (268)..(268): a, c, t, g, unknown or other
  misc_feature (268)..(268): n is a, c, g, or t
  modified_base (316)..(316): a, c, t, g, unknown or other
  misc_feature (316)..(316): n is a, c, g, or t
  modified_base (400)..(400): a, c, t, g, unknown or other
  misc_feature (400)..(400): n is a, c, g, or t
  modified_base (446)..(446): a, c, t, g, unknown or other
  misc_feature (446)..(446): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctcccagagatcattggagaagtggtgatgacacagtctccggtcaccctgtcttgttttccgngggganagagccaccctntcctgtgcggccagtcaggagtcgttaggacgaacttgcctggtatcagcagngcctggccagcctccagactcctacattcgtttgccgtaccttaacgnggtccaggtcgaactcccgagtacctaggttcaggcggacgaggttcgggtactgggtacttcgtacacgtctcacataccaanacctgacaatcgtagtacgtattgacgttatttacttgtacgtacngtacgtacgtacgtaggtaaacgtccgttcgggtacccgtttacgtaaccgggtttcgggaaccgggaacggggttaacccgacgggttaccgaaaccgtttaaccggaaaacggtacgttggacggtccttaacgggcctaacggtcttaacttggttaccttcgtaaccgtcccgtttaccgaccttacgttaccg

SEQ ID NO: 301943 - DNA, 869 bp, Homo sapiens
  misc_feature: GZ8MTXP02I5JBE.8.28.C06.1.454.CMB.2.raw
  modified_base (198)..(198): a, c, t, g, unknown or other
  misc_feature (198)..(198): n is a, c, g, or t
  modified_base (204)..(204): a, c, t, g, unknown or other
  misc_feature (204)..(204): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgngggganagacgccacctctcctgtgcggcagtcagagcgttaggactaacttagcctaggtactcagcaggacggccgtcggccgacgggcctcccgaagtacctcctactactttcgtttcggaccgttaccttttaaacggacggggtcctaaggttacgggaaaaccttccccgacggtacccgtaacgggtttccgaacgggtcgggtacgtaacggggttcggggtccggttacgggggtaaccctttttccggtttaccctaaccgtttcccgttaaccccgaaaccctaactttaaacccctaaaacctttaaacccccgttagtaaccctaaaacttccgtaacggtacccgttaacgttttacgggtacctttaaggtttttaacttttcgttacggttacctacgtaccgttaacggttaccgttaagggtaaaccggttaaccggtttcccgggttacccgggttttaccgttaacccggggttttccgggggaaccgggggttaaccgggggtaaaccgggtaaacggggttaccggggtaaacccttaaaccggaaaaaccggttacggttaacgggtcggggtaccttacggacctaccgtaactttacgttccggtttaacttcctaccgttcccttccccgtaactcgtttaccg

SEQ ID NO: 301944 - DNA, 556 bp, Homo sapiens
  misc_feature: GZ8MTXP02HVQ4T.8.28.C06.1.454.CMB.2.raw
  modified_base (199)..(199): a, c, t, g, unknown or other
  misc_feature (199)..(199): n is a, c, g, or t
  modified_base (271)..(271): a, c, t, g, unknown or other
  misc_feature (271)..(271): n is a, c, g, or t
  modified_base (278)..(278): a, c, t, g, unknown or other
  misc_feature (278)..(278): n is a, c, g, or t
  modified_base (291)..(291): a, c, t, g, unknown or other
  misc_feature (291)..(291): n is a, c, g, or t
  modified_base (306)..(306): a, c, t, g, unknown or other
  misc_feature (306)..(306): n is a, c, g, or t
  modified_base (325)..(325): a, c, t, g, unknown or other
  misc_feature (325)..(325): n is a, c, g, or t
  modified_base (332)..(332): a, c, t, g, unknown or other
  misc_feature (332)..(332): n is a, c, g, or t
  modified_base (353)..(353): a, c, t, g, unknown or other
  misc_feature (353)..(353): n is a, c, g, or t
  modified_base (357)..(357): a, c, t, g, unknown or other
  misc_feature (357)..(357): n is a, c, g, or t
  modified_base (361)..(361): a, c, t, g, unknown or other
  misc_feature (361)..(361): n is a, c, g, or t
  modified_base (372)..(372): a, c, t, g, unknown or other
  misc_feature (372)..(372): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcacccctgttcttgtttttccgnggggagagagcccaccctctcctgtgcggccagtcagagcgttaaggactaacttagcctggtatcagcagngctggcnggctccagctccnatcttggctcttagnggcagtgatccagcaggtnagcggcnggtgggtctgggacttcgtcnctcncacntacaaataccngacatcagtaccgtatttgctttaagtttttctttactgtcgtagctagttctaaggacgtacgtcgggtccgttacgtacggtttcgggcgggtaacgggaccgtaagggtcgaccctacgaaaacgtacgtggtacgctcgtacacctatcgtaagtcttacacttccctacccgctactcg

SEQ ID NO: 301945 - DNA, 685 bp, Homo sapiens
  misc_feature: GZ8MTXP02JCTK9.8.28.C06.1.454.CMB.2.raw
  modified_base (198)..(198): a, c, t, g, unknown or other
  misc_feature (198)..(198): n is a, c, g, or t
  modified_base (282)..(282): a, c, t, g, unknown or other
  misc_feature (282)..(282): n is a, c, g, or t
  modified_base (290)..(290): a, c, t, g, unknown or other
  misc_feature (290)..(290): n is a, c, g, or t
  modified_base (294)..(294): a, c, t, g, unknown or other
  misc_feature (294)..(294): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctttgtttttccgnggggagagacgcccaccctctcctggtcgccggccagtcaggagtacgttaaggacgtaacttgccttggtatcagcaggcgcnggcagccnccancctctctattcgtttggccttacttaacggcggtaccaggtacggaacctcccgaggaccgtacggtcgaggtccggtacgtagggttcgggtcgtacggggtcctttcggttaccacttcgaccaactactaactaaaacctaccgtgtaactaaactccgtaaggttaccgttactttacgttacgtttaagtttttacttcgttcgtacagttctacggttcgaaagtacggtacgttcggttacgtttaccgtacgggtttacggggacggtacgggtaaccggaggtaccgtaacgtaacgaaacggtacgtgggacgtactacggtacctacgtctttacgtcgttaccgttaccttaccgttcccgttcctacgttactaccgg

SEQ ID NO: 301946 - DNA, 680 bp, Homo sapiens
  misc_feature: GZ8MTXP02GIEJS.8.28.C06.1.454.CMB.2.raw
  modified_base (197)..(197): a, c, t, g, unknown or other
  misc_feature (197)..(197): n is a, c, g, or t
  modified_base (359)..(359): a, c, t, g, unknown or other
  misc_feature (359)..(359): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgnggggagagacgccacctctcctgtcgcggcagtcagagcgttaggactaacttagcctggtactcgagacagaggcctggccgaggccctaccgagtacctcctactatttccgtttacggccgtttaccgtttaaacgcgggtacccaggtaacgtaaccncccgtaacgccggtagttcgacggcggcgtacgggtcggtacgtggtcttcgtcacgtctaccacgactacaacgtacacgactaatcgtaacgtactgttcgtactttagtttatttcgtcgtactacgtacagtttacgaggaaacgtcgttacggtacccgtttacgttaaccggttccggggaacgggtaccgggaaacggtacgggttaaccgaaccgtaaaccgtaaaacggtacgttagggtacgtcgtacgaccgttaccaagttccctgtttacctaccgttacttcccggttccccgacttacggtaaccg

SEQ ID NO: 301947 - DNA, 600 bp, Homo sapiens
  misc_feature: GZ8MTXP02FMKB6.8.28.C06.1.454.CMB.2.raw
tcagctcgcgtgtccacgaccggtgctcgatttagagctcacgtattggggtttgggggaggaactgctcagttaggacccagacggaaccatggaagccccagcgcagcttctcttcctcctgctactctggctcccagagatcattggagaagtggtgatgacacagtctccggtcaccctgtcttgtttttcctggggagagagccacctctcctgtgcggccagtcagagcgttaaggacgtaacttagcctggtatcagcagaggcctggccaggcctcccagacctcctcattctttggccgtacctttaaacgcgggccaggtcggaactccccgagcccgtaggttccaggccggcaggtggggtctcggggtactttcgtcactctcacctatacaaactactgactaactctagtacgtatttgacttagtttattctgtcagtcagtctagaagtcgtcggtccgttactacgtttcggggacgggtacggggaaccaagggtaccggaacccttaacgaaaacggtaacgtggtcgggctacgaccacctattccgtgttaccttctactcccgttacccgctactcc

SEQ ID NO: 301948 - DNA, 624 bp, Homo sapiens
  misc_feature: GZ8MTXP02FLE5Z.8.28.C06.1.454.CMB.2.raw
  modified_base (196)..(196): a, c, t, g, unknown or other
  misc_feature (196)..(196): n is a, c, g, or t
  modified_base (361)..(361): a, c, t, g, unknown or other
  misc_feature (361)..(361): n is a, c, g, or t
  modified_base (405)..(405): a, c, t, g, unknown or other
  misc_feature (405)..(405): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccnggggagagagccaccctctcctgtgccggccagtcagagcgttaggactaacttagcctggtatcagcagaggcctggcaggcctcccagactcctcattcgtttggccgtacctttaaacgacggggtccaggtcgaaactccccagccgtaggttcaggcggnacggtgggtctgggtacttcgtcactctacactatacaactacngacactctacgacgtacttgacttagtttactttctgtcagtcagtctagaacgtcgtcggtaccgttactaccggtttcgggacgggtacggggaacgtacgggtacggtaaccgtaccgaaaacggtacgtagggttacgggccttacggaccctaaccgactttacttcggtacctttcctaacggtttccccttcccggtacctacgtttaccgg

SEQ ID NO: 301949 - DNA, 831 bp, Homo sapiens
  misc_feature: GZ8MTXP02GSQGZ.8.28.C06.1.454.CMB.2.raw
  modified_base (208)..(208): a, c, t, g, unknown or other
  misc_feature (208)..(208): n is a, c, g, or t
  modified_base (214)..(214): a, c, t, g, unknown or other
  misc_feature (214)..(214): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtcttgtttttccgngggganagagcccaccctctcctgtgcggccagtcagagcgttaggacgtaacttagcctggtatcagcagacggcctggccaggccctaccccgagtacctcctactacgttccgttttacggcccgttacccttttaaaccggacggggtacccgtaagggttaccgggtaaaaccttcccccgaaacggtacccgtaaccggggtttcccgaacggggtccgggaccggtaaggggtttcggggtaccgttcgggggtaaccttttccgggtttaccacccttcccgtaacctaaaccctaacttaacctaaaaccttaaacccgtgtaacctaaacttccgtacgtaacccgttacttttacgtaccgttaacgttttaacttttcgtacgttacgtaacgtcgttaacgtaccgttaaggtaaacggtaaccgttccggggttcccgtttaaccgttccgggtttaccggggaaccgggggtaaaccggggtaaacccggtaaacggggtttaccggaaacccggtttaaaaccggaaaaccggttaccgtacgggttccggtaccgtaacggtcccaaaccggttcttaccgttcggttaccctttaacgttccccg

SEQ ID NO: 301950 - DNA, 770 bp, Homo sapiens
  misc_feature: GZ8MTXP02F7XPK.8.28.C06.1.454.CMB.2.raw
  modified_base (198)..(198): a, c, t, g, unknown or other
  misc_feature (198)..(198): n is a, c, g, or t
  modified_base (204)..(204): a, c, t, g, unknown or other
  misc_feature (204)..(204): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgngggganagacgcccaccctctcctgtgcggccagtcagagcgttaggacgaacttagcctggtatcgagcaggacggcctggccaggcctcccgagacctcctctattcgtttcggccgtacctttaaacgcggggtaccctaggtacggaactccccgagacccgttaagggttccaggccggacgagggttcggggtccttacggggtacctttccggttcctaacgttcctaccaaccgtaattaccctaaaacgttaacccgtgaacctaaacgttcgtaacggtacgttaacgtttcggtactttaacgtttttacttttccgtacggttacctacgtacttaacggtaccgttaaggtaaacggtaccgtttcgggttaccccgggtttaccttaaccgggtttccgggggaacggggttaaccggggaaccgtaaacggggttccgggtaaacccgtaaacccggaaaacggttaaccgttggggtaccggtacttaccggaccgtaacctacgtttccgtcgtttaccttcctaccgttcccttacccggacttaccgttacgg

SEQ ID NO: 301951 - DNA, 626 bp, Homo sapiens
  misc_feature: GZ8MTXP02HOJ0C.8.28.C06.1.454.CMB.2.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (290)..(290): a, c, t, g, unknown or other
  misc_feature (290)..(290): n is a, c, g, or t
  modified_base (311)..(311): a, c, t, g, unknown or other
  misc_feature (311)..(311): n is a, c, g, or t
  modified_base (377)..(377): a, c, t, g, unknown or other
  misc_feature (377)..(377): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccngggganagagccaccctctcctgtgcggccagtcagagcgttaggacgaacttagcctggtatcagcagaggcctggccaggctcccagactccncatctttggcgtcctttaagngggccagtggaactcccagccaggttcagcggcaggtgggtctggggacttcgtcactctcacctntacaaatacctgactaatcctagacgtactttgactagttttattctcgttacagtctagtcttaggaacgttacgtcgggtaccgtttacgaccgtttcggggacgggtaagggggtaccctaaggggtcggtaaccctacgtaaaacggaacctttggggaacggtccgttacggaccctaccgtaacgtttccgtaacggtttcccgtttctacctttacccgtttcccccggacctactttccgg

SEQ ID NO: 301952 - DNA, 809 bp, Homo sapiens
  misc_feature: GZ8MTXP02IFCX0.8.28.C06.1.454.CMB.2.raw
  modified_base (197)..(197): a, c, t, g, unknown or other
  misc_feature (197)..(197): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcacccttgtcttgtttttccnggggagagagcccaccctctcctgtgcggccagtcaggagtcgttaaggacgtaacttagcctggtatcagcaggaggcctggccaggcctcccagacctcctctatttcgtttacggccgttacccgtttaaacgacggggtacccaaggtttaccgggaaaacttcccccgaaaggtcccgtaacgggtttaccgaacggtccgggaaccgtaaggggttcggggttaccgtcgggggtaccttttcggtttcccaacgtttccgtacccaaaccctatttaacccaaaacttaacccgtgaaccctaaatttccgtaacggtaaccgttacgtttttcggtacctttaaggtttttactttcgttcgttacgtaacgtcgtaaggttccgtagggtaacggttaacccgttcgggtttacccggtttaccgtaaccgggttttaccgggggaccggggtaacgggggtaaccccgtaaagggggttaccggaacccgtttaaccgaaaaaccgggttaacgttacggggtcggttccgtacggaccctaccgtaacttccgttaacgttcttaccgtaccttacccgtttccccgacttaacgttcccg

SEQ ID NO: 301953 - DNA, 614 bp, Homo sapiens
  misc_feature: GZ8MTXP02I2SRK.8.28.C06.1.454.CMB.2.raw
  modified_base (206)..(206): a, c, t, g, unknown or other
  misc_feature (206)..(206): n is a, c, g, or t
  modified_base (223)..(223): a, c, t, g, unknown or other
  misc_feature (223)..(223): n is a, c, g, or t
  modified_base (301)..(301): a, c, t, g, unknown or other
  misc_feature (301)..(301): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtctgtttttccnggggaagagccaccctntcctgtgcggccagtcagagcgttaggactactagcctggtatcagcagaggcctggccaggctcccgagtactcctnattcgtttaggcctacctttaacgagggcctaggtcggaactcccgagcctaggttccagcgtcaggtcgggtctggggaccttcggtaccactctcgactactacaaactaacctgacaaattctagtaaccgtctttggtaccttaggtttactttcgtagttccgaggtactacggtcgtagaacggtactcggtccgttaactccggttacggacgggtaacgggtaccgaagggtacggacccgtaaacgaaaccgtacgtaacggtcgacgtgtacccgacgttacgtcgtactccttacgtaaccg

SEQ ID NO: 301954 - DNA, 670 bp, Homo sapiens
  misc_feature: GZ8MTXP02FH3FA.8.28.C06.1.454.CMB.2.raw
  modified_base (208)..(208): a, c, t, g, unknown or other
  misc_feature (208)..(208): n is a, c, g, or t
  modified_base (213)..(213): a, c, t, g, unknown or other
  misc_feature (213)..(213): n is a, c, g, or t
tcagctcgcgtgtccacgaccggtgctcgatttagagctcacgtattggggtttgggggagagctctgggggaggaactgctcagttaggacccagacggaaccatggaagccccagcgcagcttctcttcctcctgctactctggctcccagagatcattggagaagtggtgatgacacagtctccggtcaccctgtctgttttccnggganagagccacctctcctgtcgcggccagtcagagcgttaggacgtaacttagcctggtatcagcaggacggccgtggccaggcctaccccagaccttcctcacgttcgtttcggccgtaccctttaaacggacggggccctaaggttacggaactccccgaggtcccaaggggttccaggccggacgtagggtcggggttcgtgggggtacctttcggttaccaccgttcctacaccattacaaacttaacctgactaaatctacgacctacgtttgtcgttagttttacttctagtactacggtctacgttcgtagaaacgttcggtacggtcccgtttactaccggtttcgggacggggaacgggaaccgtaggggtacggtacctaaacgaaaaccggtaacttcgggtacggtctaacggacctacctacgttccggtagtacccttacgtaccc

SEQ ID NO: 301955 - DNA, 904 bp, Homo sapiens
  misc_feature: GZ8MTXP02F7ACK.8.28.C06.1.454.CMB.2.raw
  modified_base (197)..(197): a, c, t, g, unknown or other
  misc_feature (197)..(197): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctccagagatcattggagaagtggtgatgacacagtctccggtcaccctgtcttgtttttccgnggggagagacgccacctctcctggtcgcggccagtcagagtcgttaggacgtaacttagccgttggtactcagcgagacggcctggaccaggcctacccacgtacctccctctacttcgtttcggccgtacctttaaacggacgggtacccaggttacgggaacctccccgaaggcccgtaagggtttaccgaacggccgggtacgtaacgggttcgggtaccgttacggggtaccgttttcccggtttacccaaccgtttccttaccccgaaacccgttaacttaaacccgtaaaacctttaaaacccgtcgggtaaaccttaaaaccgtttccgttaaccggttaaacccgggttaacctttttacggtaacccgttttaaaagtttttcccgtttttaacggttacgggtttacccaaagggtccgttaaacggtttacccgttaaaggggtaaaacccgttccggttacccggggtacccggttttaacccgttaaaccgggggtttttacccggggaaccggggggttaaacccggggtaaaccgggttaaaggggttacccggggtaaaacccttaaaacggtaaaaccggttaaaacgtttcggggtacggtaaccgttaccggaaccgtaacctaacgttccggttaacgttaccctttacggaccctttcccggttacccgtacctactttaacccgg

SEQ ID NO: 301956 - DNA, 592 bp, Homo sapiens
  misc_feature: GZ8MTXP02FQS98.8.28.C06.1.454.CMB.2.raw
  modified_base (195)..(195): a, c, t, g, unknown or other
  misc_feature (195)..(195): n is a, c, g, or t
  modified_base (311)..(311): a, c, t, g, unknown or other
  misc_feature (311)..(311): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttccnggggagagagccaccctctcctgtgcggccagtcagagcgttaggacaacttagcctggtatcagcagagcctggccaggctcccagacctcctcatctttggcgtcctttaacgngggccaggtcggaatcccagccaggttcagcggcaggtggggtctggggacttcgtcacttctcaccataccaaataacctgacaaatctagtacgtactttgaccttagtttatttctgttcagtcagtctagtaagacgtcggtaccgttctaccgtttcgggacgggagggtaccgaaggtacgggaccttaacgaaaaccgtaacgtggtacgcgttacggcctaacctacttccgtcgttcctttactaccttccctttaccccggactacttccg

SEQ ID NO: 301957 - DNA, 571 bp, Homo sapiens
  misc_feature: GZ8MTXP02HF4QV.8.28.C06.1.454.CMB.2.raw
  modified_base (206)..(206): a, c, t, g, unknown or other
  misc_feature (206)..(206): n is a, c, g, or t
  modified_base (212)..(212): a, c, t, g, unknown or other
  misc_feature (212)..(212): n is a, c, g, or t
  modified_base (273)..(273): a, c, t, g, unknown or other
  misc_feature (273)..(273): n is a, c, g, or t
  modified_base (303)..(303): a, c, t, g, unknown or other
  misc_feature (303)..(303): n is a, c, g, or t
  modified_base (323)..(323): a, c, t, g, unknown or other
  misc_feature (323)..(323): n is a, c, g, or t
  modified_base (413)..(413): a, c, t, g, unknown or other
  misc_feature (413)..(413): n is a, c, g, or t
  modified_base (432)..(432): a, c, t, g, unknown or other
  misc_feature (432)..(432): n is a, c, g, or t
  modified_base (444)..(444): a, c, t, g, unknown or other
  misc_feature (444)..(444): n is a, c, g, or t
tcagctcgcgtgtccacgaccggtgctcgatttagagctcacgtattggggtttggggagagctctgggggaggaactgctcagttaggaccagacggaaccatggaacgccccagcgcagcttctcttcctcctgctactctggctccagagatcattggagaagtggtgatgacacagtctccggtcacctgtcttgttttcgngggganagacgccacctctcctgtgcggcagtcagagtcgttaaggacgtaacttacgcgtaggtancagcaggagcaggccaggctccagacctcntatcttaggctacttaacgnggtccagtaggaaactccagacctaggtacaggcggcgtagggtggtactggggtacttcgttcacttctacaactatacaaataacctnactatctacgacttacttntattactttctntgtatagatagtactaagacgtcgtcggtacctacgtacggtcgggaacggaacggtacgaacggtacgaaacctaaacgaaacgtacgtcggagacaacgactaacgtacttcgtcttacttacac

SEQ ID NO: 301958 - DNA, 778 bp, Homo sapiens
  misc_feature: GZ8MTXP02FLWIS.8.28.C06.1.454.CMB.2.raw
  modified_base (198)..(198): a, c, t, g, unknown or other
  misc_feature (198)..(198): n is a, c, g, or t
tcagctcgcgtgtccacgaccggtgctcgatttagagctcacgtattggggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgnggggagagacgccaccctctcctgtgcggccagtcagagtcgttaggacgtaacttagcctaggtatcgagcgaggacggccgtggaccagggccctacccgagtacctcctctatttccgttttcggaccgttacccgtttaaacggacggggtacccgtaggtacgggaaacctccccgaaggtcccgtaagggttccgaagggtccggtacgtacggggttcggggtacgtcggggttacctttccggtacctacgttccaccgacctactacctaaactaaccctgacctaaacgttccgtacggtaacgttactttacggtactttacggttttactttcgtcggttacacgtcgtaagttccgtaaaggtaaacggtccgttcgggttacccggtttacgttaacccggggtttccgggggaacgggtaacgggggtaaacccggtaacggggtacccggtaaaccgtaaccggtaaaaccggttacgggttggtacggtaccgttacgacctaacccgtgttacccgttcgttacttcctaccgttaccccgttccccgtataccgttaccgg

SEQ ID NO: 301959 - DNA, 819 bp, Homo sapiens
  misc_feature: GZ8MTXP02IBIYS.8.28.C06.1.454.CMB.2.raw
  modified_base (208)..(208): a, c, t, g, unknown or other
  misc_feature (208)..(208): n is a, c, g, or t
  modified_base (214)..(214): a, c, t, g, unknown or other
  misc_feature (214)..(214): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgtcttgtttttccgngggganagacgccaccctctcctgtcgcggccagtcagagcgttaggacaacttgctggtatcagcaggacggcctggccaggcctaccccgagacctcctcattccgttttcggccgtacccttttaaacggcggggtacccgtaggtacggtaaacctccccgaagacccgtagggttccacgggccgggactacggggttcggggtccgttcgggggttacctttttccggttacctacccgttcctaccctaaaccctaacttaaccctaaaacttaaacccccgttagaacctaaaacgttcccgttacggtaaccggtttaacgtttttacggaccttttaaaggttttttacttttcgtttacggttaccgtaacggttaccgttaaacgggttccgttaagggtaaaaccgggttaccggtttccgggggttaccccgtttacggtttaacccggtttccgggggaaacccgggggtaacggggtaaacccggttaaagggggttaccggaaaccgttaaaccggaaaaaccggttaacgtcgggttaacggccgtaacggacccaaccgttacgttaccgtttacgtttcctttacctcccg

SEQ ID NO: 301960 - DNA, 659 bp, Homo sapiens
  misc_feature: GZ8MTXP02GWL58.8.28.C06.1.454.CMB.2.raw
  modified_base (197)..(197): a, c, t, g, unknown or other
  misc_feature (197)..(197): n is a, c, g, or t
  modified_base (203)..(203): a, c, t, g, unknown or other
  misc_feature (203)..(203): n is a, c, g, or t
  modified_base (278)..(278): a, c, t, g, unknown or other
  misc_feature (278)..(278): n is a, c, g, or t
  modified_base (302)..(302): a, c, t, g, unknown or other
  misc_feature (302)..(302): n is a, c, g, or t
tcagctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgngggganagacgcccaccctctcctggtcgccggcaggtcagagcgttaggacgtaacttgcctggtatcagcagacggccnggccaggccctccgagtcctcctnattcgtttggccgtacctttaacgagggaccaggtacgaactcccgagcctaggtcaggcggctaggtggtcgtgggtacttcgtcactctacactatacaacttaactgactaatctacgtacgtacttacgtcttagtttacttgtcgtacctagtacgtacgttacgtaacggtaacgttacgttcgggttaccgtttacgtaccggtttaccggggacgggtaacggggtaaccggtaaaggggtccgtaaacgtaaccgtaaaacggtacggtacgggttacggtcgtacgaccgtacgtaacgttcgtaacgttccttactaccgttcccttacccggaccttacttaccg

SEQ ID NO: 301961 - DNA, 641 bp, Homo sapiens
  misc_feature: GZ8MTXP02GDLNF.8.28.C06.1.454.CMB.2.raw
  modified_base (209)..(209): a, c, t, g, unknown or other
  misc_feature (209)..(209): n is a, c, g, or t
  modified_base (215)..(215): a, c, t, g, unknown or other
  misc_feature (215)..(215): n is a, c, g, or t
  modified_base (353)..(353): a, c, t, g, unknown or other
  misc_feature (353)..(353): n is a, c, g, or t
  modified_base (391)..(391): a, c, t, g, unknown or other
  misc_feature (391)..(391): n is a, c, g, or t
  modified_base (434)..(434): a, c, t, g, unknown or other
  misc_feature (434)..(434): n is a, c, g, or t
tcagctcgcgtgtccacgaccggtgctcgatttagagctcacgtattgggtttggggagagctctggggaggaactgctcagttaggacccagacggaaccatggaagccccagcgcagcttctcttcctcctgctactctggctcccagagatcattggagaagtggtgatgacacagtctccggtcaccctgttcttgtttttccgngggganagacgcccacctctcctgtcgcggccagtcaggagtcgttaggactaacttagcctggtatcagcaggacggccgtggccaggcctcccagacctcctcacttcgtttcgcgtacctttaagacggcctaggtgaacncccagccgtacggttcaggtcgcgtaggtcggggttcnggggtacttcggttacacctcgtcactactacaaacttacctnacaactgtagtacgtaacttgtaccttagtttactttacgttcgtactacggtactacgttacgtaacgaaacgtccgttacggttacccggttaactccgggttacggggtacgggaccgggtaaacgtaacgggtacgttaacccgtacgaaaaacgtcgttaacggcgggactaacgacaacctcgccttacgttcttactacc
